United States Patent 7,745,391 (HUMAN THROMBOSPONDIN POLYPEPTIDE) - sequence listing, part 52

SEQ ID NO: 150704 - DNA, 528 bp, Homo sapiens
tcaagacagagggtcagtttcaggccttggtcagtgaatctccaagcccaatttgaagcctaattagtaggaggcagggtaagtgctagaagaggttgcacttctttacagcaaagaaaagtcattttcaaaggtgtgtatgttgtcattccactgcaaggagagcagacaccaggaaatatgttgtgatattaggacatcaagagtaagctgggaattgaggaaaataatttcatagtaaacatatggaataattggccagtggtgcaagaaatctaaatgaggtacagagacagctggacacttttatctcaagagagaaaggattgaaggatagagtgataaaccagggaggtggggtcgagataaacctaaagggaacaagcctgctggactaaatatcctctctctgctcagcaatttccaccgcggccatttgttaaacgcatagctgccatcttcagtgattatttccaagtaacatctatgtttctgaataaaaatccatttgaatctcaagtcagattt

SEQ ID NO: 150705 - DNA, 719 bp, Homo sapiens
tacttttcagccctgctctcttcctcctctccttctgggggacaccaataacaagacacttagatcttttgttatagtcccacaggtcccttagcaccacctcattactgccaggtactcgtagaagtctaggttcctctttggcctctgttggcaagccagggggagaagaggctcttgattaactgctgggctgagttgggagctccctctccctactaggccactgctttgtctgagaggggaaggattgctttattatttcttaccatctggtttccactgacacccaagtggtgtggccatggtatctctggccagtggtgaaaattctgactctgcagtaggtctctgacactatcccactagggagggaaaacagtgtctcatcattgccacgggaagatagatatccaagctcctcacatggtctctaagggaataaggaactaattactgtgggtggggatgagagtcccaagccctcactacttggccttcttaacctggcatggggttgaagcaccttctaataccctgatgagcatggaagtctaggctccccattcagcctttgttgcatgagtcggaaatctattgcatggcagggtgactataatgtattatatatttcaaaatagctaagatagcaaatttcaaatttctcaccacaaaaaaataagtgatgggtatgttaattagcttgatttaatcattcc

SEQ ID NO: 150706 - DNA, 426 bp, Homo sapiens
cgtgaaaaggcaggcatcgtgtcagggtgcatagtcgactccagagtatacacgccgttgttcatacctaagtctcttgggagacctgagactcctactcaagaggggcgcgatcctacctgtatctcttggagaattcccacctattggccctatatgatgaggtcccagggactggaatgacgactatagaccttaaaagagacctcggatctttaagtctgacaccttaccgtaggcctctagccccaaaatcctggaggggaggaaagaaggtgtctcacatccctaccgccagagaagactgtcaggcccagtgaaaacgcctagatcccttggggcgatctcaaacagccttccttgagtcccttcacagtctgggggtcccatctgccgtggccgctcacccctcaccccacagctctt

SEQ ID NO: 150707 - DNA, 1036 bp, Homo sapiens
ggtgtttcctgctccagggattatcgtgatcacggatggggtgacagtgtacctgatgttgctgtctgtgagacactgctgaaccagcttcgcagtggcactgtggcttgttcctttgtccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggtgagaggcacactgaggctctcagcaccgcctatttaatgagcacctggtctctgcaagcagcaaccctgcctggccttgcgccggaagaagcacactgagaaggaggtgccagccgacttggcagcactgtgtcgtacggcttcgagagggctacagtgtccgagaggtcacactggccaaaggagggtcccaacttggaggtaaagctggtgctgctgtggaaacacaacatgcgcattgagtatgtggctatggcatcctggcccctggagcctgagggccctcgagtaacacgggtggaagtgacgatggaaggcggctacgacattttgcatgatgtgtcctgtgcactaaggcagcccattcgttcattgtatcgtacccatgttatccggcgtttctggaacacgctgcagagcatcaaccagacagaccagatgcttgcccaccttcagtccttctcctcagtgcctgagcatttcacgcttcctgacagcaccaagagcggagtgccactcttctacatccctccaggctccaccaccccggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacgtgggtgc

SEQ ID NO: 150708 - DNA, 325 bp, Homo sapiens
ttacagaatcatcactggagctatcccatgggacccagtgctgcgtgtgtcctggaaaccacctgagggaggtcacagcccttatgcacctactgctcactcagccccataatgactgttcttaacccatctatggattgtgaagtttatctagttgtttataactttttttttagcgaaatagaatagaaaacatcaaagtgcatacgtgtagcaaagatggagtttcactctcgttgcccaggctggagtgcagtggcatgatcttggctgaccgcaacctctacctcccgggttcaagtgattctcctgcctcagcctcccg

SEQ ID NO: 150709 - DNA, 628 bp, Homo sapiens
ctagctgagtgccacgtgctgacgtcactaagatcaatacagcaaactctgaaagatggacagagagacaggagatggtcctttataatgcagtgtgatctgtgctgcaatagagttttggaagctagaagttcaaaacgaggtgttggcagcaccatgctctctctgaagatgctaggaagaatctgctccatgcctttccattcgctcctggggtttcctgcaagccctgacattccttggcttgtagatacaccaccccagtttccgcccccatcatcacatggcctcctctctgtgggtgcctctgcgttccctctattcttcttctaaggacaccgacaccagtcatagtggattaagggtccactcctaactaattacatctgcaaccaccctatttccaaataaagtcacattctaagattcctagggagaacatgaagttttgggggtgtgtggatactgttcaacctgggacatggagtaaataaatggcaagaaagattacagatgactttaagctaaagagggagatagggttaaatgtaggacttttttttttttccaggacgggagaggtttaaacatgttactacattgaataaatgaaataaccatggacatg

SEQ ID NO: 150710 - DNA, 277 bp, Homo sapiens
cctttttttgatttttaatcaacattattgaaaggtataatttatataccatgatattttaaatgcacaagttctcacacaaaaattagccaggggtggtggcgaagtgctatattcccagctgctggggagctgaggtgcgaggatcacttgagtctgggagatcaaggctgcagtgagctgtgaacgtgccactgcattccagcctaggtgacagagcaagaccctgtcacaaaaaacaaacaaaaacagttattcttccttgggaactgcttat

SEQ ID NO: 150711 - DNA, 362 bp, Homo sapiens
gttagtgaatgacaggaaccagagttcaaaccctggtctgttaggcttcagagtccaaacttcttttaaacaactttttaggcgggacacaagggctcatgcctgtagtcccagctgccctcgggaggctgaggcaggagaatcacttgaacccggtaggcagaggttgcagtgagccaagatggtgccactgcactccagcctgggcaacggagcgagactctgtctccaaaaaaaaaaagaaagaaaatgcatttcatatcccactaaactcatagtaaacttgaaaaatcataagttgaaccatcataggtcgggaccatctgtatattaaaagttatataatattaaagtaggtatgt

SEQ ID NO: 150712 - DNA, 417 bp, Homo sapiens
catgtaccaccatctaagcccttcaactgggcaagccaaggccctgcaaagtcaggcttggatcatctttccaggctcaccttctatggccacccccctccaatccagctacagcaggcttctgctttcctgctcctgtgcccttcctcaggcctaccctgcactgggctgcccttcgctgatccagaagtcttactatgaggttttggtccagctcaaatgccagtccacccatcacattttcttccctgcctactccctgcagaactattacattgtattcaatgtgttggtttggttcttctgttagattgagaacttaaaaaatgaggtcttattcctccttgtgtccctggtgcttagtccaagctctcactcttgtgggcctcacactttgtacctcagtctctgccttcc

SEQ ID NO: 150713 - DNA, 384 bp, Homo sapiens
gctgaggcgggcagatcacttgaggtcaggagtttgagaccagcctggccaacataacaaaaccccatctctactaaaaatataaaaattagccaggcatggtggcgcatgcctgtaatcccagctactcgggagactgaggcacgagaattgcttgaaccctcaaggtggaggttgcagtgagctgagatcgtgccacggtactccaggctgggcggcagagtgagactccatctcaaaatgttgggggaaataatccagattcttccctgcggcccccatgccttgcaggctctgtgctgcccctcatcacctccctgccctcccctcctccctctctcccccttgctcactgcaccagccacacggacctcctcactgttg

SEQ ID NO: 150714 - DNA, 578 bp, Homo sapiens
attccaagagttcaagaccagcctggacaacgccgccagacgccctctctaccaaaaaaatacaaaagttagatgggtgtggtggtatgcacctgtagtcccagctactcaggaggctgaggtgggagaatagcttgagcccaggaggtcaaggctgcagtgagctgtgacagcaccactgcactcccgtctgggcaacagagcaagtccctttcagaaaagaaagaaaaagaaagaaagaaaaaaaagtgggggaggacaggggagggtgttttgtttttaaacattactaagcaaattgctatctagagacctcctctagtaaagttatacatctagtggtgtgctggtaaatgtgtaactaccagcttggagaagaaaatggctatttgcagtgtttgccaatttctatagtgtaaatactcccatcatggtcaatttcaataatggccatgtttaacaaccagttcacttaaattcctaccaaaacaacaatcagctctcatgaaccagtccacgccagctccagcatctacagcttacatgtagacaaccatgtggagacatatgtgctggta

SEQ ID NO: 150715 - DNA, 358 bp, Homo sapiens
caggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacacacacacacacacacacacacacacacacacacacacacacacacacacacacacacacacacacacacacaca

SEQ ID NO: 150716 - DNA, 1202 bp, Homo sapiens
ctgtatttcgccccttctagttctgatcacacagcaatgggcaatgagaaagaaagaagcatgaaaatgaacacattttcaagttaaatatgtgtttgctttaatgtctagcaggaggatatctgttgccaatcacactatgaaaggtcagttgctgaataaacacacataacatcgaccaggaggcggagaaaacacctcctttcttcctgtcttccaagggcatgtgtctggcgaccacccattcatttcagcaaacaaaaggtggaaataaccatctacattttacagaagaggaaactagagattagtgaaaacgctgtttaccttcaagtaatgaagatcatcagttagtgaataaaaggggaccatgtacaggcttggcattctgtcacttcctgggcgctggtgacagacagtcaacaaacatgcatgtgctcaattcacctgctcattggctacgaccaagtcacctctctgttctcaacgatattttatgtctatggcaataaaatgtaggctagacccaaactatgtccaaaagccagttatattttaagaagtaaaccactaaagtgctgggatttgaattacgagtcattgatttgaacagtaaggttcctgctcactctccatggggctcgtccctctggtcaaggcagaaggtctcaaatgactgtgctttgcaagaagcaagaacagcaccaattcagcgatttgccgtggctcattctccagcacgatgacacaaaagggaactgttgttaactgctttctcctcggcctttaatcaaacaaatataaattctcagactgtaactttatgagactcaaaagaaacggctccgtgcacaagtgcccactgggactgaccatgtctgaacttgggctacagcccccaacatcacaaaagcatcctttgataatgagagcccactgggttctatacgatgtctttctgatttttcaaaagttctttacgtcctcagcctttctactcaccatcagcagggagacagttacagattctacaaaacaagatgacagggtcctgctctgtaacctaggctggagtgtggtggtgcaatcacagctcactgcagccttgaactcctaggcttaagccatcctcctgcgttagccttcccagtagctgggactacaggcacttgagcccgggagttcgaggatgcagtgagcta

SEQ ID NO: 150717 - DNA, 247 bp, Homo sapiens
atctgagaacggtcctacctggacgcagtcctaacaatcattataattgaacaaattggagacgcttgctcaaaaagccagtgtcagcccagcaaggatgtcttccttctggaggatggtctcactggcattattcagtgctctctggtcagtccagtgcctctgcagttaccccgacgtacatcctcatccccttggaatggggctgggccctcgtttgaagtacgcctccacactgcctccttgc

SEQ ID NO: 150718 - DNA, 173 bp, Homo sapiens
tccttgggaaaacaagaggtgtgaggcagtcctctaggtcggaccctcccagggctgtggtcgttagagtaaagggaaagggtcacatggctgggtgtttctccaggctttctgcatgctgagcaggctgtaaccagacgtctggtcttgtccagggagagtgtcagaggcgt

SEQ ID NO: 150719 - DNA, 523 bp, Homo sapiens
accgaatagctgggaccacaggagcatgccaccaagcctggcttcctgtggctttgttttcttatgataagttctaaagggtaaaattttgggatcaaaagttgtacgcattttaaggtttttgatacatattaaccaggactccagtttttaagaagtcatttttgttgacttcgggactgtcccaattaattccctaggagatattgttcatcttgaacgtggctgctgtccataatcccaagaaaacgcttggttctgaacagctgacttttccagataaatgaggggctgctcgctgaactatagactgactttcctcgtcacagaaaatgggggaccacgaggttatgggataactcctctctcgtagaggaggggagatgtttcgtgggttttcagtcgaaccgatgtggttggcggaattcagagctggctcctgccggcgccacgccccgtagagttgtccagccacttccctgcatgaagacaggagagcacgaagagaaagtggccgttctgc

SEQ ID NO: 150720 - DNA, 238 bp, Homo sapiens
ctcaattatcttaggctatatttttcttttataattttaaacataatcagttcattcaatgtggctccagaaatcaaaagctttctatggctcaggcagagaccccatgactcgggcagtgacccaacattcctttgtttctctccatcgcaaagcactcagcagttattttggcagctatgcgggagttttgcctccacaatgaatggcatgcctgctctagcatgctgggtggaga

SEQ ID NO: 150721 - DNA, 284 bp, Homo sapiens
catctttctctgtcacttagcctcagttttcacttgtcttctgtctatattccttttctgcgtaagttgtatcacgcaaattttagattttgtggcttttttccagtttctttgagttttctgtgttctccaatgttatgtgcttcaggagagaaggctcaaagctttgctctccttaaattcaagtgtaaatgggaggcatgggtgttgagagtgatctcctataactgatctcatggtgtttccttcttgtcttgcccgtttaattcagcgctgtgattctg

SEQ ID NO: 150722 - DNA, 369 bp, Homo sapiens
atattgcactaaattatagatgcaatcaacagtgttgcctagacttaataattgctcagtgaaatctaggcattaaagaaaatgtcaaatcattcaattccctactaataatctgaaaaaattttatttaaaaccatagcaaaagtaacagcacaagacaaaattggaattttaggtgtgagtattgcaatgatcagtggatgaagagagctttggaaaattattacagtaaaataaaatactcagaaataggaatattttgccccaaattgtgccagttctgaagacttctgagttgacttttgattcaaaagattaggaatgtatgtatcatgtaacaatcagtaaagcagagaaccactctgtgaa

SEQ ID NO: 150723 - DNA, 2507 bp, Homo sapiens
  misc_feature (3)..(3): n is a, c, g, or t
ggncagtctcagtctagccttgaatgtcaggctgaggcctcttgtgttgcataaaagttagtccaggaaatgggttgggcggtctgagtccagccttgaatgtcaggctgaggcctcctgtgttgcataaaagttagtccaggtctggcatggaagacggcataaagaggagctggattgcaggcagtgagacctgttgggagaatcaaggatggcctaaaagggctgtggtgagacctggaagaggtctggagcagtgaggataaagaggctggcaaatcattagtgcttggttcatgactgccatgtgggctgatggagaggtaggaaggctctggactagctgaagtggctttggcctcttacagagtccattctggagccctctggctacagggaagcaaggccagctgtggccttcctctgaagagggcagtgggctgctgtgactctgcgttgtcacagctctgggctccccaaggtgcctggtatggctggcttgccccgggcacatcaaggggttctttgtctccttccagcaggagagtgggttggctgacctggttggggaaggaataggataagcggtgttgagcttcctggtctctgcctggcagacatattggatgataaggaaggatgcaaggagaaccagaagagaggactggggcctgaggacatggaaaacctaccttagggtggtatggcaactgggaagggtgggtttgggcctttggacacagcatacactgatcaaggggaggcacttggcaactggaggcttgtttgacctcacctagcacctttattctgttcttagaggtggtgccttggctgggacaaaacctgtgagaaggcaaacccctcagcacttacaaggggcaccaccagtggcatccggagatgagagattctggctggaaatgtggattttaggctagtgtttgagaaagggctctgaaccaggcacagggtcagagtgtcagtgatggctccaccactgacctttgtaatatgtgacttaggcacatccctcacccaaccatggggctaatgcttccagtttttttcacccagcacttactatatgtgtagccctgtgctaggctcaggatatagacctgatcttgccctcacagggaaatcagacattaaacaagtagtttcaaccagtctggtcaacatagtgagaccctgtctctaaaaaataaattagctgggcatggtggcacgtgccggtagtcctagctactacagaggctgaggctgagcctgggagtttgaggctgcagtgagctgtgattgtgccactgcactccagcctgggtgacagagcgagaccccatttctaaaaaaaattttaaaaagagaaagaagttaccaggtgtggttgtatacaaaggattgtgaggatcaaatgagataattggattaggagcatagtgtaaacaaatactgctgaacggagatctggagaccttaaccctatgccttactgagccactaactagctgtgtgaccttgagaaagttgcttaatcttggttttgttttgttttgttttgtttttttgagatggagttttgctcttttgcgcaggctggagtgaaatggcacaattgatcttggctcactgcaacctctgccttccggttcaagcgattctcatgcctcagcctcccgagtagctggggttttaggtgcccaccaccatgcccggctaatttttgcatttttagtagagacagggttttgccatgttggccaggttggtctcaaactcctgacctcaggtgatccacccaccttggccttccaaaatgctgggattacaggcatgagccaccatgccggtcaaaagttgcttaatctttttaacctcggttttccccacataaaaactacgcagtttgtatgtgtgtgtgtatgtgtgtttgtttttaagagacagggtctggctctgtcacccaggctggaatgcagtggtgcaatcacagctcactgcagcctcaacctcccaggcacaagcgatcttcccacctcagcctcctgagtagctgggattacaggctgaagccaccatgcctggctactttttttactttttgtagagacagagtctcactatgttgcccaggctggtttcaaactcctgggcacaagcgatcctccctcctcagcctcccaaagtgcttacgttataggcatgagccactgtgccagccaactaaggcagctttagtgggatggtgttgaagacagctacatctgacatcctgagactgaccgtggagtatatgaaaagtgttttgaagcctgagtaacatagggagaccccatctctacatcccataatttaaaaattagctgggcatagtggtgcgcacctgttgtcccagctacttgggaggctgaggtaggaggatcacttgagcctgggaaatcaaggctacagtgagccattattgcactactgcactccagcctgggcaatggagaccctatctc

SEQ ID NO: 150724 - DNA, 376 bp, Homo sapiens
tgggatggctggacagaagaaagtgggaagggagggtgtacatacaaagaaaggagtatagtccatttttgtaaaaatttgctaagagttacggcccagaaatgtagctaaaagaggactatagaaccaagaaaaggtttttaagattagaaattctagctcatgtttgtattgtagtaagaatgatctaaagagggcaataattaaagcaacaaatgcttaaggatgtaaaaagagatggtagggttttcccagggttgagggattgccaggtaagtgcaatgatggcacagaagggctggggaagtaggagcctttacaaaggaatgattataacaatgaactatggactccaagttggagcgggagagggaag

SEQ ID NO: 150725 - DNA, 155 bp, Homo sapiens
catcccctgtgaggtcacatatgtctgtgcccgtgtctgtgatgagtatatttaacctcagggtcaagacagaagatattggaagagaaggagaagccactggctcatttcccagtttttccatttttattgaaaaaataaaagtatttcctgta

SEQ ID NO: 150726 - DNA, 330 bp, Homo sapiens
gggcgacagctatttaaccaatcacaatggaagcattgcattcatctggtcatatatctcttgttctttcagctaaccttcttctatagcacaaatccaacaattctgcaacctttctgttacacccatacaattcactgaccctactttttctctatcttaatatctgaagataatattttggattatctcgcccttactcagttctactgtatatggagttggccatctgttaaagggaaaagaaagcagtattaaaataggcaaccatttcaccaggatccctgtgaatctcatggccctgggagctagggacctgcacaccttacc

SEQ ID NO: 150727 - DNA, 432 bp, Homo sapiens
gtacttgtggttacactaagtgcatctacctgaatcccaaagggatttgaatgggaaaaagcaaacttctaacagcttcttaaaaatcaggtgtttcaacatctgctttgatttatgagtaatcccatattccaggtcttaattatttctctaattttttattttaagaagagaaaaagctcatctattacaaagcagaataaaaatatttttgtcactgtcagataatgtaagattatttgaagaaaaatcttttacagtataaccattagtagattttaaagcagagcctctaatttccaaatcattgggaagatgcacagaaaaagacggaaaaaaaatacatccacatgtcaacaggagttttccaagaatcttattattgtgattaccctcattgcaatgtaaattttatgttttacaaactttcta

SEQ ID NO: 150728 - DNA, 814 bp, Homo sapiens
aaattccttaatgatcagaccaatttgagttggattttcagttacttgcagctaaaggaaacccaaatgatatacctgctgctgtggaaatacactaaaatggattccaaatcaggagcctaaatttgtgtcttggttcttcatttacttgcagtttgacctcagacaaataaataatttccaggcaggcactggtgcacgtgtctgtagtcccagctacacaggaggctgaggtgggaggatcactggagcccaagagttcaaggctgcagtgagctatgatcataccagtgcattccagcctgggcatcaaagcaaaactctgtctctaaaaaataaaattaaattaaaataattaataagtaaggtttctatgtaaaaggggtagatgagattacataaaaagcttctaacgctaaaattctagaatctgtgatcctaaattggtttctaaatttaaaaaatgtaaatttcatgtaatggtgaagatcattagcttcttccagagctggactacagcttgggagtaggaagacaggcctgtgtgctcttcaggatatattaagatggcacacatcaaagtgtcatttgggaagatattagcataaacaaaaaatgccacagaactgttttattaattacttgagcctcgtgttttgtccttatgagctcttttgtcctggaattctgaaaattataatttgtcagtacttttgtcactcaaattttcctctctgtcatatgtaatatatatgtacatgtacatgagcatgcacacatactatttttatatgttaaatgtcttgaaatggaa

SEQ ID NO: 150729 - DNA, 402 bp, Homo sapiens
gattagaggattcaaacgacccgaagaccagacgtgaaaccaaggattccagggcgcatagcctcgggcaggactaatggacttaaaaaacacaggctcagcaaaatccacttcacaacccagatggtccacatcacaccctctttcagggacccagagcagccactggaagagaaggagtaggaacgctctcttaaagtccacttatcctattccttcacattaagaccaaagtccaatgtatttaggtaaaaaataatttcttttagaaaatgctaaggtttgtcttctgaaatttaataacagaaacaaaaaaagaacactagaagtaaggaagtgagaccagaaaacacaaactaaactatccttactaggttggaatggatggggtggagttcctat

SEQ ID NO: 150730 - DNA, 335 bp, Homo sapiens
tgaggacagaaagtaggttctggtgaagcaagagggggataaaggtgttgattatttgacgatctttcccagcctcatccaagtttgcagtggtttttttttcctcttttttgagactgagtctcgctctactgcccaggctagagtgcagtggtgcgatctcagctcactgcaacctctgcctcctgcgttcaagtgattctcctgcctcagcctcccgagtagctggaattagaggcgcctgccaccacatccagctaatttttggatttttggtagacatggggtttcaccatattggccaggctggtctcaaactcctgacctcaagtgat

SEQ ID NO: 150731 - DNA, 513 bp, Homo sapiens
tttgccctgtttcatgtctctacatcttcagcaactagaacacatttgtgctcatgcagggcaagtaatagaacactggcctgtaaaatggagaacccaaagcaaaaatcctgtacaacattgtgaatatgaaaggaaagcattggtgtccctgtgtgatgtggtccattggggaactggattcgcttttctcaggctcaggaaactggtctgattctgattctgttttgtgttgggttgccaggaggaggggatgatggaggcggttcttccataaatccaggcttggagatacaagcaattccttttacttcaatagcactggtgaatcatctattggaacaaggtttttattctcctcacctttaaaaaaacatatctccataaagcatttgtgacgaaataaatttcttgatggtctggtgttgacagctggtattttaggcgccctgctaatgcactttgttttgccgcagtgtggtctcaggaagcctaaagctaaagagaattgag

SEQ ID NO: 150732 - DNA, 480 bp, Homo sapiens
gctgaaacagcagacttataagggttataggcctgtgttctatcttgtggtacagaatgacgcagaaagacaaaaagatgactcatacaaatcctttttcctattaatcaaaacgttgtagaagggacaaacagtgacttttaccattcattcaactggtttgtacagagagagagaccagaagcctgaagatattctttctctgaagcttccagaagaatggagtggcttttgaggatcctgcatgctgcaccatagctagaggggtgtattagtccgttttcacactgccgataaagacatatgtgagactgggaagaaagagaggtttaattggacttacagttccacattcctggggaggtctcagaatcacggtgggaggcaaaaggcacttcttacatggtggcagcaagagaaaatgaggaataagcaaaagcagaaacccctgataaacccatcagatctcgtgagacttat

SEQ ID NO: 150733 - DNA, 462 bp, Homo sapiens
aagggatgagcctcagctgaggccgggcggggctgccctcctgtgggggccacacttgtagcccaggccaagacccaggccacgcatggaggaccaacccaaagtgctgcccgcctggccggtgtgggccgatgtcactccccagccccgacccagaatcggggactgggcccaacaacaaggtgcactcaagggggtgccacccgaacacagcacgttcgcaggcacccggggtcatcaggccacgttcgcaggcacccggggtcatcaggccatgttcgcaggcacccggggtcatcaggccacgttcgcaggcacccggggtcatcaggccacgttcgcaggcacccggggtcatcaggcctgagcccaaagtttagcagaaaggagaactgagacccagagagaatgagggacatctgagatcccagagaaaggcccagctcccagcccagccctccc

SEQ ID NO: 150734 - DNA, 492 bp, Homo sapiens
taaacattagtgttcttcctaacgatcaaatgagaccctgttgtctaccttttcaaaataaaaacgttctaacacagagtaaattgctcacttgcatggagtcacatcaacaccatgaaacctcagttccaagccggattgtaggtttctagccacttgttcagctggcattccacaacctagttatataatgaccagatccctctctcctaattacatgaccaggtactgtcacagatcactgaccagggttagggacccagggacccagggtgagagaaaggaaggtaaaaccatgagggcagagttgaaagaaaactacagctttctgaaacactgtgaaaccaaaaagactaagatgagcctttcccatgcaaggaggcagttgagaaaggaggagtattatagagttaattcctaggacaagatgtctaagtagaggatgttgggcagaacccgacgtagccaccaagatgactctgtaaagtcata

SEQ ID NO: 150735 - DNA, 332 bp, Homo sapiens
gtagtccccccagtttcacagctataagagcagcatgctttcagcgcctgtgaaagaaaaagcagagagaagcaacagggtatatgatgaacccatgaatgttaaagccatccatagatactgacttcattgcttaataagtctagctgaaaacaacagattgagatcatccaaaaagtgggtgatgcaagtagtttgcagtaagatcttatagggctgaaaataaactcttaaaaccaaatggccaaaactcccttccatggacaaagccccatactgataagatgctgtgaaaataatccaaagctgttgtacagctgttgtagtcccgg

SEQ ID NO: 150736 - DNA, 279 bp, Homo sapiens
ggtaagcccaccatgttgaagggctagtgaagctggagagcaggcagtgaagggtagagatggggaaggtgtttggaggttattctggttgtaacgggaagtggctacagaaataaagtaatttgattaaatctgtgattctcaaatgtttcggtttttttagcaggagaattctttagtcaaataacaagaatttcaacctacaactagataaaggtattgctctgactggttgggaagctagttaaagcccttctgaccctctctctgacctcttgg

SEQ ID NO: 150737 - DNA, 492 bp, Homo sapiens
caagcgattctcctgcctcagcctcccaagtagctgaaattaaaggcgtctaccaccacacctggctaatttttgtattttcagtgaaacccgtctctactaaaatataaaaaaatcagctgggcgtggtggtgggcgtctgtaatcccagctactcaggaggctgaggcacaagaattgcttgaacctgggaggtggaggttgcactgagccaagatcgtgccactgccttccagcttgggcagcaaagcaaaactctgtctccaaaaaaaaagagtcctttaactttccccacagcactacaatacaggggtgatggctaagtcattgtctcgtccagtgggagagccagggctcctgtagcagccacccagcctcctaatgccagtgacaggttgacccttttcgtttttgcagcacattggacctaggcagccagtgtagcctagagtgactcaggtccctttcccaagtgaccttcaatagctcaga

SEQ ID NO: 150738 - DNA, 422 bp, Homo sapiens
gggaggattgagaaaagggcattctgataggacaggaacaggacatgggcggggacaaataagagaataaaagctgcctcccccccaacccttctccacacggagccagcagaggcaacctgctggggtcctcttccgtggtggggaagctttgttcttttgctcttcacaatagctcttgctgctgctcaccctttgggtccttgtcttctttgagagctgtaacaccaggaaggtctggggctccattctcaaaatcagcaagaccacaatcccactggaaggaaccaactccggacccaccactccctcctattacaggcccactgcaggtgccttgctgagtctagtagagaatcctgcctgagccccggccaagagtgggagccagccaggagcgggggagggaaggcaagtgcgag

SEQ ID NO: 150739 - DNA, 251 bp, Homo sapiens
taatcattcaaagagagctagtgtaggccaaagaaagggcaataggctaaagtcagatacctgaggttcaatgttgggggaatgggcttatcacctaatatcaggagtcatctttaaagaattttcctctgctattatccagaactcttccttattgcttctcagaatttttttttttttaagagatgaggtctcaccatgttgcccaagctggtcttgaactcctgagcttaggcgatcctcctgcttca

SEQ ID NO: 150740 - DNA, 221 bp, Homo sapiens
ctgaggacttcctggaagaggtgacgtttgtgttaggtataattactacaggtaaatttctacaggtggaagtggtagggttttggcaggaaggggaaaaggcaagtaatggaggaagtgattctaggtgcaggaacaatttgaactaaggtgggaagggtccagggctgcacagagcagtaatgagaacagcttgtctgaatcagagggtcggtgggagt

SEQ ID NO: 150741 - DNA, 310 bp, Homo sapiens
ggcatcactgcactccagcctgtgtaacagagtgagacactatctcaaaaaaaaaaacacacacactcacaagacaaacaacaaaacaacataatatgaagatgggaagaagacagaggaggaaggaaacgaactatggtgtactgaaaagccagatcccaataccatctcagttaaactgagagacagagttagccccccattccccaccttttttttcaagacaaggtctggctctgtcgctcaggctggagtgcagtggtgcaatctcggctcactgcaacctccacctcctgggctcaggccatcc

SEQ ID NO: 150742 - DNA, 199 bp, Homo sapiens
acgcctgtaacattttacactcccattagcagtgtgtgagagttcctgtataatataaactagggttttcagctttctataaattaagagatttcagaggactttttttactgactctccagacattggcatagtattcagccttaaaaagaactgaatttctagccaggtgccatggctcacacctgtaatcccagca

SEQ ID NO: 150743 - DNA, 235 bp, Homo sapiens
ccacatggtggactccacatttgcctacagttccacaaagtgttgtttaaattcaaatcaacctgtatttactgtgccaactttatgttcactgctgtgccaggtacagaagaatattaaaaaatgtaacaagagcctcagaggaaatgtataactactgagtgcctacagccctttgttctacttaaggtacatttactcattcagttttcactagtatttatagaccctctac

SEQ ID NO: 150744 - DNA, 416 bp, Homo sapiens
cccaaatgcaccaggtgtcttccactttctaattgagcaaggcagactcttttccagccaacagtcttaaaatatttacccaaattttgggttcactggattactgctttaagctggtgagcaacccaactgaaggtcaatgtttgtttcctgaagttgtccaatggccgtgtggtactcagacctgaaaatgataacgttactccagattgcaaactccccaaggtgcatcctggagatggaagccagcccacaatattttctgatcggtcagcataagtgatcctctcttttgagttcaaggtgggctcagaattgaaactgtcttgagataaagcagatcagccccaattcacccctgggctctgagcagaggaatgtgaaaggcccctccagtcagggaaggcatctgctcc

SEQ ID NO: 150745 - DNA, 408 bp, Homo sapiens
tgaacctcaactctaccaactgtgaattctacattcagcaaacttagtttaatctgtgaagactaagtcattctcacatttctgggaattaaggaaatctaaaattaatgcatccatcattcaattctatgagctcccagttcgcctcgtcgccatgcctcggaaaattgaggaaatcaaggattttctgctcacagtccgatgaaaggatgccaaatccgtcaagatcaagaaaaataaggacaatgtgaagtttaaagtttgacacagcaaatacctttacaccctggtcatcactgacaaagagaaggcagataaactgtagtccctgccccctggtttggcagtgaaggaactaaaatgaaccagacacactgatttgtgctgtattaaaatactaaaaatcct

SEQ ID NO: 150746 - DNA, 319 bp, Homo sapiens
ctgagggcacccttgatgggtgctgcagtgatggggagccatggaaggcttcaagcagggaagtgatgtgggcaggtttccatcttattttctgtctctcgggcctgtggtgttaaaagcagcaagacaagatgggggcctggctagccgggactaagaagacagagagtagagaaatctgcccagagaggtgttctgcggaagtccacccatgcaaagccacagctgaactgtccagaaacccaaacatacagcaaccaccattctcaagcacaacgggagggtcacctctgaaaggccagcgccagggagaagtcac

SEQ ID NO: 150747 - DNA, 150 bp, Homo sapiens
acaaggaggggagagctttgtcagccaaagcctaggggtggaacgacaatttatgtttatttactcaggtgactcatgttagggtctcattaataatcccaccaatagagagggaggggctggggaacacacaattttaagtgtatctca

SEQ ID NO: 150748 - DNA, 316 bp, Homo sapiens
taaccagcagcagtcacttctctgcagaggagaagaggtgagagtagaggaaggcagaggcctggatccgggatgaactgctgggtgcagcccggggacgggagccacgcctgcctcattcaacatcacatgctggaatccaactttgggccaccgtggtcgcgcatggaatacaggagtggacggatgggcacctaacccatgtgattcctcccccacccaatgagcagaaaacatcagtgagggggaggacaggcgagccaaatacagggaggacagcacattttctggcactgaaaccggtgctggggtcact

SEQ ID NO: 150749 - DNA, 346 bp, Homo sapiens
gtgaatttgaagggtaccgttgctacaaatacattttaaaacacactaaacaataatcataaacaaatttaaataagtgctagttaatagtctgtcaaatggtaaatatacagtttatttttgtgaccagttttgcatttctagacatcaaggaatatctaaaataatggttatctgaaggatctttttacaaaaaagttgactatgaggttacaggctgtcctccttatccctctacacacttgtatcataacaccttacagcgtttatcaaatatctgtttcctcctgttaaactgtaagctcctcaagtctcagttctgctttgtttgtatatcactgacacc

SEQ ID NO: 150750 - DNA, 454 bp, Homo sapiens
cttatgttgtaaacctgtggtctgtgtttaagacattgaaaccattagaagtagttacattagagcttttttgtttgtgctttatttacttattagagatggggtctcactttgtcacccaggatggagtacagtggctattcacaagcgtggtcgtggggcactactacatcgtgagactcctgggctcaagagatcctcccgcctcagcttcctcagtagctaggactacaagttcacaccaccacacctggctggacctgttttagcttctcaaggagtaggacagagcctaaggagagagaagacaatgaataagaaaattagggctggacatggtagctcacatctgtaatcccagcattttgggaaattgaagcaggtggatagcttgagtccaggaattcaagaccagcctgggcaacatagagaaactttgtctctacaaaacata

SEQ ID NO: 150751 - DNA, 374 bp, Homo sapiens
caggaactcaccacagttccacccctctcccaggaactcaccacagttccagccctctcccacgaacacaccagcaccggtgcaaaaaagagctcgcatgttgtcatcttggaaacagtacagcgcgtggtggggtgggacctacgacaggagagtttggtggctgggggcagggagaggatgtggggtgggagtgcagaggagcaagagcaagtcctctgagacctggtcccgggatcattttgggggagctagtcctgtcatcttcctcctccccactgttcactgagcacttactaaatggcaagttttttacagatgtttttgagttaatctttttaacttttatggagcgctgttactatccctgtttt

SEQ ID NO: 150752 - DNA, 345 bp, Homo sapiens
atgtgtgtgggggtgtgcacactcgctgggagcagggaaccaggcacttcgggcacagggggcagcttgtgtcctggtcccaggacaggagggagatgttatattgaggatatggagggagggctgtgtgaccagagcacagtgtaagcgggagatctgagagaggaggaaggcaggggctaggccacacagaaccctgtagccacatctgggatgttggccttcattctgagtgcaaaaggaagctgtgactgttaattttatgtgtcaacttggctcagccatgtgccagttgttcggtcaaccaccagtctaaatgttgccatgaagatattttttagatga

SEQ ID NO: 150753 - DNA, 465 bp, Homo sapiens
gtatatttgatccttgcagtgtcgtttactggtcctctatctcttgagtttcctgaaaagggaggttatctctagagttggattaaattcaggttcagtaatttgggcaagagtacttcataggcgggtctgtgtgcttcacataaaatcacatcaggaagcatacggtgttggactgtagtagatggtagcattaatggctccctcttaccccagcccattttttctattttgggtaaaggaattctgtttttatcagtcagctgtagctcaatctgagatgggtatgtaggaggagtaagaaattaagcttcattgttttaagccaatgagattttggaattgctcgttaccacagtataacctagcctatcctaactgatagacaagtctagaatgtggctcatcctacagggcaagcgacctggtttcttcaaaaagtcagtggcataaaaaatgttaatt

SEQ ID NO: 150754 - DNA, 174 bp, Homo sapiens
  misc_feature (148)..(148): n is a, c, g, or t
cttttacagcgaggtcattttggaaaagagcccggaatgccgcccatcccccaagcctgagagcacttcaagagtttgtaaaataaaaagcaacaggaaaccagaaacgcagcaacgtctgcatcgtgggaaggtgaagagcttcccntaaggatgacccgtccaatgccggtc

SEQ ID NO: 150755 - DNA, 307 bp, Homo sapiens
tgtcccacggaaacagttgtgccctgcgtgggcctggcagctgctcctgcagaagccacaccatgctcagagtggctcaggcagggtcctaggaccacagacctttcttcattagtggtgctttgcaggatggaggggacttgctcagatggagccagagccaggaaagcataagccaccctttctaacacatcctcatccccacacacccctgaggcggaggctgatggagggtagcagccacacctcaagtgcaggtcaggttcccgaacacagagctggaagccaaggctgatggagtgattcc

SEQ ID NO: 150756 - DNA, 301 bp, Homo sapiens
gatttatttatttcactgacgataatgtcttcaaggttcatccatgttgcggcctgcatcagaagtgcctgtttgtttttgttgtttttttttgtttggttttattttgttttgttttgcgttttcatggagtcttactctgtcgcaccggctggagtgcagtggcacaatctgggctcactacaacctccgcctcccgggttcgagcgattcttgtgcctcagcttcctgagtagctgagattagaggtgcatgccaccacaccagctaatttttgtatttttagtagagatggggtttg

SEQ ID NO: 150757 - DNA, 300 bp, Homo sapiens
aaagggacaattctcatttcaacaattcattaaggacacttagctaagtaaaatttagagcacaaggtgctgatcatcctcaagatgaatggtaaggagaaaagtggacacagttaaactgtcttttaatgccctcaactctcctgggctcaaaatcccagaaccaacgtacttctctttcattttgccaacacccacttcctctttctttcctcgggaccgtggaaatgaagtctgagtctcaacaaggtaatggctgccaacttcagagaggttttgtttttgtacttttcttttttg

SEQ ID NO: 150758 - DNA, 191 bp, Homo sapiens
tggattgggcctgaggtgatttgaagctcctgtcttggagtttaacttagttataacaaacactgagttaatcctatgcaggagacacaaagataattaatatatggtctctgtgcttgaagagacgctaattttctgtggttgaagagatgctgtgaattgtgtgatagtggcagctctcaaaaggacaa

SEQ ID NO: 150759 - DNA, 270 bp, Homo sapiens
aaaaaaaaaaatcctttagcaagtttttagaaagcagattggacctagaaatcatattcttgaaccatgttgctgtgcttgtagatccaggcaatgtttaacattacaggacagcatctaacctcataccttgaatatatgataggaatttaataaatattctggccgggggcagtggctcatgcctgtaatcccagcactttgggagtctgaggtgggcggattacttgaggtcaggagttcgcaacatggtgaaaccccgtctctact

SEQ ID NO: 150760 - DNA, 402 bp, Homo sapiens
ttagaaggtgtttctctcccacctgagcctttctctcaggaaaattctgacatatccttggactcagcacccaggtgatgggtctttgccacctatggcctgcctacatagaccattgtgaagtatagctgctttcaatacccacgtgatgtaaccgttcttccagggcactgccttctagggaaattgtgatgcatttctgtgtggatcacataggtgatgtgaatcttttcactggactgatccctgctcactgggggataacgatatgtattgctggtttcagcactgagctgatgtgattcttctcttctgcaagaaaactgacgtattgctgggcccaacaccaaggttattttgcctggcctgccctcaaaagacattgtgacatattgcagtgcc

SEQ ID NO: 150761 - DNA, 496 bp, Homo sapiens
gttatagatgttcaatcgagacagatccgctcaggaacatgtatgatcgacgaccgactattcactgaattttgtcttggacctatattttaattacaggccactctgagagtgaatcttaactagtttttttaaagggaagcatgttgacttatttcctaaggacattatgaagaaaaccagagacatttttaacctatgtaatcactgagttgccataggaaaaactgggtaattgaatatgattaaaagggagtatcttttaggtggttctataagcaagaaaattgccaccagggcaacagaaatacaggatgtaaataaaatcttcattaagcaaggtatatgtaaactctacaagtacggcaggttaatgaccataaggagagaatggccctcacctctggatgctgtggcagggacattgttacagatgatctggtttaaatggcagcatttgaaaataaaatgtaaacatgaggcagtaggagtagaa

SEQ ID NO: 150762 - DNA, 365 bp, Homo sapiens
tcatcatttggcatggaggagatgatggggttgatgattgctactgatttcaatttctttcaagatagctacagagacttacattaactgggtgctaaaatacaatgcataggtgaaggttagtgtagaaagagttggagtatatgttgtataccaacattttgctctgtaggtgcaaataatgcaagatgcttctgtgtgttatagctttattacttaagtgaattcattacataagaattctgaaatagattggattaaaacttatgggttacatgtttacaaatgataaaatagtcaatttggtggttctgattaattttctattagactaggaaaatactaagtttgtatagagtcacttt

SEQ ID NO: 150763 - DNA, 386 bp, Homo sapiens
ctgttagttacttaatactgccttgaattatgagaaagcctctatgctaaggatgacaatttttgtttgtacccctaatcacaaatgtctttgtgttttacttaatacattgaaggcatccttgatgttaggacatgtatattaatcttgcatttcggaatggccgaatagtgttgccttgtatacatgcaacatgctgtgtttagccattcctgtacacttaccttatttctttttcttttttctattataaacaagctgcaatcaaacatatattgcacacttatatgagtatgactgtaggataaatttctggaattgatatttctgtgtcatgaatatatgcattgtaatatttagtagttattgctctctagaaatttatc

SEQ ID NO: 150764 - DNA, 116 bp, Homo sapiens
tggtattaaaatgatgctgtccttatagaatgagttagggagtcaatccacatttgttaaaccctagatttcccaaacaaaattcatttcccaaggaatctttttctccacttttc

SEQ ID NO: 150765 - DNA, 538 bp, Homo sapiens
tggctcaggatacattgtccagatgttggcaaaataaaagccaaaaaggaatatttaaagtcggctgcttctcttgtgactccacagctcttttgccaaacatgcaagcttgtcttgttagaagctgaagcctgagccaaggtcttgggtggacaggacttgaaggaaactttgggccatattcaaacaatcttggactgagtagtggtcactaaattctccattagaatacagctattcacaaactcaagggaagtgaactgcgaagcaaaaactcagagcattagtattgggactttgtaaaatcagcctgcaaatctgaggaaccaaccatgctagtgtcaccaaaaggcatgaaggacatgtgggaggaagtaatgggattatcacctactatctgagacagaaggcatttttggagtctttaagactagaaggtaccttagagaccctctgctcccagttttccatatctatctctaccctggacttctgagctcagtcctctataaaagttggccagagacggtaacatcag

SEQ ID NO: 150766 - DNA, 826 bp, Homo sapiens
  misc_feature (22)..(22): n is a, c, g, or t
  misc_feature (25)..(25): n is a, c, g, or t
  misc_feature (36)..(36): n is a, c, g, or t
cctagcggactgactctcttanttnccaccgctacngatggaatctgactctgtcacccaagctggagtccagtggcatgatctgggctgactgcaatctccatctcccggcttcaacagattctactacctcagcatatagagtagctgggagtagaggtgtgtgacaccacacctggttaatttttgtattcttcatacagacagagtttgactatgttggccaggctggtctcaaactcctgacctcgtaatcctcccacatccgcctagcaaactgctgagatgagaggagtggcccactgcacccagcctactggtttatttttaaaaatagcaatttgggtcgggcgcagtgtgtctcgcctttctatatcaaccaacattctttctcgagtaggctaaggcaagagaatcgctggaacctgggaggcggaggttgcagtggcccgatactgcgccatggcctgaccaacagaacaagactccatctcaaataaattaataaatacgttagttaatcgaaaagtttaaaaagaaaacttcaaggacgttgcaggaatgcacgggaatgcttctctcattcctaaagatcagagcagaaacacagtaccatcaggttgagatacaggccattgtgaatctcttctcactgtgctcaactgacaccaaagaagggcaggtttccatgccgcccgttcatcatcaccgctctcgtcaagtataattgcagagtcatgactacacagagatctctcaacccaccaactgcgtccttacttgtatgagtgcagttgaaagaataaacagggcatttagcgaagta

SEQ ID NO: 150767 - DNA, 991 bp, Homo sapiens
  misc_feature (22)..(22): n is a, c, g, or t
  misc_feature (25)..(25): n is a, c, g, or t
  misc_feature (36)..(36): n is a, c, g, or t
cctagcggactgactctcttanttnccaccgctacngatggaatctgactctgtcacccaagctggagtccagtggcatgatctgggctgactgcaatctccatctcccggcttcaacagattctactacctcagcatatagagtagctgggagtagaggtgtgtgacaccacacctggttaatttttgtattcttcatacagacagagtttgactatgttggccaggctggtctcaaactcctgacctcgtaatcctcccacatccgcctagcaaactgctgagatgagaggagtggcccactgcacccagcctactggtttatttttaaaaatagcaatttgggtcgggcgcagtgtgtctcgcctttctatatcaaccaacattctttctcgagtctgatgacctgggatctcccagcactttgggaggacgaggccacaggattcctggaagttggagttcaagaccagcctgggcaacatgggaaaaccctgtctttactaaaaaggtaaaagttagctgggtatggtggcacgtgcctgttatcccagctactcgagaggctaaggcaagagaatcgctggaacctgggaggcggaggttgcagtggcccgatactgcgccatggcctgaccaacagaacaagactccatctcaaataaattaataaatacgttagttaatcgaaaagtttaaaaagaaaacttcaaggacgttgcaggaatgcacgggaatgcttctctcattcctaaagatcagagcagaaacacagtaccatcaggttgagatacaggccattgtgaatctcttctcactgtgctcaactgacaccaaagaagggcaggtttccatgccgcccgttcatcatcaccgctctcgtcaagtataattgcagagtcatgactacacagagatctctcaacccaccaactgcgtccttacttgtatgagtgcagttgaaagaataaacagggcatttagcgaagta

SEQ ID NO: 150768 - DNA, 466 bp, Homo sapiens
atgcggaattgctaactgcctgcagtgggcacactgacttcccttgtctgtttagaagaacctctcttaggaaacagcattgggttggccacagtttgcctactcttgagaagagactttgccccacaagtggtgaggatgccagaagcttgttctcttccataaaacaggccccaaagggcttcctcctggaagtggttaattaatcatactaccttatatgtttacaaagcaccaccccataaattaccacctcacagcaactctacaaggcaggcggggctgacatcttcccctcttctaaatgagggaactgaagccagatgaggtatctggagagtgagaggctgagctagaggtgggctccaggccttgtgcctccccagctctgcacactgcccctgccctgctgtgagtgtgacaggacattcctgccatgcatcccctcctggaggaggaggacaga

SEQ ID NO: 150769 - DNA, 319 bp, Homo sapiens
caggctggagtgcaacggcacgatctcaccttactgtaatgtccgcctcctggcttcaagcaattctcctgcctcagcctccagagtagctgggattacaggcgcctgccactcctggctaatttttgtatttttagtagagacagagtttcatcacgttggccaggctggtcttcaactcctgacctcaagtgatccgcctgcctcgatctttaacagtgccaggattacaggtgtgagctcccatgctcagcctttagttggttcactttgttgcggatctttctctccttcccacataggagtgctatgtgcgact

SEQ ID NO: 150770 - DNA, 545 bp, Homo sapiens
tgtgtccattcaccagcggcatgagtcgtggatgggggtgcgacttgtggaattggagaggaggggaactcaggagggaggcctaaagacacgtctaggtaaagagaccatggacaatgacaggctagggcaggacccaaggaaatggctgcaattcagtggaaaaagaagagggagtggtaagagctccttctcttttgcctctaaagaagcagaacagctaagggaaaaggtggcccacagtgttaaaacacagagaaaccacacagaatgtgggataatagatgctggagacttggaggggtgagagggtggcagggggtaagagtacttaatggtacaatgtacatcatgcgggtgatggttacactaaaaggccacacttcaccactgtgcaatatatccatgtaccaaaactgcacctataccccttaaacttatgcaaaaagcaaacaaacaaagagaaaccaaggcaagtggcagaaacaaaggctgagagctgagaaagtgagttcatgtgagtatggtaggcaggggccagaaag

SEQ ID NO: 150771 - DNA, 424 bp, Homo sapiens
ctcccagctttcacattgctcccttcaatctaggctcaacatggaagccagagagagcttcttacatgtaagtcagttcacatggctcctgtgttcacaaggtgtagtggctttcctctctctcacagtaaaagcctgcgaggccacatctacacagtggcctcacgggctttcgctcatctggtctgtgtgacatctctgacctcatcttttcttttactcactgtgattcacctgctccagccgcacttgtccttttgatgctctcaccccaggactttttttatttgctgttctctctgcctggagccttttcctcccacagggtctgcatcgcttagtccctcacctccttccagtctttgttcaaatgtcacttctctagtaaatgcttccctggtcactctgttttaaattgcagccc

SEQ ID NO: 150772 - DNA, 363 bp, Homo sapiens
tcactcttgctgtgtctgccccgcctctgagaagcctggcggcttcttagtgtggctcggtgtcttccacaaagaagacttccccgtccatcagggagaaacctagtggcggtccgcgtcatgattgtttccctctccacacctctttctggatgattgggcagctgtggtgatcctggagctctgggcttccatacctgtgtgggacagggaagctctctcggtctccatggcccaagtgatggctgcacgctcggtccaggaagaggcggaggcaagcccaccgctcctgacattggccttctaggaaaggcggtgttgcatcccacctgcacttcctctctgggtgggtcagaacataag

SEQ ID NO: 150773 - DNA, 469 bp, Homo sapiens
gtcaccaagatggtaaagtaggggacactagtcttcatccccagcaaaaaaattagagagagagaaagacagctattcaaacaccataatagccctgtgggagctcaagggcccatgtaagaagctgcagcaaaacggaacaaatggctggttatatcggcatacctaagatgcctacagatggctagtgacaaagaataaaggcaacagcctattggtgacagccgtggagtgggaacttccatggttcccagcagcctgcttcacagaagacaccagcatcttttgccactgaggtaaccaatagccatttccaccagggaaccccagagaggaaggcatggctccatattcccttgctcaagaagtagctgctgttgtaccaccccagaaccaaaaccaccacctctccaaaccttgcacattcccctaacccccaggtcacagtcacttcatgaatgtgcatact

SEQ ID NO: 150774 - DNA, 217 bp, Homo sapiens
caatagatgctaaaactattaggtgaaaagttttgggggatgagatagtacccatggtgccaaagcaccaatgaatggattacttcctgacataccttcgtaaggaggagatccagtggttatcttaactaagtgaccaaatccagcgtcatcagcagacggggcaaagtggcatgtgctttctggcatggcactatatgaatcacacaacattacc

SEQ ID NO: 150775 - DNA, 275 bp, Homo sapiens
taggtaagggtcttaaccaactgatgcctcagtttcttccacagagaatagttagagggatgctgtcatgaactaagggaagggcactgaatttttttttgccaatatcaaaagtgacatttccccatgatgttcaagactcaccaggtttctctctccacctgtacctacacccagctagatcttgtcgttaaagatgtatggagggaagaggtttcaatccttccctccttggcaacctacattgttaagtgactcaaagtcatgtgattttt

SEQ ID NO: 150776 - DNA, 159 bp, Homo sapiens
cgtcctctgtccccgtgttcgtgtgttcaccgtgtgcatgcgtgtatgtgcttgttttgatgcagggaccaccctcagctgaagactcccccaggtaagcttaatgggcagtctctgggcctggcccggctgggacctgccacaggccccccagggccc

SEQ ID NO: 150777 - DNA, 742 bp, Homo sapiens
accgctgcgtatattcaccccctcccctccatttaccgcccaacgccaacaaaaccttaattttatttcaccctaatggcaaaatggtcaataaaagcttccgagtctcttgctcttgctctccctgctcctctctcaccgggcagagaagtttattaccttaaggttgttcttgaacaaaagaggctgcacatattggatggctaagacagaaagatctcaccagtctggccttccgaagctgaaacaggctcacacagttgggaagaagaagaaccaagatataaactcagatttttttcttttttttttttttgagacagagtctcactcttgttgcccaggctggagtgcaatggtgtgatctcggctggagtgcaatggcgtgatctgagcatctcccgcgctcaaacgcttctcctgcctcagcctcctgagtagctgtgttataggcatgtgccaccacacctggctaattttttttttttgtatttatagtagagacggggtttcaccatgctggccaggctggtcccgaactcctgaccttaggtgattcccccgcctctgcctctcaaagtgctgggattacaggcgtgagccaccgtgcccagccaaaactcaggtatttttaagctccaaatccagttttttttccttttgttttggctacaccatgctacacattttatctaatgtatgttatggtcctaactataaagtcaagatgaataatgaaata

SEQ ID NO: 150778 - DNA, 726 bp, Homo sapiens
acagcatcgtgcccacaaccacaagaacagacagacttttaggattttatttcaccctaatggcaaaatggtcaataaaagcttccgagtctcttgctcttgctctccctgctcctctctcaccgggcagagaagtttattaccttaaggttgttcttgaacaaaagaggctgcacatattggatggctaagacagaaagatctcaccagtctggccttccgaagctgaaacaggctcacacagttgggaagaagaagaaccaagatataaactcagatttttttcttttttttttttttgagacagagtctcactcttgttgcccaggctggagtgcaatggtgtgatctcggctggagtgcaatggcgtgatctgagcatctcccgcgctcaaacgcttctcctgcctcagcctcctgagtagctgtgttataggcatgtgccaccacacctggctaattttttttttttgtatttatagtagagacggggtttcaccatgctggccaggctggtcccgaactcctgaccttaggtgattcccccgcctctgcctctcaaagtgctgggattacaggcgtgagccaccgtgcccagccaaaactcaggtatttttaagctccaaatccagttttttttccttttgttttggctacaccatgctacacattttatctaatgtatgttatggtcctaactataaagtcaagatgaataatgaaata

SEQ ID NO: 150779 - DNA, 338 bp, Homo sapiens
tgacaccaaaatgtatgtgtatttgtataggggaaagggaatgagttagcaattaggatcctgtgccttcatgaggtccctattaacgctcatcttatctcaataagattcctcgcttgccatccccaaatccccatcattttgcccaggtcagcctctcccttttgcagcgtcatgggacctattgatctctgaggccaacttcaacttgctggattacagccctccctcatctcttacagttagatactgtggcaggtttgatgaagaagcaagaccagaaaaaatactggttatatcatttaaaaaacaggaaaaaaggctaggcgtggtggctc

SEQ ID NO: 150780 - DNA, 253 bp, Homo sapiens
cctgttgggcagacccgctcatcaagcacaacacagttaccccttaggaagtgaacataaatcgatgttggttcctcttatcaagatccggctgagaacgagatgagcacaatgggaaactctttaaacttctgtccctttctcctcagcccaaactgcccattgtcgtagaagcaacattccattctcacccacagttcaacctccagaacatggaaatggcaggggccagccaatcacaggttacaaaccc

SEQ ID NO: 150781 - DNA, 289 bp, Homo sapiens
ggtggtgtgcagtcctgattagaagaacaatccaggacacttgaaatatagtttggaaaagtacagttaaggtcaccccattaacaagcggacagtcaggcctttagagaagaaagaccatgaggaatcccatatacctggagacaaaggaatggtttgattacttctagaccaagctcaagtggtggggaaattgacaatgttgtcaactgggtttgaaaacgcacttggccatctttctcagatgccctactcctctctatatagccttctttgccctgggtcagcc

SEQ ID NO: 150782 - DNA, 349 bp, Homo sapiens
tgcacaggattcccagagattgagcaaagtgctcataaacagggatttacaaacccacaaggagagaagtcactatgagtgaagaactagcaagataagaaatcagatttagaacatccctccccgaggtggcagatgttggactgtcagattcagaattgctatggactgaaccatgtccacctgaaatttgtatgttgaaaccctagctcccaatgtgactgtatctggagatagggtctttagggggtaattaaggttaaattgagttataatattggagccctaatctgaccagactgtagccttataacaagaggaagagagagagagagaactctctattatg

SEQ ID NO: 150783 - DNA, 416 bp, Homo sapiens
ggtgaccccaggtttacaggcgttgtcagtgacccgtgggtatgtgccatggttgaaaaagtacttctgagtgtcagaagagctggcttttcaggctctgccactaacaagctctgggacttcaagactaaatgaaagcattaggcactgtgttagttgttttacataacctcatttcattcttacaagcagtgaggcaggtgtatcacaggcattttttaaaaaatgatacaaaggctcggaggcataaatgctctgtttaagtgtaaaaagctaagagacatatttggaattcaaacctacaatggtctaccacattatactgtttcgcatgacttcccatgtgtaaaaatcttaaaatgaaagcaaacccaaaaatattgtacagcaaactgttgctgtatttttcaaaaatt

SEQ ID NO: 150784 - DNA, 429 bp, Homo sapiens
tccttccatacccattcacattactggaagcattgttcatgcacacataagtataatggccgctcttcttctgccaagatctgctctgaagaaaaggtttgatgcaatcaggcatcactaaggtttgtaagcatgacaagacttagtgctgccactagtctacagcatgaagaggcaatataccacagtgggaaagcagggccacgccttttacatgtaactgaactggccagtcacttgaccttgagcttcaaatcctgcatcatcactcaggatgcacttttcacttatacctttacctagaatgtaaactcgtaagtgtaggacctctgtgtctttaatgctactttctcagtgtccagagtggtgcttgacacatgggaggcaatcaacgaatatttattgaagaaatgaaataacgataactta

SEQ ID NO: 150785 - DNA, 529 bp, Homo sapiens
tcgatagagacagtgggtgctgtgagccattaccttcactgcttccccttttcccacatgcatatttacatcctcaaaattataatagatgaatcagacataatttgcttttatggaagtcatgtagttcacttagtgttttgtggccccacccttttaatttctccagcataaaaagtaaaaaatctgagcctcagtagttggtagtttctcgtatcccctggaaaaccttataaaacagtcacactggtgttctgtcctttatcacaggacctttaaagacaggttatatattttgaactccacaggtactccctcaagtttctttaaagcagtgagtctttaacctgctggaggttatggatcaatttcaaagaatctgttaacccactgaaataatatacaaaatttttttgcatgtatctatacattttcctttcctgatacagagtttacccctgacctcccattcatagtgggtttctctattcttagtggatgtgacaaaaacatcactaaccccaatatc

SEQ ID NO: 150786 - DNA, 197 bp, Homo sapiens
tgaaatgctaatgtgcagaagtcaaaatgattaggcttaaatgaaatgttggtgaaagatgaatatgagagaattcctggcctaatgggggaagacatgctaaaaaatattagatgatctttctgccttcaaatccatacaaagtgcctgtgtttgcaggcaaagctacacaggagaactgagcatgatgaaatgtg

SEQ ID NO: 150787 - DNA, 605 bp, Homo sapiens
ccccccaacacaaaggggcaacggtcaaagacaagactggaattgggccttgcgagctctgcctggcaaccttggctgtggaggccacagtggacagagttacccactctcttctgggcttgttcccaccatctgtggggtgggtgtatagggctggggctaagccagcttcagaagccccccaaccaccaccacaccatcaagtctctcaagtgggactgctgtgctgtggcacgcacacccacacacaagttgccaacagtttggaagttagccccagtttccaaatatgtcaacccaaaagccattcaggtaaatataagtgggagccactacaaagtgggactttatcaggcagatacagagaaccaaaaaatgaagttgctgaaagctgctgtggagatttaagtcttttgtttttaacggaggaagataatgaggcccaggaacacagcttcctagagtaagacagtgttccgtcctggcctccaggatgttcaacacctatcccaagcttctgagcattctgtcctcactggcttctctcagtgctatttccaaataatctagattgcaagttatcacaggccacattcctgaaaaaa

SEQ ID NO: 150788 - DNA, 703 bp, Homo sapiens
ctaggaatggctttcaattacaaactaaactgtctcatggcttttgcttctttcactctaaaatcatgatgattgatgattttttatgtatggccatgattgtaaatataaatattgttaacttagaaaggtttaatatttaaaattcatctaaagcactgatctctctctttttttttttttttttttttttttttgcggcagagtcttgctctgtcactcaggctgcagtgcagtggtgcaatcttggctcactacaacctctgcctcccaggctcaagcaattttcatgcttcagcctccctagtagctgggattacaggcatgcaccaccatacccagctaattttttgtatttttagtagagatgggtttcaccatgttagccaggctgctctcgaactcctggcctcaagtagatccacctgccttggcttcccaaagtgctgggattacaggcgtgagccaccacaccccgccatgatctcttgttatgcttgttactttcttggtatattttgatttggttcatgttacaattaaagttttggataattatcttttagataatatgtttaatgaacattcaaatatgtgattcagtcaagaattaccagaaatgtggaatttatctcatattttgaatttctttatgaaaagtgtcagtcatgtgtcattagagatactctattattgctaaact

SEQ ID NO: 150789 - DNA, 321 bp, Homo sapiens
tgccattaggatacgcagtgtcacaggaaccatcctaacctcccgcccttagtctccccttccccttccttgtaatgtttgacctcggcagtttcctttttccttctattaattacaacattctatcattctaaagtatatcttaagtaagccaaatgcttgcatttgagaaatatttattgagctggtgagtgttggacactatgctccaggctggggatgcaaagatggatgaatacgacccatgggctttgccctcagggagcttcttccagggtgtgagagaatggttggtatgtgtagatgcgtgcatacatctgt

SEQ ID NO: 150790 - DNA, 269 bp, Homo sapiens
ttccagtcagtgtctccacaaggttaagaatgtgtttgccagatgatctgggaagacctaccattaccttttgctagagggtccccatcccaccccaccttccagctccgaatttgccaagtggaagagcaggccctgggaagaaacaaaacaataaaaactactggatgatttctactgaagaaggctctgactcccccatgaacatctttctcatctcaaataaataaaatgcagcgggggcttgaactagccaccatatccctgag

SEQ ID NO: 150791 - DNA, 270 bp, Homo sapiens
aatgtacaattaagttttcttttctcttgggcatccattgtgtctttaatccttgttttctttcccaagtccccatcccaccccaccttccagctccgaatttgccaagtggaagagcaggccctgggaagaaacaaaacaataaaaactactggatgatttctactgaagaaggctctgactcccccatgaacatctttctcatctcaaataaataacgatgcggccagattcctcttattcatactcatatcccgctattatctccct

SEQ ID NO: 150792 - DNA, 430 bp, Homo sapiens
tttcaaagcaacatggcatggggaaggaggtcacaaagagacagtgagggaatcagtaagccacaaggttctaacagcccctggttccaaagggccctctccatggtgatgttttcaaaacatcaggcattactctccattctgttcttctcttcctgcaggtttactttagcacatacttacagtcacctcctatgggcataaggattaaataagaaatagcccacgctctcagggggcagttgccagagagtgggcagaagtgaccatagttcaaggcataaagttacgagtatcatcagggagcagacaaaagccaggaaaggtcagaggcaggtgacttcatttcttgctgcgggaattagggaggttgcaagaagggcaaatttgagcgggcactcatagagtgagtaagacttcaacagctggg

SEQ ID NO: 150793 - DNA, 484 bp, Homo sapiens
ggcatgtaaacaaaacagcactcaggaaattccaaagctgcatggttcactacacagtaaactcaagatctgagatctgagcttatgtaaattagccttgtatctggaataacagagctgtgggcaaatgaaatccagtttaatatgtcttattatcaggggacagtagcaatctaaactatctccttaaataatggaaagtttgcttaattggcaagaagaaattcatgtgagtaggcagaggagagaaagcaatagggataagacttagatttatttttaaatgagacaagataccattattccccagaattgcaagaagtaattgcagagtgggcatggctttcgctggagccttcccttagcagagggtgtcattgtgtaaagagaacttctaatagccccaattaaaaagccccctgtcctctcctgagaaacagaaatggaataagggaattctaattagagcagtgatgggggctgt

SEQ ID NO: 150794 - DNA, 344 bp, Homo sapiens
ccttggaaatcaagttcttgagcacttttgaaaacagactaatccaaaacatctgcaagaattttatctttaaaaacccaggtgtctaaaacataaggggaaaaatatacaaatgagactttgtcaaccaagtttttgaaaaacaggtttctagcagaaaaagaagcatctagaataaaatgcagctggctttatgaatctttattttccatggtgattcttcctttttggtcttcaacaaagaatggaatttctaggtgagtcttgtcagattttccaaaagtactattaaactaaaacgaggggattccaggcaagataacatctctgggaggctcaactct

SEQ ID NO: 150795 - DNA, 209 bp, Homo sapiens
tgatgggggttaaagtattactatgcaccagcacacattctctcaatcacattagactttaaaattccaaggtctggtttgccttttacaaggaataatattggtttagaatgctgctcaaagcctgctccacaaatctgagagaccaggttatagcacctcattttcctttgccactgccatgtcctcactctcccctcatgtaacta

SEQ ID NO: 150796 - DNA, 359 bp, Homo sapiens
caacaccatcactacctccaccatcaccaccaaccatcatcactacctccaccaacgttactaccaccaactatcctcttcatttccaccacctcctttctcatccctccatcacaatcaccaacagaaccatagctaccattaccattatcgaaaacaaaacaaccacataactcctgtcctcagaaggagaaaaaagaatacacatttgcaaattctgatctcaaggaatggctgtatttctcatttaatgcagcgcttactagatatactcagaatggtgcagcaggtcctgcggcacgtcctctgtagcacgcacagtcactacagcagtgtgggggcctcctccactggtggaa

SEQ ID NO: 150797 - DNA, 331 bp, Homo sapiens
gaacgagagcacaggtgcatcattaagtcgcctcaacaataattttttttgctgttgtttttgttttagagacgaggtatggctctatcgcctagagtgaagtggtgtgactttggctcactgcaacctctgcctcccagactcaagccatcctcccacttcagtctcccaaagtgctgggattacaggcgtgagccactgcgtctggcccattctcaagttttgttttgttttgttttagagacaaggtctcactctgttgtccaggctagagtgcagtgatatgatcacggctcactgcagcctggaactcctgagctcaagcgatctt

SEQ ID NO: 150798 - DNA, 278 bp, Homo sapiens
ataagtctccatttttatgggcatgcaatctgtgtctatatttacatatagacagtttatgttaattacaatttgtacatgtatggtatatatacattcactaagatgaatgtgttctaggcatttctgtgagcattatttttgttaaattcttttggggttggcaccaatatcactacttcagatatagaaactgaaacttggagaagttaaagggaatttatccttgcagatagctatgtaacattactgttcatctgcataaaaacaacctggta

SEQ ID NO: 150799 - DNA, 446 bp, Homo sapiens
gagctgagattgcaccactgcactccagcttgggcgacagagggagaccctgtctcaaaaaaaaaaaaggcttcctagtagtttctgaaaaaactgactgattgctagtgactcctgagtgagatatagtatgtctcagagagaaggaaagacctcttaaccaagctctgatgctggcattggaattatagctgactagtaggcttccatgacactgagggaattcctacgtgtatcaaccacaaattggtacattccttaaggacagccagcatcttatttatctttatctccctggctcccttacacacaggggttgtttattacccattaaagtaatgaatgcaggtagcaggggagtcaaatcttgacacatttcagagagttttctgacagagggtggtgactatgaattaatccagtgacagacaccaggattccagagg

SEQ ID NO: 150800 - DNA, 809 bp, Homo sapiens
gtcaaactagttttaccatttaatagatgcatggcctgaggaaatcactcagtccctctgagaaaactaagctcaattaaataggaataatactcatcccacagggttgtggggaatgagagtcaggtaaagcaccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatagtgattctgttaatttgactgagttctattttattgctgctctacgtttttatttgctcagggcaattttaagttgtggttatgggtcactgatttttatctccagcccacagaactaccattaaacagaaataagaaagcaagcggctttgggtccgttttagtctgaatatattattacgtgccttgggctttaaaaactgctatgtagagttagcagtttttaagatgaaaatcactagacagctcattggaataagggcttctccaaagaactctgtagggttatatctattgttactatttcattttattaagatatactgtatatttacatgtcttcatggttt

SEQ ID NO: 150801 - DNA, 305 bp, Homo sapiens
agagttgagtccaagagtggaggtgtcttgtgtccaacatgcagaattgttgagaatgggctaaggaaacaagattagggtacaagaaggctgcagaagcaccacaagaagctgagtgctgtggttgaagcacagtaatttcctatgcatcctgcctggggaagaaaaaaaaagttcactaagaaagagcacgagtgcaagagaagaatgtttccaagaatcattaacataaggaagccaaggagggaactaagagaaatccaattgttctatttggttaccattcaaaggcaaaccagtgatca

SEQ ID NO: 150802 - DNA, 407 bp, Homo sapiens
ccagcctctggtggctcctggtgttctttggctgtgtcacccccacctctgtctctgttttcacatgaccttctccctgtttgtccatctgtatcctcatatgggcttcgtattaaaaaaaacagttgttagatcagagcccaccctaatctaccatgagcccctcttcattgggtgggccaaagcaggtagatcacttgaggccaggagttggagaccaacctggtcaacatggtgaaaccccgtctctattaaaaatataaaaattagccggctgtggtggtgcgcgtctgtaatctcagctactcaggaggctgaggcaggagaattgcgtgaacccaggaggcggaggttgcagtgagccgagatcacaccactgcactccagcctgggcaacagagtgagac

SEQ ID NO: 150803 - DNA, 220 bp, Homo sapiens
ccgcccgcctcggcttcccaaagtgctgggattacaggtgtgagccaccacgcccggcctctgggttatatgataatcttttgaggaatggcaccattttatattcccaacattttagccaaataatctgactaaaaacaggcaaaagagctgaatagacatttctccagggaagatactcagatggccaataaacttatccaatatgctcaacctcttt

SEQ ID NO: 150804 - DNA, 471 bp, Homo sapiens
tttatcctgaatgtgccaatttaattatttgccaacatgttgccagacatgctccctagtctgtgctaaagcatttgttaccatgtactacattgaacatacttgaatgtttctgtcatgtttaccacccagatggtgagaatccaaggaaaggagacacttgtattaagttcacagtttatctgttcttggaaacatataactgcatgaagagatcaggatgaaaatatcgttatagttaccccagttacctcaaggtggaagtctgggtcagacaaccacggggacctgccattgcaaaacttctctgtatatgcctgggggacctggctgttctagtttttcaccatctttgacatctgcttgttctcacttggctcctgccttaccctcagggtctcaataatgacttcttgactttgacaactttgacaaaaatgcattcatcaaaattataataaaaaataaaat

SEQ ID NO: 150805 - DNA, 528 bp, Homo sapiens
gattctcctgcctcagcctcccaagtagctgggattataggcgcatgccgccacacccgactaattttttgtatttttagtagagtcagggtttcaccgtgttgcccaggctggtgtcgaactcctgacctcaggtgatctgcccacctcagcctcccgaagtgctgggattacaggtgtgagccaccgcacccggctctatttagctttttaaaaattatttcctttcaagggccctttaatatctatcaagctccctcccctaacaaaatgggctgtccctgcccaacaagtctgaaatagaccttaaaactgtgctgccttagtggtaagtaaggggtgggggttggacagtgaatcttaagatttcatccttcattcagtaagcatttgagtacctactgtgagcaggcattggggcggagcagcgagagccctgccgatgttgggttctcctcctattggggaaacttgatcacagatggaacacgtgcagattgattgatgagtgctgtggagaaagcagca

SEQ ID NO: 150806 - DNA, 126 bp, Homo sapiens
aattgagtctcagagaggtcaataagtggcagaggtgggatctaaattcaaattggtcccatattcagagcctaggctcatattccctgcacagtaacacagccccaaattcagtgccacatcccc

SEQ ID NO: 150807 - DNA, 217 bp, Homo sapiens
cgagatttttgtcaagcttgactgtgtatctgtcaggtttgtttataccgaggatcactgaagcactcataagggaaatgaaggtataaaaactgcctttttccttgctcccactaacaaatgtgagaaactggccttactttttttttttttttggagatggagttttgctcttgttgcccaggctggagtgcagtggtgcgatctcgtccccctg

SEQ ID NO: 150808 - DNA, 287 bp, Homo sapiens
attttaagattcattcatactaccaagtgtgcgtacaggcaatgacttctaagggctgtgtagtaccactgaagtacacccactacatcctgtccacgcccaggggtggacatccatgttgcccacaagtggttccttggcaaaggaacgccatgttgagagttgacttttaggcaggctggtggcctgacagggctgacgcatgatcaccagtcaatgagacactggtgagcccagcttggatgtgtccagctggagttaagtggctgtgacttcaggtacttaag

SEQ ID NO: 150809 - DNA, 145 bp, Homo sapiens
actagattaccagatctgcttgtagtttcccacagatgccatgccgtactctgggtggaacacccttctcttctttacctggttaactgctattcatcctcaagagttggcaaaatagagtgtagtagttaggggttcatgctct

SEQ ID NO: 150810 - DNA, 461 bp, Homo sapiens
cctgaggatccccatgccaataacctccaagggaatcacagtgattgtgataaaaagctgtgcttttcgagtagtatggtctttacatttttgtgttgtcccaaatgtttttggtcggttctgcataaatagtgataggttctgcctacatctgtgggggcaggattcatgaagcatggcagacattccaccagtcagagctatgaacacttctgaaccaatggggactagttttgatagcagtaaacccaaagtttttttcagtggtgttttagtctttttctgtttagtttttttcccggtatttttgcggtacagggaggtgaaatacaatactgtacttttgaatatatattgaataaatttggtaatcctgttggtaggtatatcctaaatatatattgatgtttagattgcctatgctgtctcacgtaatgaccggaaacccgaggagagagttg

SEQ ID NO: 150811 - DNA, 368 bp, Homo sapiens
cctggttgagtcttagggtcttgacagtgctgatggaaagatttcatgagtaccaagtagataaaggcatgatgccaaggacgaggattcccctgtaagtttcttaaaggtaggatggatacagtacctggcataaaacgtggaacagttaatgtatacgaagcttgtttaaatgaagataaagtggtcatgtggataaatggaggataaagtggaaaaaatatgggtaaattagaggaaagcactggcctagaggagaaaaagacacgtttgagtctttgccctgttgctgactttcgtgtatgctatccggcaagttacttcccttttctgggcttcagtttctctatctgtaaaaaggaggtact

SEQ ID NO: 150812 - DNA, 356 bp, Homo sapiens
tcaacctttgccaacttgcaatcgttcttcaatctgccccaactatttctagcaaattctttggctaatacagcatagaaaacacatcctatttgtcccagacttatttcattccagcttcaaggggtggacatttagcctaagagcattcatagagagtcagacttcagagaatatatttccctctgttaaatcgtatatgaaaccaagcttgctccgaggccgctggctgcaggaagcagtgacgaggatggagcttggcagatggttgtagctgtggtttcctggaggcctgtgtggggagatgattgtttgtatattggttttcatttatgtattggtcttattttcatctt

SEQ ID NO: 150813 - DNA, 528 bp, Homo sapiens
atccttcaaaaatataaaaaccatttttagctgggagaccaaataaaaacaggccacagccagactcggccctaagatgatagtttacctaccccatcctaaagtaaaaacaattatttacagtatctgaaatgacaactgtccacacaggcagtttaaaattgatctctcaggcaaaaatggaaaacaaaattaggttgcagaagtgacttctaacttaaaaatatgagcaaaatctgatatactgactactagagtttgatcctcaggtgatactggttcctctcctatcaataaaaggtgggtcatggtgagatattttttattttgcttttaaggttttgttttcaagtatattagattaaaaggataacttaatgaagttttacatttcctttgaaacagcattactgtttgcctgtaagtgttaagaacgggttaatgaataaaggaaaacagaactgaccactgctgactgggaagcccacatccctccacacttacccaaaggatcttaccagccgggag

SEQ ID NO: 150814 - DNA, 541 bp, Homo sapiens
ctagctctgagggtaggaggcgggagcaaaggcgattagcatgctgggtgctgtctgatgaatggctctctccttccccactcggcccatttctagagtgtgaactcagacaagtttcattctctccttggacttggttttctcatttgtaaagtgcaagtattaatcgtatctatctctcagatttttttcaggattaaacgatgagaaaatgcatgtgaggtacatgtttcagtgtgcagcgtgagcatctacctctcagggggactgcgaggagctggcccaacccagggcccagctgagcctccagaatcatctctgtctttcgcagtttgcaccagagccttgctcctgaggctgctcccaccagagaccaagagcagctgggacactgaagcagctcccttcctgggagatgctgagtgagtgagtgtaactcacaaacagctcatgttcctgcaaactgccttagaacccacagctgtctgagatggcccctcctgaccctgctccttcctccctgctcttctggccttgggat

SEQ ID NO: 150815 - DNA, 268 bp, Homo sapiens
gatttcaaaactgtgatggggataggtctgaaaaactcagacaaatatggcaaatatatgagaacagatttttttaaagtttgaagaacagactagaagaattctatagcataagaatttgaaaggaataatgtcttgaaaagattgagatgtttgcaaaaattctaaacataccaaaaaacttttaatattagttttctctgatgttaggattatgagtaatttcttttcaagtttatctgtctatatttttagctgtctacgcgtg

SEQ ID NO: 150816 - DNA, 245 bp, Homo sapiens
tccattttccacgaagagcttcctctgaccccccgcttcccgcgtcaatgtgtgtgctttgagcggggctgtcctcaccgcccagcttcaggggtaggggtggcacccaggcctggccactcaatcaccccatcctccttcctgcagcgataggctcaggaatggcgcttagatagaaactacgaccaaagaacccagtcccattacttacttacccagtaacactatggaaaatgcattttttt

SEQ ID NO: 150817 - DNA, 517 bp, Homo sapiens
atgattcacaagggtccaatgataagagtcatttgcagggtagaccctctggtccccgtcccttaccccttctcagattggtgaaatcctgctcacaagccctgaatgatatgctaccttctccatgctcccaacctattcctgccataaccatagcagagcagatgtgtggctaccaccccctaacacttccccacatctgtcaacaacagacaaccccagtagatcacagccctgctcaacccactccaggcagcactaccaaccacccagatctgccaccctggccagccacgtcggatcagaaatccttactatgcctgtggcactgagttcctcgagtaagaaacggtgtcttgggcatctttatgccaccaacctgtagcacagggctggcccatagcacacgctggtgaagggcctgctggatgaacactaaatacactctcatctttgggccacacgggcctccagcgcaatcggagtcagacgtggacacaggtgaggagccagagcc

SEQ ID NO: 150818 - DNA, 1388 bp, Homo sapiens
acgccgatgtgtggttccgcggcgcgctgggagtttgggtttggttggctgcagccagccagccgtgtaaaaactccaacgccgggcgccgcgggcagcacccacggagacccgcggggagctgctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgctggattacatggttcatgaagaatttaaccccgatcaagccaatggtagctatgcatccagaagagggcccttcgacttcgacacgaaaacagtttggcaaagagaggctgaggaacttgaaaaggagaaaaaaaagctgaggctaccggccattgactcaaagtatctgagcaaagcaggcaccccacttggccctaagaaccctgcaggaagtagactctccttcccccacgtgcctggtcaaaaaaacagttcacctaccaaattttccaaactcattagcaatggttataaggatgagtggttgcagcagcagcagcgagctgactcagacaagaggaccccgaagacctccagggcatcagtggtatctcagtccccacgagacctggaaggtccccaggatgcagccaggctccaggacgcagaggcttctgaaggtcctgaggacaccccaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcac

SEQ ID NO: 150819 - DNA, 1184 bp, Homo sapiens
acgccgatgtgtggttccgcggcgcgctgggagtttgggtttggttggctgcagccagccagccgtgtaaaaactccaacgccgggcgccgcgggcagcacccacggagacccgcggggagctgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgctggattacatggttcatgaagaatttaaccccgatcaagccaatggtagctatgcatccagaagagggcccttcgacttcgacacgaaaacagtttggcaaagagaggctgaggaacttgaaaaggagaaaaaaaagctgaggctaccggccattgactcaaagtatctgagcaaagcaggcaccccacttggccctaagaaccctgcaggaagtagactctccttcccccacgtcaatggttataaggatgagtggttgcagcagcagcagcgagctgactcagacaagaggaccccgaagacctccagggcatcagtggtatctcagtccccacgagacctggaaggtccccaggatgcagccaggctccaggacgcagaggcttctgaaggtcctgaggacaccccaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcac

SEQ ID NO: 150820 - DNA, 317 bp, Homo sapiens
ctcccacccacttttctcaaggggggtgaccctcacaactgtctgcgatgggctctctcatgggcaaggtgtgtcccttcactggaagagtgtaaacacaagctgaacactcattttgtagggatgttatggaagcaatttgaggaccagctgggagtttgaatcacatatggggaacataacacaaaattttgtttatgagtttcaagaggtcgctgaccctttgaagccatccatagatgccctaaataattaagggcccctagaccagaagttctcaacttcagctgaatgttaccaaccactgggggagattt

SEQ ID NO: 150821 - DNA, 173 bp, Homo sapiens
aaatgaagcctgctccctaacaccctatcaaactggattaaaagaaggtttccgtatgcatagatttccttgaaaaatcaaggtttttctctcttttggcatgaaagctttcccctcatcggactgtccttacttagcaaatgaagagaattccaggcagtaaagtcatgacc

SEQ ID NO: 150822 - DNA, 1175 bp, Homo sapiens
cgtgacgtgtgtgggctcgtgttcctgtttacctcagggagaatgagaaacggttatgttaccccatcagtgagttctggctaagtaggaataaaagttgtcatagagacttttaggactaggacatttcatgaccgtgcttcgtttttgaataactgagaggggtgagagcggtggccccattcaaaggtcgtcagggatgaaggtaggcaaggacaagtcatgtgcagggcgccttagagggccttcagaagatggaaagtcgctcctggctgaacattcagatttgattctgtaaacagaattgaacataacttacaaagagactgagtcctgcagttggaagttgatgcttagattagtcgcctgtgttttcacagcttctaagtagtgtgttgtaattgtgtggcaaagtatgtgattacctggggggtccataattgctgacttgtgtttttacttgatgtatttgaaaacagttaggaaaatgattttgccaaagtgtgtcttaccttagttaagatgaaatgtaccttattgtgagtttctgaagattgcaaaagcttgtcagtttagtttttggggtcccattagtgagggcacccctctttaccttactcaaaccagctcttcacatgtattccaagaaactagagggcatgctaagaggtatttctcaacaaatggtttgtgctcagatgctgttgcttgtagctgaggaatttgactgcagactttcccagagccttggtgtcctgattgggcactgtgagagaggggctacagttggaccactctcaatcctgtttgacgctagaactctttttagcctattatgggtccgcagacttcctctgcaaagggccagagagcacgcatttggctttctgagccatatggtctcttgttgcaactactcaaggctgccatttcagcaagaaagtagccataggcgagtgggcctggctgtgttccagtaaaactctagttgtaaagactggcatctgaggacttcgcccatgggctgcaatttggtgactgatataacgtgggacttcattctctgagcacccgttggggagcactggcctaccacggctgcacagacagctttaaggaaaacagcagcagggcaagttttctgagctgcatgatgtggagcccgggagagccca

SEQ ID NO: 150823 - DNA, 483 bp, Homo sapiens
cacgcctattctccctctcgcctggcgagctcagcccatcctaaaagtcttagctattaaagcactgccgctctctgtaaatgctcctgacagttcagttttgcagctcaacaacctgggttcaaatctctgctctgccattgaccactgtgactctgctctggtcacatgcttgccatgtgactgtagcaagtgacctaacctcttagaattctacctcagtgtgggatgaaatgggatgatgcaaggaaactgttcaaagcagtgacaggcagatactaagcattcactctgcactgctgggatcttgcctgacttcacaggcagagttaggcagccctgccatacctccaccaccctgcatggccactgctcaggcctattgagatgcctgagtagtctctgggcagcgtctgcattgccatctttatactctcagaatccagtcccatccccagacttcatcatatgtaacgtatgaat

SEQ ID NO: 150824 - DNA, 220 bp, Homo sapiens
ctagcctataatggacacttttataaatacatgttgaatgagtaagttgacatgtatagcttcagacatctgagtaagagcaagatggatgcaagaacacattcaacgacacaggcatccttcatgcacaaaattcctgtcacgaactctccagacaagaaagatcatgaaaaataccacttattcttgataacagtagttcaagaaatcgttatccaga

SEQ ID NO: 150825 - DNA, 654 bp, Homo sapiens
ccatgtacatgtttgcatctatgatctcatttgatcctcttgccggccctctgtggcggatgttgttccatagcccagctccactcaccaaggatctgaatagcaaggaatgcaagcaacttgcccagggtcattgagagcgtgtggtggatgcaggatgcgtcttctgactcaaaatattatgctgcttctcttacacctgcctacatcttcgtaattcagcctgccagcgtggtagctacaatcttaggctctgagagaagctatattctgtattgacgtggttttgtcaatgtgtttgtgtgtgtgtcacttggtgtcaccttcccaaacctagtggcagtttctccctttaacttttctgccatcccagacccttgtagccaatgatgcaaaaaatcttaagtttttatttcaacttgccgtttctgtgttttctagagtatgctggagagtactcagaaggccctttaagctgcttgagaatcaattattttcacatcctctgcctttttctactctaggaatccttgtcagtgacaaggttttagcttgcctgcaggtactgcatcttccgtctgagtaaatagcaatgtcagaagagcagtgaatggcaaacatgccatctttctggtatttggagcccccagtgat

SEQ ID NO: 150826 - DNA, 200 bp, Homo sapiens
acaaaaccccatcctttcagcttccttctaattatttccatttctctcataggctcccagaaaacaagtgttagtaaatacagtcgctgctgctctgctcagatcagctttgattcccggctcctatttttcatacatgtagcgtttcctccctaactgccttagggtgcctttttgaataaacattgaattccaaccct

SEQ ID NO: 150827 - DNA, 455 bp, Homo sapiens
gggcttaggccgtgtcagtgtgtgttagcgcagtcattccaagaaagacatctaagctaagcatctaaaagcaggttgggtgtttctaagtgcctggtgtctgaaatgaactcttgtttaaatcttagtatgctcagctacttcttgacacagtagataagtttcagggtgaattctgttcagaattcctgaatattggtctgttctctccagctaactaagtgacgcttggggaatagccatgcagatagatggaaacccagttaacgggggcatgctccactgtaccaagaggaattataatgctcgtttgtacttctggcacttcatgacttttcttttacctaccccattccccgtgtgctctattccaagcgcaaaaatcttctagtaggctttcactaaggaaattccccaaaaacattttcccaaccattgagagttggtcatttact

SEQ ID NO: 150828 - DNA, 113 bp, Homo sapiens
ttttagttttctgaaacagaaacttcttgttctttaaagttcttgttcttcacaagttgttttatactgaggaaagaaaaaaacccagaacattgggttcagacctctccaga

SEQ ID NO: 150829 - DNA, 207 bp, Homo sapiens
tggggaggaagtccagccgtcaccggggcagtcttctgtttactcagcagaggaaagtccacaccggggaggcagcaggtgggacctgccggagaccaggatgggagatacctgggagacgcccaggaaatgcccggggcagtcaggagggctcctgcgcaccctggtggccccaggtcacacatggaactcatgaggaagtccccg

SEQ ID NO: 150830 - DNA, 1193 bp, Homo sapiens
cggcctcccaaagtgctgagattacaggcgtcagccaccacgcctggctgagtcattttaaaaacatttttctttggcctcctttagtttgagctctgtcaaagcagggtccatgttttactgacctgtctgtgtccctccagtagtaagaatcatgtatcaaaatagtgcacgctcagtaaaatgctttttgtggggtgtgcttcacataaaatacgaatactgctgtttactgtctcattgcttcacagacacgtgcagaagttatctttgtcgtgctcgtaagtaattgaaaattctttatttgaaaggtaaaatgtgactaaaagttcaagtcaatgcccgtataagttgtgatttggtgttctttcagaagaaaattttgtttatttttacaactaacattcattaagagtattacacataagtatggtatggaaagctttgaggctgtggtaagcaaagatgccttgatctgcaagcagcactctgtgccctaaactaatcctgacaggacaagagcctccaaagtcacaagggaaaccaccacaccacatggaagcacattttattattaagtcacaggaggatggaagtttccagaaggatccctccaagaaaagaaaaagaaacaaagtttctgatgtgtttgagtaaatcaagacggaatttacatttctggcagacagtgggcaaaaaattaagaaaaggatcaaataaaagacaacaacaaaaacaaagacaattattaactcagaccaaacaaaaactctactgaaaaaaaattagtcttaggacattagtggctcagttgcgcacaatatttacattaaaaatgatgtaagaactgagtcacaatttaaacaaaatttgttaaataaccaaattagaaaaatggagaagagaaagtttactttgtataatgttgtattcagactagaaaaagaaaaaattcatcgtatataataggaagtcaatgtcatgttttcaactagaaaaatcaaataactatatatgcatgtatttacatagaagtaaatacaattaaaagtgttggcattcaagaacataagaagtagagtgataaaaaagatgatgattctttgctattgggtggtatgactctcaatgttctatttcaatttttaaaccatacacatatattacagagacaaaactaaacattcagttag

SEQ ID NO: 150831 - DNA, 541 bp, Homo sapiens
ctaaattcagtgatgaatatccctgtaagatgcagaaaatggaaggaagatcatgtgaaaacaaagatggagattagagttatgctgccgcatgccaaagaacgtgagtggccagcagccagcaaaatctaaagagatgtggaacagattcttccttaaagcctgcaaaaggcaccaactctgttgacaccttgatgtcagaattctggcattcagaattgtcaaagagtaaattgctgctgttgttagccacagtttctggtgatgcattgtggaagtcctacaaaactaatacagatgtcacctgtatttttcaggactctacagagaaacaatcaatagtatacatatgtgtgtatactactggacatatatatatcttcaaattatttatttacttattataggaattggcttatgtgatcatggaggctgagttgtctcatgatctgccatgtgcaagctgaagactgccatgtacagccagtggtgtaattcagtctgagcctgaaggccaaagaaccaggagtgctgatgttca

SEQ ID NO: 150832 - DNA, 233 bp, Homo sapiens
tccacatccaccaccatcactaccatcactccactaccaccatcaccacctctaccaccaccacaaccaccacctccaccactaccacctccacctccaccaccaccatcactaccatcactccattaccacgatcaccacctctaccaccaccatcacctccactaccacctccacctccaccatcactaccatcatttcactaccaccaaccccgtgatcgtggggttgta

SEQ ID NO: 150833 - DNA, 623 bp, Homo sapiens
acaaagctgtaggacatttgagttagattgatgaattgttttgcctggtaattgagactgggaagtacacaggttttcttctaagagcttagagaattttgttacattagactcttgttatttgaataggttagaatacagagccaaagtaacctggtattggaggaacctggtgtattattttagtgggatgtggtgtgctaaccaatatattctaaaactttgctagttataattgtcaacatcctgtaatgggtgttttcttcctcttttcctccccctccttcttattgtatcttaccacaaatatgatcttaaagtggataggatctgcaactgactaaactgtgtgggccatttaggcgcttacagatatttccatagggttaatgttaaagattagttacagatcagtatagcttttgatttgtactatagtttcttgctgatgattacaatttcctctgtagctatcactttttatgcatacagtatttttagttttggaataagcagtgaattttacctctattttcatttagcaggcaatattgtgtattttgttgcatttttgcagtttggaaaaatttaggactatttgcaattataatggtgacaaatca

SEQ ID NO: 150834 - DNA, 601 bp, Homo sapiens
acaaagctgtaggacatttgagttagattgatgaattgttttgcctggtaattgagactgggaagtacacaggttttcttctaagagcttagagaattttgttacattagactcttgttatttgaataggttagaatacagagccaaagtaacctggtattggaggaacctggtgtattattttagtgggatgtggtgtgctaaccaatatattctaaaactttgctagttataattgtcaacatcctgtaatgggtgttttcttcctcttttcctccccctccttcttattgtatcttaccacaaatatgatcttaaagtggataggatctgcaactgactaaactgtgtgggccatttaggcgcttacagatatttccatagggttaatgttaaagattagttacagatcagtatagcttttgatttgtactatagtttcttgctgatgattacaatttcctctgtagctatcactttttatgcatacagtatttttagttttggaataagcagtgaattttacctctattttcatttagcaggcaatattgtgtattttgtttcctctgccctccgggaatcctcggaacagctatga

SEQ ID NO: 150835 - DNA, 739 bp, Homo sapiens
catattggccaacctggacttgaactcctgacttcagatgatccgcccacctcggcctcccaaagtgctgggattacaggcgtgagccaccatgcccaccatgcctaaaaatttttgtatttttagtgaagatggggtttcaccacattggccaggctagccttgaactcccaaactcaaatggtccacctgccttggcctcccaaagtgctgggattacaggcatgagccaccgtgcccagccaatgctatgctgcttctatgatgtcaactttttagcttccacatatgtgtgaaaacatgtggtatttatctttctgggcctgaatttacatcactcaacatcatgttctccaaagcttatctttatcttgccataaatgacagaattttattattttttatggttaaatagtgtacctttgtgtatgtatgccacattttctttaccattttctgttgatgaacacttagattggttccatatgttagctattgcaaatagtactataataaatataggagtgcagataggagttcaacacactgatttcctttcctttggatatacagctagtagtgggattgctggatcacttgaatgctgatatgcataagaggatctacactggagaaaaaccatggaagtgtggagattgtggtacatgcttcagtcagggctcacatcttcaaattcagtgtctgttctgtagagaaaccttaataatgtgatatatgt

SEQ ID NO: 150836 - DNA, 403 bp, Homo sapiens
tatgggacaggacacttgtggcagctggcgtagctggtggtctaatcttgacctttcaccctttccttgaagttccgagtcgggggtagcttccttttctcttcagctgtggttttcctgtgatgggtccctcccagttagtaatgagaggctgagagacaagttgtggtaactgcttcgtgggtagtggtctttcccggcccctgagtcattctaacttccatcctgctccgctgcggatgcacatagctgctttcctaggggcgagaggagatgaggggactgggcctgatgaccacaggcgctgccccttcatagcacattttattcctgaaggatcctaactggaaaagtacctctcgccgaaggggctgggtggttccttatcattttcaggcaaggc

SEQ ID NO: 150837 - DNA, 437 bp, Homo sapiens
ccccatcttgacttctcaaagtgttgggattgcaagtgtgagccaccaaacctagccagtcccatttctttttggtttcatttttcctgccttcttttgaactacttacatattttttgtgatttgattttgtttcccattttggacttactagctatatttctttgtttttaagtggttgctgtagcattttcagtattaatcttcaacttatcaaagtctatcttcaaatattaatctcactttacataaagtgtaagatccttacaaaactatacttccagttttccctcttttcctctgtgctgctattatatatttgaattttacatatagtataaaccccaaaatatattgttactatttttgcttttaaacaattaacttttaaaaagattataaacgagaaaagagagaactggaagtattaagcgtga

SEQ ID NO: 150838 - DNA, 332 bp, Homo sapiens
caaaaacctatggaatttttttcagcgagccttacaaagtactcctagaaaaggaaatgaaggccaataaagctttggaataatagtaaagggaaactggcctaatcagattccaaatataacgtgaaagtataataattaaaacagtgtggtaataaggctagaatcaacaattccgtatgggtaagaatttagtattatgattaaggatgacatcacaatttagagaggaaagacttatttcaaataatgtggggccaattagttgatttttaatttattgtttttaagttactgtcacatctataccaaaatacattccagataaacta

SEQ ID NO: 150839 - DNA, 364 bp, Homo sapiens
tgtcaggcgtctgggggaatctttgatgttcccagcaggcagggtccttgtggaaccagcattgggtttgtcccaaaagagcaggctatccatcccaggtgctctacttggagttttctgattacagtaggtgctctccgatcccacagaagaacccacagatgtttctctggtcactgcattccccctgtctgtctcccctacccatgtctggccagtggtcttcctctttggtcgtccttgtcctcctgacggcccagctaatgctggagataaagctggctgggtggtctatggcaccttctcttgcatgggagctaattgaagactgaagagaacacgtctaggcttttttcctctccag

SEQ ID NO: 150840 - DNA, 291 bp, Homo sapiens
tactgtcaactccagccaacagaggacaaaaccactgagcttctcaatgacactgtgcccctcacagatgcacttatccctttagtgaaggaagcgacctctcggccctcctgggatcatggtctgatggttggctcttctgatctttcataagagatccacactacatgcccactcttgagccttttgacctcctcaatattctgccaaggcagtaccagcatctccatttaacttacacgaggccattgttgtgctcaggccgcaaggagccatcccaatgtccgcaga

SEQ ID NO: 150841 - DNA, 305 bp, Homo sapiens
gctaaggcagagagttgcttgaacccgggaggtggaggttgtggtgagctgagatcgcaccactgcagtccagcttgggcaacagagcaagactccgtctcaaaaaaagaaaaaaaaatactgtactagaggtgtggtaccatatattagattaatattagaggtaaggactgattgaattcctatcaaaatgatgaattaacaggtagtcctgtggagtattgggaactttaataaatggttgtctgaatatggctatttaaattagttctatcttggatagttctatcttggataccttctta

SEQ ID NO: 150842 - DNA, 394 bp, Homo sapiens
cccactcacaaagtcttagctgcaatcgggcaccttttcccaacacctctagtcactcagtttttctccctcacctcaggtgtcagagctgggatgctgtcctgatgaccaaaagcttaggtggacacagagccctgggctccctcacgaggaattcactggggaacaaaaaagtgaggcactgaggacacctgcagtgtgagtccggacaggcacactgacacagcggaacagacgcggcagaaccgacacggcggaacggacgcggatgatgcagagcccctctcaggatggccagccattcctcccctgccagggcccaccacgcctcccatggagagacggtgtctgtttccctcctgtcggaatctggatggcccagagacgactctga

SEQ ID NO: 150843 - DNA, 266 bp, Homo sapiens
aaagctccattttgatgcaactagggaacttctgtcatccctcatccccagtcacagctattgaaggtggtggagtggtaactgacttccagagcagacacctgagtcctcatagtggggccaccattgggaaacaagcaagttttgtcccttggatcccagaacagcacaggaattggaagtatcaggtatctcaaaagacaggggtggggcagatgtgcttgagactcagggaaattaagcagcagaagccctaagatgagaca

SEQ ID NO: 150844 - DNA, 530 bp, Homo sapiens
taagtcaattactctcttttcttcataaattacacagtttcaggtagttctttatagaaaatgaaaattgactaacatagtatttaaaaaaattttagtcattctaataactgtatagtcttatcctattgtggctttaatttgaatttccttaatggcgaagaatgtcgaatatgtttttatgtagttattgccatttgtataccttttgtataccttctttagtaaggtgttctattttctagaagattattttcttacttttgagttctacgacttatataatattgatcaattcctcaaaatccacaaactaaactcactcaagatgaaatagacaatataaatacagctacaacttttgaattcatggtcaaatataattcatgaccaaagaaattgagttcgtggtttacaactttctgaaaaaactgtctttagatctagatgatttcatgtgtgaatcctgccatgtatttaagtagaaataacatttatcctacacagtctcttccaaaaaaaaaacagaa

SEQ ID NO: 150845 - DNA, 291 bp, Homo sapiens
tcctccctcctccatttttttaaactgcttttatctatgtatttaacatcctgagcacctgtgtgagattgcatttatgaaagagttctttagctaaaaaggcttttgaaatctcgtagtgggtaaagatgatgtttttctctataaatgttagggtcttaacttacgaacaagtgaaatgtgctgttacatcagtcactgaactttcccaagccaaaggctcaagacatgaagattcttttgactgcccgagcctcccagttctcaggagccatcctgctgaggctctgg

SEQ ID NO: 150846 - DNA, 432 bp, Homo sapiens
tcctcatctctctcccccttcagtattacatttctgtggctcaggcagtaaacgcgggattcctaaaagcactctgacaataaacaaaaagctttcctctgactttggtacagttcatttgatcttttcaaacattttgaatgagggacaaggtgtgttttgcgtggttagaacaagggccagtgggtccaaggtccacctggaccaatctttgcaggatacaggaagaaccttctaaccgtgcagtacaaaagtgagatgtcagggattttaggctttcggggctagtgggggttgtgtttgaggaacttgaggccatctaggtacatgcatggccttgagcaatggttctcagtcctgactcagtacatgcacttaggcatatacagatattcacacacatgcacactcacacacacatgcacatacaaa

SEQ ID NO: 150847 - DNA, 147 bp, Homo sapiens
gcacacacacgcacactctaataagagcaatctgggaatttccctctgtgtctgtcagtttgtaccttttagatttgccatctgtgataccaaattctccagcgttacaaaaaaaaaatctgaagtagataagagggtcaggagaga

SEQ ID NO: 150848 - DNA, 392 bp, Homo sapiens
tgcagtggcacatggagctggggggagcgtgcctcccataggaggtggtggcctggaggtaggtggtcccacagatggagaaggggggtagattgaagagagggagggaggaatttgacttggaggacccctgagtttctggcctgggaggccaggtgttcgggaaccctccctgaccacacagtcattgcctgttctgggccatcctcgtctgtatgtcccctggactgcagctgttggctgctctgaccctgagagccgatttggacaatgggagctgaggtgctggctgaggccatgccaggcttcctggaggtcgtcgctatttttagagtcttttattggggagtgggtttgtaatagtttcaggcttactaatagcaccaacaaca

SEQ ID NO: 150849 - DNA, 345 bp, Homo sapiens
  misc_feature (121)..(121): n is a, c, g, or t
gtgtgattcacttcggccgttacgtactgcaggattctgccaacaaggtgtcgccgaccaaatgtactgtcctggcatagagagcactgctttgtattccactgtagtaactaggacaacngctcaagagtgacagactactttgtcgtagctggtctcactgacacatctactcttttggatcaagaaataaatcgtttagatactaagtcaactggacctaaagctccaattacagacattgccattattatcaaatcagctggagaaacagtacctgaaggttacacctgtgtagaagccactccatcagctctccaagcaaacttgaactatggaagtctg

SEQ ID NO: 150850 - DNA, 611 bp, Homo sapiens
gacatttgcaaagccagtgtcttatatttataaaagctttagataggaactgctatttttctaaaattgttggtttaaaaataattgttacatttgtgcattttaaaagttgcttctaacacactttgggtatgcttgagctcagccttttcagcaaagtatacagacatttgggcatcagcctttttggtcttattctgtctcagacgatttatggattgtggatgtcagggatttgataagctcccattaaaatatgatgtggtttttaaaattgcttaaaatgccctttgaacctgttaaaatgtgctgccgtcatctgaattaagaaatttagctgccgggcgtgatggctcacgcctgtgatcccagcactttggaaggccaaggcgggtggatcacctgaggtcgggagttcaagaccagcctgaccagcataaagaaaccacgtctctactaaaaatacaaaaattagctgggcatggtggcgcatgcctgtaatcccagttacttgggaggctgaggcaggagaattgcttgaacccgggaggcgggggttgtgataagccgagatcgcgccattgcactccagcctgggcaacaagagcgaa

SEQ ID NO: 150851 - DNA, 235 bp, Homo sapiens
gtctctgtgtatgtaaagttcttggaacagtgcctggcaccacatagtacttaaccattgatactacgtatgtgtagaatgggcctagcaagatgcatcccaggttgcgaactactgacatagagtacctcttagcatagacttaacatagcatgtaacatatattacaacaatcactttctgtgacgtttcctaaaggttatggaagttttactccaacacttttcctgctgtc

SEQ ID NO: 150852 - DNA, 566 bp, Homo sapiens
ttttatagtgcaaatcagaatccttttagacatgcaattttatattgtgctgactaagccaaagtttgtacagtcatctgtatccttttactgtttttatcctctgacatgattttagataatgatgaaaaatagacctgccgaaaacaacaccaacatttctgaagagtgaattaatcccttcctgtttgcaatttgggtatcgttggtgacattatcacatatcttcaaacttggaagatgactgtggtatagcttcctgcctcctccaatacagcagccatcaatttagacaaaatacagacataattatgtccctgaaaaaacagaaaggatggtaaatttctcttacaagtgagtgaagacccaggcctcccaaatttagccagctttctcttgcagggactgattcttgcctcatctgtttctcccacagaaaacacatcctttgacaaaagtgagagagtgttttgtgggaaaaaaaaagagatccaagaattagcttactttgtgtgaaataatgccttcctcgactgcatgcatcactgagatattgatttatgttt

SEQ ID NO: 150853 - DNA, 914 bp, Homo sapiens
gggggaagaggtcttttattcacttcctggtgcaggcacatgtacctatatattgctctttctgtagccagattatttactcagtgtagtgtgtgtgcctatgctacacaagaggttagcaaccattttgtaaagggtcagacgggaaaaattttaggctttttgagccatacagtttgagtggctactactcaaatccgccatgttgagcaaaacagtcataaataggtctttacactgtgttccaataacattgtatttatggacgatgaaatttgactttcatctaatgtcccaagtggcccaaaagattaatcttcttttaatcttcctccctaaccatcaagaatgcaaagccccacgccttgtgtatgagtacacaccatatgtagcacaggaaaaaggacgtccttgggaaggataatcactgcattcaggggagtggccacccctgagaagagagagagagaatcaagttgaggggcacgaggggcttcagttatctctccagtggtttattcctcatgttggtcccagatacagaggtgtttgttgtacctttcagtaggtcagaaataaaacaaatttttaaatattaagtatttaagtatttaaagttttaatttatcggccgggtgcgatggctcactgggaggccaaggcaggcagatcgcctgaggctcaggaggtttgagaacccagtcctgaaattaccattaacggaagggccccggttttcgtaccaataccacacacactataactatagaccatcgaacacacttgttttcgcaggcgcctggtgcgccctaaagaaaaagtgtcttataacacaccactcgttatgaggacaggagaggggcccacatgtatatattaggtgaaacacatgggtacaaaacgtgctgttcata

SEQ ID NO: 150854 - DNA, 281 bp, Homo sapiens
ggctcctttaagtcattaataaccaattaatacttgtctctttctcggtgaggacatcagtacataataggtgtgatttatcactatttctatttcatattatggcttcatctagagatagtatgtttcagtgactaaagacatggatttctgagcagactgactgggtttgtgccctggcttcaccacttcccacctgtgtgattgtgggcaatttgctaacctctctgcactgtgctttactccagatctgcaagacagagccacatggccagtcccca

SEQ ID NO: 150855 - DNA, 308 bp, Homo sapiens
ctttgaacttcacatatttgggatccaggctttaatactgtcagctggtgaaaatatgggtgtagaagatatttttgtatgaacataaaaatttggaaattgagagtttttaaatattagttgaaaagtggacatacttgaaattccttaggttttaaagttaacactcgtttgtagataactagattgttgccattatactataccatcatttttacttgcatgcttatctccctactagcaggtatacaccttgaggacagaattgtctacctttttttcaggttctctaccacctaacatagtag

SEQ ID NO: 150856 - DNA, 532 bp, Homo sapiens
gtcttttgagaagtagcaaaggatagtgatgaggagtacagaatctggcaccagactacctgggtgtgaatcctgctatttactgggtgtgtaaacttatgtaacctctctgtgcctcaatttcttcatctttaaaatggagataattataccactttaaagggctactataaatagtaaattaatatatatgaaatattttgaaagaggtctgagaaatagttaagaatcacgtaaatgtttacggctagtattatttcttcctagcttcctttcacttgttctatttcaaataagacaggattttttttgtaattacgtttttctatttctgatacatacatgtaactcatttttatatattcgttttaaacttaattctgttgtggtcagattccatttgttcgaaatttcttgagaattgctgcatttggtcagttttcataaatattccatgaattctattaaataatgtgtattcttcaggtgttgaatatggatttccttagatgttcattaaattgagcttatg

SEQ ID NO: 150857 - DNA, 473 bp, Homo sapiens
aactcctttgcttcatcggtatggaaactgaattttaaaaaataaaaatcaatttagctgatgcctaaacaatttaaaaagagtaaaaacttactttgcttaaatgaacgacaattaaaataacttttgagacatttattgattgaaagctgaatgagaatcattggcaatgtagacattattaaaatcacaggtcaggaagagtactgcttttcttttaggcctatctggagaatgcatctagcaagtaaatgtatgtaagtcataagagtttacctgcatttctaatatgatacagttaagtgaaatgtgacgatttcagagggcagccataaatgtcatcatgagttagaatacagattaggaacaatttaaacagttagaaaagctaatgcaaaggtcatgctactcacaaaccatgaggacttcaattttcctgacatttcctctaaggatgtgaagttcacaatctc

SEQ ID NO: 150858 - DNA, 355 bp, Homo sapiens
ggactcggcggagcgggccctgctaagcgtgtaagatagtgtgccgtttctgctacgtcccctgccccagcgtgccgtgtccccaggttactctgctgtccatttgtgctggagagaataatagaaataaacagtctttctgggtccactctaagttcattttcctgttgccccttcctgaagcttggaaatacatttattcaactcgattgaactcttctactgtctgattttctggtgttagagtttgggcaaattttctggaagggaagacaccagcgtgggcaggcaactgagaagggttctcgggtaagaataaactgggctggatgcaaacacagcgatgagtgaagat

SEQ ID NO: 150859 - DNA, 268 bp, Homo sapiens
gaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaact

SEQ ID NO: 150860 - DNA, 120 bp, Homo sapiens
gtttctctgctgggacctaggccttagtgcgggccctcaaccaggagccagggatagctcagagatgctttgtttggcagaccttctcatttcctgcctcttacccccgggactgcccca

SEQ ID NO: 150861 - DNA, 793 bp, Homo sapiens
cctccaatcatgagctaacctgtaaaccaggcgtgtcttatctgtgttgacaagtcttctgcaacccaatcccctggacagggcatgtgcagagaagtggttcatagctggctagccaaggaacacagatggctggactcaagaaacatcaggctctatttgctgcagatcccagccaggagactagaggaggtgtggcttcactaggggcaacttccaggcttttctagcctaactgtactccaggttcagctgaactcaagcctataatgggaacttgtttctctccatttttaccgagcctggtttggaaagtttattggatagggcaagtccctgaaacgtaaccagctccatgcaatgtggccaactggcagccaagagccatgctgagttggagcagagaatacaccgacactgtatggccagagcctagtgctgccatgggaagcctagagagctgagcatgactcctcagcaggctgaagaatgagcttaggacctgcctgatgcttccctggctgcataggcttggacgttcgtctctccactggcaatggcagcctcgagtataaacccactgcgaggactgactccccagagcaaaggtcaggagcttgtgtaacgtgtattttagaacagttatacttgcatatgctatttttaaaattcaaagaatataacaaaaagaacacaaattcttaattcttctcatcagctgggttctcacctctcactcccctctccagctccttaacattttctttatacaaactcaagcaaatttgaatat

SEQ ID NO: 150862 - DNA, 365 bp, Homo sapiens
caagagagtcccaggtccctgcctggagtgcatgtgacaatcatcataatacagggctatagcgcatatatgacaaagtgctgtgggagaaaagagaaagacaatccaatcccttgggctcccagaagaggtggcttgtgagctgcgccttgagcacccactcacggaggacagcataagcaaaagtggggaggaatgtgggcaggaggggcgtgaagaagcgggcagtggggtttggagtgactgaaccctaggagggtggtggtggcaagagatgatgggggagtgttggaggggcctgggcaggctatgctgaggagtttgggcttgacccaaaagtcacagtgaaccacggaaggggctga

SEQ ID NO: 150863 - DNA, 397 bp, Homo sapiens
cctcaagagcaaggtctgtgccttcctcaccctccctgctcagcgctcctgcacccggagcagcaggggccactgaatcctcaccagctcccaagccaaagactaccagtccactgacgccagtgaccgcgcccaaattcccttcctcagccaggcccgagagtcttcacagtccaaactccatgttcaggggtccgaagccccccattgcccccaagcccaggctgactgccccaaacgagtggagagccagtgtgtacctgaatgacagcttgaacaaatgcagcaacgggcggctgccctgtgtagacagggggcttgatgaggggccccggtccatcccaaagtgctctgagtcggagaccgacgaggattacatcgtggtccccagggttcc

SEQ ID NO: 150864 - DNA, 443 bp, Homo sapiens
gaaggaaagcaaaaagaaaaggcaggtaagctataagtctacctttcttcgtggttcaggatacatagtcctcctgtgcaaattactcaccatcttcctgcacccagctattaccagacacctcagctgatagaaaaatgcaagttagctcactgcaacctcagcactatcagtactgcacaaagccctcttaacacacagcccaagcaccattctgtcaaatcccgagcaaacgtttgtttcctggcagtcagctcctctcttgctgatttgcttgttgcacccttgcaacatactttcctgctttgtctaataaatctgcctttctttacctacaactgtattgatgaattctttttaccacctgcgtgacagcgggccccagagagtcgctacccacgacaggcaatggaaaagggtgctatgcttttctttgtggaagg

SEQ ID NO: 150865 - DNA, 190 bp, Homo sapiens
atacagtgaattcttggaacttgcaacgggtgtgtattatgaaatttaggatctaagctagcaagactttgctatacggctttgagaaggtatatggttgtcgcaaaaatctcaggagactctgcaagataagaaaatctcaaagcagaggcaagttcagagacttgctttcctactcctgaatcttcat

SEQ ID NO: 150866 - DNA, 551 bp, Homo sapiens
aaattgaaactctgaagttataacaaatgagcagcagattttcaaaattaacttttttgcacattttagaaatgtttacctcaaccctcaattcccaagaaaccattatatttcttcagccttttgcccagaagttcttaggatctttcctaggaactgccacaatggcaaattaacataaagttttgtattgcattgacaccaaagacctttcctttgccctggttcctggttgaaacaagcgtgaaataccatgtctgatgacatgccatggcagcatgaaggcttaggcccaagggataccaaggcaggaggattgcttgaggccaggagttcaagaccagcctgggcaatatagtgagaccctgtctctacgaaaaacacaaaaattagctgcacatggttatgcacacctgtagttctagcaactcaggtggctgaggcaagaggattccttgagcccaggaattcaaggctgcagtgagctatgatcacaccactgcacaccagtctgtgcaacagagtgagaacctgtctctaaatatataaat

SEQ ID NO: 150867 - DNA, 377 bp, Homo sapiens
atgttgtccccactgcctgagcctacggtgttggttccaccttggaatttttatatttgctctgaatttcccactcagagtatcccagaaatggccagccctaggaataaaagaagcaagctagtccatcatatctgtaattgattactttgcctctgctcgcatatccccagtgatggggagcttccttcctccccaggtagcctgttctaaggaagcttaataactaataattagcctttttcttttattttctttctttatttttatttagatgtagtctcactctgtcgcctaggctggagtgcagtgttgtgatctcagctcactgcaacctccgcctcttgggttcaagcaattctcctgcctcagcctcc

SEQ ID NO: 150868 - DNA, 783 bp, Homo sapiens
gtgtgactgaagcttagcaagtgagtgggaaattagtttagatttaggatgtagaagtcagcattttccgattcatatgagaaaatgatagtgctgagatttcaggcgtgagccactgcacccagccccaaaccaagtttttatagcagcaagaatagatactctggtatggtcagcgtctaaagattttacaaacaatatctcttcttttagtttgcagtcattattgaaataacaaacatgtcctattgtcaggccttactctcagtaactgatttcattgatctgaataggaaacttacttgattaatcagctactctttggtattacctgacatctcattaatgcatctttgaattgaattattgctcaataggagtgattgtgaaatagtggtaatgtgttacatcactattgaagttaccgtctctcatgtgagtcttgtgacagtttcagcaagtacaaagcactatggggttttacaatgatttctgtaatcttttctttttttctttttttttttttttttgagacagagtctcgctgtgttagccaggctggagtgcagtggcatgatctcacctcactgcaagctccgtctccgggactcaagtgattcttctgcctcagcctcccgagtagctgggattacaggcgtgtgccaccacgcccggctaactttgtatttttagtagagacggggtttcaccatgttggccagaccggtctcaaactcccgacctcaggtgatgcgcctgcctcggcctcccaaattgctggga

SEQ ID NO: 150869 - DNA, 685 bp, Homo sapiens
cagaagaatcacttgaacccaagaggcggaggttgcaatgagcccagatcgtgccactgcactccagcctgggcgacagagcgagactccattccccgccccctaaaaaagaaggtcataactgtttttgtgagagtgtgtaggagtgagagtttatatttggagaatatgagatgtaagatatgtataccagaagaattggggttatatatttgtgatttgggttgtgaagatgtattttccatgtgttttctcagatgaatgttggcgatttgtatttgtctaatgtttggcagatttggaagaattatcttgtgcacatgggcaataacagagaaagtgcttgtgtctattttgtggatgtacgctctgtttggtttacgtatttgggaaatgtaggaagaccatttgtatactcggggcatgttgcatggtgatgcgtgcttcttttcatgattttcagggggtgtgtatggctatttcaatgtgtgagggcagatccatgtctactgggggactggtaggatgaatgtgtgcagttatgaggtggagtttatatgattctgtgtcttggaagatggaggagttatttctgtgtgagcatttggaagtgtgattacatatgtgcaggtattgtggaactgtatgtggaggtagccacctgcgtctacccgagttccaattc

SEQ ID NO: 150870 - DNA, 955 bp, Homo sapiens
  misc_feature (235)..(235): n is a, c, g, or t
  misc_feature (237)..(237): n is a, c, g, or t
  misc_feature (902)..(902): n is a, c, g, or t
gctagcatgagacgactctcttaatcctccaccgctacacttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctatantnaagtcaaatctgtattgcatattgatgataaagtctttgctgtggatcaacattgctatgatgtcttaatttttccatctcatcttaaaaatgatcttataaatatagatcttttcaaagattacaaacttatatttcaggacaaatctcgaagtcttgctgtccattctgtaaaggctttattaaatatggatgatgatgtcttaatggtcaatacaggttcatggtacacagttgcccacatgtcaattttaacaaataataatacctcaaaagtatttgtgtgtggagtacaatcacaagctaaggatcctgacttgaagacccttttcacaaaaataggatgtaaaagtatgtaaaaatatttcttcatttggtgattattgttctgcaagattttagaaacgttaaaaagttttaatttattagtttttttgtaatgtaaaagctctatatgtgaactaatatcttaaaatccttactaatctatgtcttatcaggctgtccttgttgcttaatttggttaaacaactgtgggttaaattaatttcttggtactttgtaatactgtttgacatttagctcacataatttgaggctcaaacatttaaagtagaaatgtatcatttaataaataagaatgattatcatttaataaatactgntacgagccggccccctcctcccctcgatttgtaatatttacagatataaggat

SEQ ID NO: 150871 - DNA, 1208 bp, Homo sapiens
  misc_feature (488)..(488): n is a, c, g, or t
  misc_feature (490)..(490): n is a, c, g, or t
  misc_feature (1155)..(1155): n is a, c, g, or t
acacatgggaaaaatgaggaacagacaagttaaagcaggggtccccaaccccagggctgcagaccagtacctgtctgtggcctgttaggaactgggcagcacagcacgagcatgggacattcagaactgggaaggacttaatacagactcatgaaagttctttaatcttatcaagactatactgttgccatctgtgatactgataactagcctataatgagtgcctgctacgtgccaggcactgcgctaagaattttgcacacatgattgataatcactacattaataacaagttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctatantnaagtcaaatctgtattgcatattgatgataaagtctttgctgtggatcaacattgctatgatgtcttaatttttccatctcatcttaaaaatgatcttataaatatagatcttttcaaagattacaaacttatatttcaggacaaatctcgaagtcttgctgtccattctgtaaaggctttattaaatatggatgatgatgtcttaatggtcaatacaggttcatggtacacagttgcccacatgtcaattttaacaaataataatacctcaaaagtatttgtgtgtggagtacaatcacaagctaaggatcctgacttgaagacccttttcacaaaaataggatgtaaaagtatgtaaaaatatttcttcatttggtgattattgttctgcaagattttagaaacgttaaaaagttttaatttattagtttttttgtaatgtaaaagctctatatgtgaactaatatcttaaaatccttactaatctatgtcttatcaggctgtccttgttgcttaatttggttaaacaactgtgggttaaattaatttcttggtactttgtaatactgtttgacatttagctcacataatttgaggctcaaacatttaaagtagaaatgtatcatttaataaataagaatgattatcatttaataaatactgntacgagccggccccctcctcccctcgatttgtaatatttacagatataaggat

SEQ ID NO: 150872 - DNA, 349 bp, Homo sapiens
ggcctgtgcatcacctgacctagaagcatgtggacaactgagagtggagaggcagttcctgcaaggagcaaggcgtgcagtgtagatgaagaaccagaagcctgggttcactgcatctcatctgccttgcctggctaggctgaaagctccaggggcagactgagcctgcccaggctctccaggaacagctgatgattccttgggtgtcttgcttagtgctcctggcttgacttgacctggtcttcttggctcagaagcccctgcttattcgtgggtttctccagggggccggggaggaggtcgcacagcctgagatgatgtatgcgtgcacttgtcgtatcccagggtt

SEQ ID NO: 150873 - DNA, 341 bp, Homo sapiens
cgggaggagtcagtagtactgcagaactacagcctgagtaggggggatgtgcagctgaaaggtaacagattcatgcattcattccttcactcatgattcttttccttcatccagctaggaggtaattattcagaggctgttatgagccaggcatgggtcaaaacagaaaaatcagctcgactcagtgagagcccaatcttcccattccaggaagcctagcagatggaggattctacccccaccagcaaggtccaggcttaaagcaagtgcaagggtcacctcaaatctttctttacaaggtgaatgttaaacttcaagtgtgggtactactgaggtgtaag

SEQ ID NO: 150874 - DNA, 662 bp, Homo sapiens
cggtgaaatcttgtttgttactgtcattcccattccttttcgtttagaatcagaataaagttgtatttcaaatatctaaaaacaaaaaaaaaaaaaaaaaaaaaaaaaaaaaaaaaaaaaaacaaaacaaaaaaaaaaaaaaaaaaaaaggaaaaaaaaaaaaaaaaaaagaaaaaaaaaaaaaaaaaaaaaaaaaagaagaacacaaagagaagcggagacctaaacaacaacacaagcgacacaagagccaagccacgccacacacacacacagacgcgtcgacaacccacacggcgccaccacccgaacctcccgccacaaacacaacacacaagcaggcgcgcggcgaaaacagcgaacaaaccacgcagaagcagacacaacgaagcacgagcgacgacacaacctaacaaaagacacacccaagacaacaaagaaggagaaagaccaacaaagaacgagcaaacacacacgaccacaccacggcaccacacgagcacaccagacacaagaacaaacaaacaagcacgaaccccacccacgcacaggcaaccacaacacaacaacagaccgacgaagcgcacgcagacaaaacacaacacaacaagaacaaaagacaacaaacaaacagacaaaccgccgaacaaacaagcaagaac

SEQ ID NO: 150875 - DNA, 272 bp, Homo sapiens
aatagggtctatgtagacatcaaatatgtttgtttaaatcaacactcaaatccacactggcctgtaggtgtggattccaaactcaagtgactgccttaatattcttttaatctgccctgatttcttctgtttttgaaacgtaaaatatgaccttcaagtttcacctcactgctttgattagtcacacggtatccatgttattagcaagtatgagttgtgctggagaaaaggctgcggcctaaggactctttcagacgcatgggctgtgtctg

SEQ ID NO: 150876 - DNA, 336 bp, Homo sapiens
tcatcgagctcggtaccggagtggagagagaagggggagtggagagagaaggagaaaaggaaaacaggtagaacaaggagaaggaaacgagcatgcaggcaggcaggaagtcaagcaggtaggctgggttgtttccatatgggactctttctatgcaaagacaaatatttcaatgattctgagttttactttggctcatgatatgaaattggtgcatttcataggtatgtgagtatctgagaggtgaatgagtgttcttagacacttgggcagcagctgaagctcacctggcattcctacttgatgctctcatagttcaagtctcaactatggtga

SEQ ID NO: 150877 - DNA, 287 bp, Homo sapiens
gaacacaacgtgtagttatacagaagttggcttcgtttagcttgcttctgccggggccagtgtacccagaagaaccctgggactattttggaaaggcagacttggggttgttgttggactgggtgatttgaaggtggaattagggaaatgggaccagatctgggttggatgtggccaggaggcagaaacaattcagtgattgggtatccaacaacttttatctaggaggtaggagattaaagtagagttagagtggccatgcagtaaagaatttgcaatcatacatg

SEQ ID NO: 150878 - DNA, 505 bp, Homo sapiens
acagtgtgttctatctctccttaggataagatacagaggggaaggacttcggctgtctatttgcaatacgtgtgcaacctctggaacatccatccctaatctccttgaagcccttcattcattattaattgaagataacgaaataaaaaatctccaccagaagcaaaatctataaatgcaataatagtaacctattttatatgatagatgactttatatttttcatatttaactgtaaattgtgaaacaaaactaaaaagtgaagatgagaaaatagtagaaataaaatagaaatctacacttaaaagtaaatgtacaaaaagaggctatcaatgaattcttctctatatgttctttgcatgtctttcactcctgggagatttgggcactccggtaaaatttctcttacgtttatgtttcacaagacaattaattctactctaatctcagtgtaatgatttcactcttctgttaaataaaaggaaactctactttttgatatttt

SEQ ID NO: 150879 - DNA, 498 bp, Homo sapiens
ctgtaagtttgtgaaaaagtacaaaaatggtgatctcttttatcatacaaataatttctttttaatagaatgttttttctaattaatgtattaatgtacttttcattcaacacattcgcttacatttgaactattttatgaatgaatgtttaattgcataggtgaagattactagtcacgggcattttactaactgattctcattaggcataggttcatgtgatgtcaaggagctgtgttttgtttggtaaaagtaataaaatagcacaagaatgaatgcaagcactgaagcacgatggaggcgcctatcatgacttgtctatgatttacatcactcgttgtctttccaggttgcttatcatcctgataattgtcatcagcattgtttgggtccttctagcacagtttcacaaaatgggcaactcttccgttaggtagagataattccatttgagcctttaattgcatctgtcttccagcttcttcttttggaagagt

SEQ ID NO: 150880 - DNA, 847 bp, Homo sapiens
cagatgttcagatgggtccggagtttcttccttctggtgggttcgtggctgacatcaggagtgaagctgcatccctttgtgctagacacaaaagttctccaagtccccacccatcccagaagcccagcaggcttcacctttcactggcactggcttgactttgcggcacctatcctggacactccggcaacccagaaggagctcgtcccagacaaccaagaggaaaaggggaagccagaaagagacagagacccgccatcgttgccaacaactcggtgaagagggaatggcgatccaagcaggggacccagcctctgatcaagcccagcaggcaccagcctgctgcccggagtgcggggccctccgagcccgtgcccacccagaacccatgccggactgcaagcaccgcgcagccccagctctcgtctgcgcctctccctccacacctccctggagcagagggagccggctccagcctccgccagccccagaaaggggaccccacagcgcagtggtgggctgaagggctcttcaagcacggccagagcggacgccgaggccgaggaggccccgagagctagcaagggctgctagcacattgtcacctctcagaagtccaattctcttaccatctgcttagagtttttcacttctttgtggccctgggaactctttttcatatatgagttctggaatatttctggtgataatcttgacattgtacatttggttttggtttattgtggagggagtgaagtcagcatgcttctatgctgccattttggaactggaagtcctcctgacccacagaaacagaaataataaatgtgtattccttaaaaaaaaa

SEQ ID NO: 150881 - DNA, 420 bp, Homo sapiens
ctgcctcagcctcccgagtagctgggattacaggcacctgccaccacgcccggctaatttttgtatttttagtagagacggggtttccctgtgttggccaggctggtctctaactcctgaccttagttgatccacccaccttggcctcccaaagtgctgggattacagctgtgagccaccgcgcccagctgtaactcattttcaatgtgtattctgcccgtttcatccacaaaggtggccaccaccctgcacatgggatttagtattcttttttttttaatcagctaatgaaatgaccatttaacagacatgtactgtttaaaaaaagaaaacaaaaaaagaaatgaccagaaagcacttttttaaaacatacgttatgctgtttatataaaattcaaaagcattgcattgtcatttatt

SEQ ID NO: 150882 - DNA, 351 bp, Homo sapiens
agtcttaatggtgaaagtaaatttaaaatttttattttggccaggtgtgttggttcacacctctaatcccaggtacttgggaggctgaggcaggaggcaggagaatcacttgaacccagaaggcggaggttgcagtgagctgaaattgtaccactgcactccagcccaggtgacagagcaagattccatctaaaaagaaagaacatttcaaatctttaatatgcggctatgcatgaagacatgagctcttatcaggtggtatttaataggactttgatttcctttagggcactaagcaaaagcactagtagttctttgaatttgggacttaaaggcaagaaggtgagttag

SEQ ID NO: 150883 - DNA, 516 bp, Homo sapiens
atttttttgctttttaatagccgttctcactggcatgagattgtatctcgtggtttttctttgcatttctccaataattattgataggcattttattatatgtgtgttagccacatgtttgtcttcttttgaaaagcatctttttcaagttttttgtctgctttttagtgaggtcttttttttcttgtaaacttaagatttttatgaattctggacattagacctttgttagaagcatagtttgcaaatatttcctattattctgttggttctctgttttctgtgttgatagtttcctttgctgtgaagaagctctttagtttaattaggtccaatttgtcaatttttggtttttttgcagttgctttttgtatcttcaattatgaattctctgctagattctatgtctagaatgacatttcctaagttatcttccagggttttttataatgttaaaataaacatttcagtctttaatcttgagttgatttttgtatatggtgtaataaaggggtc

SEQ ID NO: 150884 - DNA, 178 bp, Homo sapiens
agaggatccccttctttgctcatcctatctcactgttctcccttctgctttgtgtggtcatctcattaaatcaattttagaaattattagaaataaaataattttgtttcccaagttttcctgtgaaagcaattctaatatttggggtctccttttaaacaggttcgtctcaatttgg

SEQ ID NO: 150885 - DNA, 843 bp, Homo sapiens
  misc_feature (64)..(64): n is a, c, g, or t
  misc_feature (75)..(75): n is a, c, g, or t
  misc_feature (111)..(111): n is a, c, g, or t
taaaaggagagcaggatcaattaaaaaaaaaaaaaaaaagctagcggcactgatctcttaattncaccgctacanctactgtggcctagaagtaacatgcaccacttcttnaactgggcattgaggtattactgtccaagaatcccttcaactaagatatcacatagaaattgaaccactcttgggaacagatagtgaggacgagaaaagaaaaaaaaagaagaaggaaattgaagcactgacatatgagggaatagttttgtaatgatttaataattactacaagcaccacttgaggttatgctggaactattggcgtaagaatcttattaccagggattccccggccagatggccaaataggaacagctccagtctgcagctcccagtgagaccaaggcagaagtagtgcctggaactccagcaagacagaactgttcactccaatggaaagacggctgaagccagggagccaagaggtcttctcagtggatcccaccaccatggagcccagcaagctaaaatccactggcttgaaattcttgctgccagcagagcagtctgaagtcaacctgggatactcgagcttcgtagagggaggggtgtctgctattactgaggcttgagtaggcagtttgcccctcacaatgtaaacaaagcctccaggaagttcagactaggtggagcccactgcagcgacaaaaatcctctgtttccacactgcctctctagattcctcctctctgagcagggcatccctaaaagaaaggcagcagccgtagtcaggggcttatagatgaaacttccatcttcctgagacagagcccttggggaaagggacgg

SEQ ID NO: 150886 - DNA, 363 bp, Homo sapiens
aacgggtgatgaagaagccatggaagcaagtagtggtgatggttttacaaacacggtgaacgtagtaaatgccatcgaattacacactttaaaatggttataatgatatattttgtatgtattttaccacaagaaaaaaaatgtttttaaaaaattgcgaggactttgggaaggacacaatacctggtaacaaacacctgagggcctatccgacgagggtccaaggacaggacctgtcctgcaagttcccagagtatggaacctcccggaagccaagctccagcatcacagcacacatcacagccagcattccctgcacacctgccacggtcaggccagaagctttcatcagcattagaggat

SEQ ID NO: 150887 - DNA, 802 bp, Homo sapiens
  misc_feature (802)..(802): n is a, c, g, or t
atttgaagctggcttgcatgaaatgtatagtgcttatgcacagattagaacctcttcccagaacctgagggtggagatgtatatcctcatttaaaggaaatgaaggttgttatagcatttctttgcagtttgtccccaaatttggcgtaattttgatttgggaaggatgaccttgacatgaagtcctgtctttcttttttttgtttttttttttcgggtgggggacggagtctctctccgtcgcccaggctggagtgtagtggcgcgatcttggctcactgcaacctctgcctcccgggttcaagcgattctcctgcctcaccctctctactaaaatacaaaaaattagccggaaaaaaaaaaaaaaaaaaaaaaaaaaaaaaaaaaaaaaaaaaaaaaaaaaaaaaaaaaaaaggggggaaaaaaaaaaacgccaccagtggggggacaaaacaatataaacacaaacagagccgtcgttgtaacacacaggcggcgccaccacataaatcggacaactattacttcacgcatccatgaagacgaggacacgtgtataaacacacggccgcggcgagggttaaaaccgacgctcggtcaaacacatcgacgacgacaccaactaatctcgggcggagcacaccacatcggcggcaaccacaccacagacagaatatagaacgccccaggcgggcataaacaaacaagtcaccgcgaggagaatgcgtaaaacacgaatgggatatacagtagcgcgcagcaatgacgcgtcgccggcagctatcgagacaatcaccaacgn

SEQ ID NO: 150888 - DNA, 122 bp, Homo sapiens
ttgagggacatcagttctctgaagatttctgccactcacctgttcctgaatatgtcaaatgacataagacatttaacatttactgagcacatatatatacaccagacccccctccacacaca

SEQ ID NO: 150889 - DNA, 403 bp, Homo sapiens
atcacgtaatgagtgcttactcgggcaggtactagttcacacatttttctcctttactactcctgtctaccctatgcataggggctctacccccacctaagaggtaaggaaataggctcaggggcattagggaatatagattcagatcctgactataatacattctagccaagtgtgtgtaactcttccaagcccaactgctgtgctctagaccctgtttattggcacacttactattggcttacagctctttgctgttttcttccctttctccattcctacccatgattctgggattgtggcatattcagtctttcctggcttcaagacagagactattaccaaaaccatagtgtattcaataaatgttgaaagactcaatggatgaatccaaagtcagcag

SEQ ID NO: 150890 - DNA, 413 bp, Homo sapiens
tattcctggagctcctactatgtgtgaagcactgccccaccctggaaatacaatgagtatgaggaggatctgcctgctaggaactcccaggccacccccttttcttcctactttatgagccttggatttatgtccaccctaccagatccttggaaaagaaaatgtttacattgcaagacactgtagggctatggacaagggcaggcccctgggggggacacatttacccacacctgccacaggaaagaacacaagcctatctgttttttccacacttcagatgaaaccatctccacctcatatggcctaagcaaggtagtagtgtgggtttgtggtgagtggggatgcacaaaggaatgctctagtcgatataggctgaagccaagctccgttcctacttggtctcagaaaaa

SEQ ID NO: 150891 - DNA, 340 bp, Homo sapiens
gaccacttgatctgctgctgactcacggcgcactctccctgccttgcttgggtcctgggccatgtaggggattgggttccagaaggggagctagggaccctggttctaggtggcctggacttcagaagctgcccctgaagttcggggatggatccgcagcctctgtgtgtgggtggggattttagcatgcactgggccatgctcaggacctcgcacaggtctggaggggaaccagggcctcggcatggcgtctgtggcctgaaaggaataaatccatccttgcttcaaaggctcccagagtgttcaggtcttccacgtcaacccacatactttggcaggg

SEQ ID NO: 150892 - DNA, 588 bp, Homo sapiens
gaaccgaggtcatgcgtacaagatggaatggtttgtaaccatgctcgggtagaaactgacatagtaagttaagcacatttgttggtgcctttagtccccgcctccaaatacatactctctgcaacaactgcgatttcctaagaagaatgtttctcctacttttcaatctttggttcaacattgccttgagaattcaatatgaaacaaaatctgcatttataacatattcacccatttaaacagacatttcaagtgacttttctggtagtaaaactagtgatggttaaatcgcaagcaccacattttcaggtttagtagaaaatttcaatgtgcaaatttaaaaactttaacctggctgggcgcggtggctcatgcctataatcccagcactttgggaggctgaggcgggcagatcacaaggtcagatcaagaccatcctggctgacacggtgaaaccccgtctctactaaaaatacaaaaaattagccaggcgtggtggcgggcgcctgtagtcccagctactcggaaggctgaagtgattctgatggtgggactacccggatctgggaagacccagtggggcctgga

SEQ ID NO: 150893 - DNA, 553 bp, Homo sapiens
ggccaagaagacgatgggagatctggcccataatgcttcactgataggttttgtttatttccccatgaactcactgtaaagcagtaaaatgctgggattgttctgctaacttacggccaacaaaaaattcatcctcatggagagccctcgtcctttgggggtggtgctggctcctgccactgccctgcaagtgtctctaatgtgaggtcatcagggtttagggccaatcagtatgaattcctccgaagctattttgaaggcagatttgagaccacaagagactttttgtccttccctcagtagcattcttgatacctggttttatagcatacataataactagggccattacctcttttttttctttttttgagacggagttttgcttttgttacccaggctggagtgcaatggcatgatctcggctcaccctaccctccacctccaggaggctgaggcaggagaatcgcttgaacttgggaggtggaggttgcagtgagctgagatcatgccactgcactctagcccaggcgacagtgcgagactctcccaa

SEQ ID NO: 150894 - DNA, 6281 bp, Homo sapiens
cttgcgaggtgagcatttccaaggctgtgtgctcgtggggtggggggacacacgatgaccttctcctcctcaggaagacctaagagggaagagcaaaccccagcgagatcccccctgtgctgatgattttcagggacttgttggcaactcagcgagggttgccatagcttttttatgtagggtgaccagaaccggctgaaactggtttgaggcagatcagctcctgaacacaatgcagtcactgagctactacagtaggatagcagcttcctcccttcatggcagccaaaagcagaggagcttgcaggaaggtaccatccctacacagtatgtgaatgcacacttagacaccacacagcactggtacgtgactaatggagccctaaaagattctgggtagagaagatggaaaaaaaggtgcaggtttgcagggtctgagattacttgggcttttcctgcctttttcttttgcttaagggatggacaaggagctgagatttatgacccttattagagaaaaaaatgtgccttgctagggtggggacacttggttgatgcagtctctctctctctttctcggtgtttataacaaaacaaaaccaaaatgaactgaggggtttgtaatggtagtttgtttgttgctggagaatgctactttgcatgctttttttctcttgcagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150895 - DNA, 209 bp, Homo sapiens
ttctcaattgtattattgttttggcatagagtttttggattgggttgtcacacttaaatatgaaaataaaaaaaaaaggagcattttcttgcatatcccaccaggaggctgaggcaggagaatcgcttgaacttgggaggtggaggttgcagtgagctgagatcatgccactgcactctagcccaggcgacagtgcgagactctcccaa

SEQ ID NO: 150896 - DNA, 5950 bp, Homo sapiens
  misc_feature (1)..(1): n is a, c, g, or t
  misc_feature (3)..(4): n is a, c, g, or t
  misc_feature (9)..(11): n is a, c, g, or t
  misc_feature (16)..(16): n is a, c, g, or t
ngnncgaannngccangtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgaggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150897 - DNA, 5868 bp, Homo sapiens
  misc_feature (1)..(1): n is a, c, g, or t
  misc_feature (3)..(4): n is a, c, g, or t
  misc_feature (9)..(11): n is a, c, g, or t
  misc_feature (16)..(16): n is a, c, g, or t
ngnncgaannngccangtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgagcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150898 - DNA, 6787 bp, Homo sapiens
  misc_feature (1)..(1): n is a, c, g, or t
  misc_feature (3)..(4): n is a, c, g, or t
  misc_feature (9)..(11): n is a, c, g, or t
  misc_feature (16)..(16): n is a, c, g, or t
ngnncgaannngccangtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgaggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgtgcttctgtgagagaattattgatggtgggtctctgacatctttgtgaagtttgggaagtaattaattgcagcgacaagctacagggtgttgcagaattcttcccactcagaagaatggcatattcgttctcattagtaatcagctattttgtcactttcttgttgactccatcagtacatgggtacaatccgagggtgtgaatttcagcttgaaattccattgctgttccttgttttgtttgtattgctctaagttgtattcataatagcactttcatatgtttctgcatttgaaccttgcaataagcctgtgtggtaggccacataggtccgaataacctagttttacagttgagggagctgagctcagattcagttctttgccgaagccctcatagctggtaagtggctttgcatattagaacccaaatattttgctctctaaatctaatgctcgctctatgtggttatgtacatattgacaaatattcatttattcaacaaataaaaagtatgtacaaaacatgaaaaaaaaaaaaaaaaaaaaaaaaaaaaaaaaaaaaaaaaaaaaaaaaaaaaagaagacaacaaaaaaagaaaaaaaatcccaacacacatacaaagcggcccggccaaacagtaatgatgaatagaaacaaccgtgcggcaacaacagaataacacatcaaagggcagcactacgtgggcgcacagaaaagacgtgcggagggtcactcgccgcatcacgaaaagcgtgcgcgcgggaaacacaaacagagatagtcgctcaagtacgccgtatcgcgagagcgcaacaagcaagccgaatagcggagc

SEQ ID NO: 150899 - DNA, 4852 bp, Homo sapiens
cccccgaggtgaagggatttggacttctccccccaggtgcttgaaagaagagaagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaacaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150900 - DNA, 994 bp, Homo sapiens
catctcgacaagttgggccaaagtaaatgcggttttgggccgtgaattttaaattattataactaggatcaaatatatctttattaatccaaataggtactattaccatccacatgtttttgcccaccagaaataagtttattcctgtggagtaaaaatccgtgcttcgggattctaccaactcctggaaagcatgttcttcatcctgctaatcaaggaagcgttttccctgcacaacttgtcgagattcgaatctcgacaagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150901 - DNA, 4061 bp, Homo sapiens
cccccgaggtgaagggatttggacttctccccccaggtgcttgaaagaagagaagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtctaacattgcagatgtttgctttacagtgaaattgtgttgacttgcttttcccattcatttttttcctttcaagtttttgttgcatagttacagttttaaaaattcagactggctgggtgcggtggctcatgcccaccactttgggaggccgaggcgggtaaatcacgagttcaggagttcaagaccagcctggccgacatggtgtaacctcatctctactaaaaatataaaaaattagcttggcgtggtggcgggctcctgtaatcccagctactcaggaggctgaggcaggagaatcgcttgaacttgggaggtggaggttgcagtgagctgagatcatgccactgcactctagcccaggcgacagtgcgagactctcccaa

SEQ ID NO: 150902 - DNA, 401 bp, Homo sapiens
ggtttgcagggtctgagattacttgggcttttcctgcctttttcttttgcttaagggatggacaaggagctgagatttatgacccttattagagaaaaaaatgtgccttgctagggtggggacacttggttgatgcagtctctctctctctttctcggtgtttataacaaaacaaaaccaaaatgaactgaggggtttgtaatggtagtttgtttgttgctggagaatgctactttgcatgctttttttctcttgcagggtatgttctgtcttgtgctttttcttttagaagctactaaagggtgttggggatgcttctgactattatgaaggccaaaaggtaacaatatcgttctaggaaatgaacataaatgcattccagtgatgctgttagccataca

SEQ ID NO: 150903 - DNA, 5170 bp, Homo sapiens
cttgcgaggtgagcatttccaaggctgtgtgctcgtggggtggggggacacacgatgaccttctcctcctcaggaagacctaagagggaagagcaaaccccagcgagatcccccctgtgctgatgattttcagggacttgttggcaactcagcgagggttgccatagcttttttatgtagggtgaccagaaccggctgaaactggtttgaggcagatcagctcctgaacacaatgcagtcactgagctactacagtaggatagcagcttcctcccttcatggcagccaaaagcagaggagcttgcaggaaggtaccatccctacacagtatgtgaatgcacacttagacaccacacagcactggtacgtgactaatggagccctaaaagattctgggtagagaagatggaaaaaaaggtgcaggtttgcagggtctgagattacttgggcttttcctgcctttttcttttgcttaagggatggacaaggagctgagatttatgacccttattagagaaaaaaatgtgccttgctagggtggggacacttggttgatgcagtctctctctctctttctcggtgtttataacaaaacaaaaccaaaatgaactgaggggtttgtaatggtagtttgtttgttgctggagaatgctactttgcatgctttttttctcttgcagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttgg

SEQ ID NO: 150904 - DNA, 5656 bp, Homo sapiens
cccccgaggtgaagggatttggacttctccccccaggtgcttgaaagaagagaagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150905 - DNA, 6478 bp, Homo sapiens
  misc_feature (1)..(1): n is a, c, g, or t
  misc_feature (3)..(4): n is a, c, g, or t
  misc_feature (9)..(11): n is a, c, g, or t
  misc_feature (16)..(16): n is a, c, g, or t
ngnncgaannngccangtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgaggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgtgcttctgtgagagaattattgatggtgggtctctgacatctttgtgaagtttgggaagtaattaattgcagcgacaagctacagggtgttgcagaattcttcccactcagaagaatggcatattcgttctcattagtaatcagctattttgtcactttcttgttgactccatcagtacatgggtacaatccgagggtgtgaatttcagcttgaaattccattgctgttccttgttttgtttgtattgctctaagttgtattcataatagcactttcatatgtttctgcatttgaaccttgcaataagcctgtgtggtaggccacataggtccgaataacctagttttacagttgagggagctgagctcagattcagttctttgccgaagccctcatagctggtaagtggctttgcatattagaacccaaatattttgctctctaaatctaatgctcgctctatgtggttatgtacatattgacaaatattcatttattcaacaaataaaaagtatgtacaaaacatga

SEQ ID NO: 150906 - DNA, 3410 bp, Homo sapiens
gatgtgtatgcctataaacttgttactatatattaaagtcttttgctcacataaatttgtaagaatacctctttgccctaagcaaaatgcaaaagtaatggaattggaactctgctgaaacaggtgtttttagctcatactttgagacgagcctgactagatagcacatactgtgattttacaggatagagaattgtacgctggacatgtaactttcaagttggcttttcccttgggcttagaatcaattactgtagtgtttgaaatgaaggatgtataattatctggaggtttaaccaaggttctttgcatattagaaagtacttagtaggaccaaccctgtttccccctttggtttgtttagaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 150907 - DNA, 417 bp, Homo sapiens
cagtaacacagactgggttgtttaaagtaaagaaggcactagtccagtgagtaatcccttcattttccacacacatacccttctgttttctccctctcctccccccacaccctccactgcagttaaaacgtaattcgaagaagcctaaggtaaaagcccctgccgcataatgaccctagagcttcacctcacctactctgattcttagtaacctacctctaaggatgagagacagggtgctacgagcggggcgaactttggtccaggagttaagaaacctgaaccctggagtcctcaaaaaaaatgaatgaaaataacagaggcgccctgaggatccaagctggggcggtgccaagggctggcaagtgaggttgggacaacagaagtcaaacgtgccgtccttccagatcccggcgc

SEQ ID NO: 150908 - DNA, 540 bp, Homo sapiens
tgaaggttaatctacactgtagacctgtgcagattcagacaccacctcatgatgtcaaaattgctgccagaggagaaaggtcttctctctacaacagttgaatagaagccctagtcctctcattgcctggatttgcatcctgtgcccaatactgaatcaattgctgcagtccctggaatcctaaaccttctctgttcacagcaatctggtgtctcaaaagtctttttcatgatatcctacgtcaaaataaatacacaacagttctgtttattaagtaattaggtccaaacaacttgataagtatccataccctaacaacatagtagctgcttgaatatataatacacatatatatttttaaaagcacttttatttttaaataaacataattacttagtaatgggatgtgtgggctacggcaaaatttctcaaatgttagaatcagattagacacttccactcttatttcttgtcccatattaattttttcatgcagcacttgtttttatcataataataactgaaaaaccagcttcataa

SEQ ID NO: 150909 - DNA, 359 bp, Homo sapiens
gtgatcacaggattaagtgctactccacaaacagctgggatgtaggagtgaaccaccatgcccagccaagtattaattctttaactggtataattcagcagcgaaaccatctagtcccaggcttctctttgctaagagactttttattatggccttaatctcattactctttgtctattcaggttttagatttttttcattgttcaatctttgtttttatattcatgtctggtacagcagattccagcagaaaaaccaaaaagattttcttttacattttgttctctgttggcaaaacatgtttttcttcctttgagcaacagtaaacttccatagttcctgtttgtggaggtatcact

SEQ ID NO: 150910 - DNA, 519 bp, Homo sapiens
gtgaacaaatgggtttaagagagacaaatcattagaaatctctcctgggtatttcaatatctttaatgtccaaagcttattttctgttcactcatcctttaactcaggttgccagtaagtaatgtttcatcagaaagtcctgactatacagaaatatgaaaatatttgttgttttccaacagagaaaccccatcctcccttaatgcctaccttggcagactgaagtcagatggagaagtagccctaattctaagttgctggttatgtcccatcttcctgttgttggttattactggatggtgatactgccttgggatttcagccacaagcaatttggaggtttagaattcatctcttacctctaactactccacaacgtaactactctttcatactccatacctactctttcagcctctactctgtcatgatggtaacagaggtagaagtagggctgtctcccctacattttagaagtgtcagtcctttcaccactctacttccatttacaccattttc

SEQ ID NO: 150911 - DNA, 542 bp, Homo sapiens
tctaggaataattctgttatatgaattttaagaaactctgctataggaaatggggagccactgaaaaattgtgttaggaagtaacacggttagatgtttgtaggaaaataactctgattgcagttatagcagatggattgcaagaggcataggctgaacgtagggagaccgcttaaggtatcacagtcccactgaaaaatgaagacctgaacttaggcaaagcaatgagattaggggacggggaatggtgaaggctgatttgagacagctttaagagataaaagcaagtattgatgattaactagatgtgggaggagatgaaagatgaggaagataactcaggtttctggcttgcctaagtggagtcccaagcaaaatgggaataacaatagctaacctatgttgagctatatagtaggcgctaccttatgtgcatttttctcatctatcctcagaggaacactaagcagtaggtacaaattattatctctgttttatacatggaagtacagagaggttaaatgacttgctgaagtttagta

SEQ ID NO: 150912 - DNA, 589 bp, Homo sapiens
ccaaaacgacccgaaggacatctttgggcagctctgattctttctaagccagtgcccctgaccatgcatctgttggtgcagttttattctttggagctgttgagataaaccatgagttcagattattcatgaaaagtgatgggatcttaacagataccttgtgaaactacttgatcaaatccctctttcccatgtccaaaggccctgaatcttcagccctccaagtcacgtaccctcacatgcctggaggccagatggagtggtcgtgggtccgttcaccagcctgtggtgtgcatgtcactgtctgtcttcgggtcgtttaaacgacccgaagacctttgtcatgatgtcctctttaaatccctcccccacattgaaacatgcaatgaggactgagctttaactagtcatctgtagttactggcccatcctttgatagagtggagatgagagattttaaggacccaggacaactagaaaggtcagggtagaacccagagtcagtaagagtggtagtaacagtatgcaggatttaggtttggctccagagacctggacttcacacatcaactgtcatcacattacgctg

SEQ ID NO: 150913 - DNA, 921 bp, Homo sapiens
aatttcttactttttccaggcagagtgtcttcactatttagctgtagaagtataactatttttgtctgtgtcacaattttgtactcaggaaccctggccatgtcactagccaaacggacataacttatggaatacatggacagcatccggttgatatgctctagagaaaaatagcagctaccatagacttcaggaaagacacatcgagccaatgacaaaaatgtgggtttcctaccttcagggagtctaagaatgcagtagaaagtgatgtggagcaaacatctttcaaatggaaggaagggatagggaaaggaagactgttagaggctcttttgaatgttagaggcaacataaaacatatttggatgtgtattctaaataaaatgcaaatgtcaagaaggatgtcagctgtgagtgggactcagagaaagagaaacgttttggactacagaggcctgcagtacaagtggatctacaattttgtttagggaatccaatgcctcaggtatctatgtgaggcagaattttcctatggagccagcggcaaggctccagaggagaaatacagtacaagccactttattttggagtaaaagcctgttgtacaaaaattacccgccccctccttttttgagaaacaatttcacattgggatactaataagaaggaatgctcagtcatgaataagggtgaccccgttgtgatctgagcattataggatcatagtaactacaaccagtcttccatcattccatggaaattgcatgtatgccacgttgccttctcagtttccaagggaccaattaatgaacaggctactcacattttcaacatcctactcctgacacactcccacccttctttctatttatctgtgattcatagagatttgcctatgactggattcctgaggagaaaaaa

SEQ ID NO: 150914 - DNA, 604 bp, Homo sapiens
aatttcttactttttccaggcagagtgtcttcactatttagctgtagaagtataactatttttgtctgtgtcacaattttgtactcaggaaccctggccatgtcactagccaaacggacataacttatggaatacatggacagcatccggttgatatgctctagagaaaaatagcagctaccatagacttcaggaaagacacatcgagccaatgacaaaaatgtgggtttcctaccttcagggagtctaagaatgcagtagaaagtgatgtggagcaaacatctttcaaatggaaggaagggatagggaaaggaagactgttagaggctcttttgaatgttagaggcaacataaaacatatttggatgtgtattctaaataaaatgcaaatgtcaagaaggatgtcagctgtgagtgggactcagagaaagagaaacgttttggactacagaggcctgcagtacaagtggatctacaattttgtttagggaatccaatgcctcaggtatctatgtgaggcagaattttcctatggagccagcggcaaggctccagaggagaaatacagtacaagccactttattttggagtaaaagcctgttgt

SEQ ID NO: 150915 - DNA, 776 bp, Homo sapiens
cagagagtggggagtgggaaaggttggtgatcaactattttgatgtctgtcttggaagcagcaagggctgtagttgcccacacctccctccaatgctgacctagactggtgacaatgagattggggtgagaattagctgagtgcccatgagagagggaattagggcaggatcccgctgggctatggacacagaggcttcctggcaatcactgcagacaccggtgaaaaacactctgattacagaatccaaaggaagccgctggcatcatagggtgacagccacaggcacagcctccctgggggggtccctcagctcctctcctctggggagaaatcctaggcagggggcaggaaagggcaagagattatccttgagcatggacacgccaacccagatgatccccagtggggaaaagtgggcttctcagtttggcatttccaaccacacatttttaccaggaagacagactaataattgggctagtaatggacacgacaatcaacatccacagccttagccttaagcctccccttgaagcctccaggagcctcccaagctgtgttgttctgtgacccagcacagcccaacacacttctgacctcctgaggctgggtcagtctattttcccctcctctgccatgcccaggtcctctccctgcccggcccagctgccctggcctccttgacccacttcctctgcccggtatggttcatagtcacaatggtggcctccaagaggcagcaagacactctcatgccctgttccgagctctcc

SEQ ID NO: 150916 - DNA, 443 bp, Homo sapiens
cggaggttgcagtgagctgagatcgtgccactgcgctccagcctgggcgacagagcgagactccgtctcaaaaaaaaaaaaaagaaattcttacatctgtcaaagtttgaaaggcactgtgctaaataaagaggccacttcataaggaattaatcaagtaaaggctccagaagacaggatcaggaggaacctaaccctgagcaagtcacctctctcctggtttcatttcctcctctccatagagtgagagagaactatgtgactcgcaaggcccttgctggccccaaatctagaaaaagtacactttttaaaaagctaaaacaagaaagcaagcatgtttataggatatgcgtgtcatcatctttcagggtccaccaggctcttacagcaaatcccatcgttcccaaagagagaatcagttaagaacatgtccaaagagaaga

SEQ ID NO: 150917 - DNA, 514 bp, Homo sapiens
aatcatacacacaccccccacgaagaaaggggggctccggatctcaatcatagcattccttcctctctgaagggaccaggtaacacacggagtgccttggcagcctcatcattgcatgcaatcttcacagacaatatctcactgcagccacctttctacaggagtacagactgtggtgctggatgtcacccctctgcgaggcccttgggatcgactgagagaccagcagtgaagttcgtccaccttctgaatggatgccatgatcggacgtgatggagctcagtgggatgctgctgctttccctcccttagctaggatgtccctgataaaggatgacacccaagcctcagcacaactggccaaacttgaggtggtcatcatagcactgatgctgggccaacaattagccccacttgtacctttttacaaactttttgacaattgccaagaattgtccaccttccctccccattgaattaaataaacttcttgtctcatggatactcagaatacc

SEQ ID NO: 150918 - DNA, 575 bp, Homo sapiens
aatcatacacacaccccccacgaagaaaggggggctccggatctcaatcatagcattccttcctctctgaagggaccaggtaacacacggagtgccttggcagcctcatcattgcatgcaatcttcacagacaatatctcactgcagccacctttctacaggagtacaggaagcactggcctccttcatccttaggctataatgctgacactggcctccttcatcctcagactgtggtgctggatgtcacccctctgcgaggcccttgggatcgactgagagaccagcagtgaagttcgtccaccttctgaatggatgccatgatcggacgtgatggagctcagtgggatgctgctgctttccctcccttagctaggatgtccctgataaaggatgacacccaagcctcagcacaactggccaaacttgaggtggtcatcatagcactgatgctgggccaacaattagccccacttgtacctttttacaaactttttgacaattgccaagaattgtccaccttccctccccattgaattaaataaacttcttgtctcatggatactcagaatacc

SEQ ID NO: 150919 - DNA, 448 bp, Homo sapiens
aaaaaagaaaaatgagccaggaaatgttcccatctcttctgttttctggaagacattatgtagagttgtttttttgtttgtttgttttgttttttagatatttaatagaatttgtcaataaaaccgtttggtcctgcaaatttcctttcttggtaggttttgaactataaatttaagttacaaatagttataggactattcaggatatctatttcatcttggatgagttagataactttttctttcaaggattagttcatagtaagttgtcaaatttgtgtgtgtagagttattcctagtattctattatctccatgtctgtgaagcctgtagcagcatttattatttctttcctgatattgaacattttcatcttccatctttttctttgtcaaattctttagaagtttgtcaatattattgatcttttcagagaaccagcttttgg

SEQ ID NO: 150920 - DNA, 341 bp, Homo sapiens
gtctagaggatccgtaaaacgacatagaggcaggtcaggtcacggtcttgtgtctaaggtgttgtctgagctgtggtctcatgaccaagaaaattaaggaacgtggccacaaaggccgaggttggagcaaaagtttaataaaagaaagctctccacagcagagagaggattccaggtggattaccgttttaacagttgaatccaaaagcttcttttttttttttttttgggagaacagtgtctcgctcggtcgcccaggggggagtgcaggggggtgactctcagctcagggcaacctcggcctcccgagggggaacggagcctcgaaatcgaaactcagg

SEQ ID NO: 150921 - DNA, 190 bp, Homo sapiens
atttttatctagatgctggtaactctgaaatttacctcttaaacttctctcctgaactccattttttctctccaactcttccctggatagttctgctggaacttaaacactccaaactgtcatcatctgtaccccatcctactgcaaacttatgttctttatccattaagctagttggacatccctataa

SEQ ID NO: 150922 - DNA, 579 bp, Homo sapiens
tttcccattcttgacacatgagaacaattattttatattggggacagaggcagaattgttttgtgagaattcctgggactatgttaggtaaacctatatttgaatctgttgcttcctcactattgcctggtaggagacttgctcacttcccaaatgggagtgacagcacagtggctgctacctgaccacccaccatgtgcaggctccattcccacactgccctgcaccctcacgtcagtcccactgtagacctgggaggtgggtgctgtcattgtccccatcttacagagggagagcttggggacacagagagggtgagatgcacgattagagccatctgactctaaagcctggcttctctccctgactccatacagccccttcaatacaatagcttactcccaggtctgtagggagtttcagacgattacccacagttaagtggataggaatgcttagcacagggccaagctccaccggccagcttccttccggtcccaccttcctttccactagaccctgatttcttcaggagaaaggactataatttcacttttattccccgcactaggacagtcc

SEQ ID NO: 150923 - DNA, 144 bp, Homo sapiens
ggtgcgtgtccacaacacgaagtgacttgtgcagctctcagcggaggactggcattaatgcattgctagcaaaaggtgggggagaaaggaagcatctcctgcgctcccaggcaggctctgattaccatcatgttttctgagccc

SEQ ID NO: 150924 - DNA, 285 bp, Homo sapiens
catcatcatcaccatagtttacattagagttcgttcttggtgttgaacgtacattctgtgagttctgacaaatgtataaggacatgtatctaccatactgccatacagaatgatttcactgctgtaaaaattatctgtgctctgcctgtttattcttcccttcccactgtgtataacatttgtacttaccaagtttgaactttactacagatgatttggaatattagttatttgaagaaatagaattaaaagagataaaataggactacatctaatgacacaaag

SEQ ID NO: 150925 - DNA, 370 bp, Homo sapiens
ggggcaaggagtcctgctcccctgccaaattactgcttttgactgccatggaattgaatttgatcaggaacctcttctactcagagaagtaaataccaaataaggatgttttaaatgttagttttgcagtttctgatcaactacattcccctgtcctgacaggcctgggagcctgggtgtggtgtgagaacgtgaacttgcagggttactaatcagaactgcgtctcctgcggggctgagaagcctgggcctgggctcatggaaacaagccaaaaattgagatcatcagggttaggattttgcggggagcacaatggaagggcaatgaatcatggagtttggagactttggcccgagagtggctgaaatg

SEQ ID NO: 150926 - DNA, 457 bp, Homo sapiens
ctcagaactcccaaaatcactaagccaaagggaagtcaaactgggaactgtgtgaggcaaacctgcctcccattttattcctacgtaagctagctacaaagataaaaaagctacatacctccctcacaatttgcccactaggaaattccttgtggacaaaggacagacagaattcagtcattcttttgctcatgtgagaccaatgcatatctgattgcttcttctgccctattatttcactaagccagactaaggaataagtgactattcctctaccctcctctcacatgtaaattgtgtattcagtaaaaggctaaccagagacaaaaaaatgcaacagtttgtcttgtatctacctatgatctggaagcccccacccctgcttctagttgtcccagctctccagactgaaccaatgtacatcttacatatactgattgatgtctcatgtttccct

SEQ ID NO: 150927 - DNA, 403 bp, Homo sapiens
aacttcatgtagcatacacaaacatctccttgattcttgcaaattagactgagaaaatcgtggaaattgctaagcaacgtttggtgtagtgcaaactctagggatttgctggctggcaacattcccttcatcctgtaatgaacatattttgttcagtagtagccatatgagtatgactaaagcaaagagacccattcagagatatttgcattttcttaacacagaaagaaaactttagtgcaaaattatcagatagtatgataaaacatagtgaaacattttggggagggtggaaaagatgtttctagcccactaaatcatacctcatatgcaaaactttctgcttttcaagagagacctacatttgtctccagagaagaggactgggaaataaatctccatt

SEQ ID NO: 150928 - DNA, 353 bp, Homo sapiens
cttccatgtgttatataattcaatcttctattaatattaggcattaatatctaatactttagacattaagtaggatataggttaagtctgtgacaaaaatatatcaaaatacagtctattagacaaagtgtgagattctttctttctaaaataatgatccacattacagcccagcaaacaaatccagagcgtgtttgctggttcaactctcctcaacatgtgacttccatccttgggttcgacaaggccactttagccaatgggtagaggaaaaagccagagacacacaacccagaagggccagaaaacctttctgttcacatcctattggccagaatttagttacatgatta

SEQ ID NO: 150929 - DNA, 285 bp, Homo sapiens
aactttaagtattttaatgtccaggccttaccacttaacacttccataaaacagttcctgtggatgggacccaggtatcaatattgagtaaagccctcctggtgattctaggatacagccgagaatgagaattactgggctgcagaagatgagccttatcaccagatgtctcttagtataacattaatttaacaagagaccaggaattgacagaatttaaaggctaagcatggaccatttactattaaaactattatctagtcatggtggcttcaaggatagttt

SEQ ID NO: 150930 - DNA, 338 bp, Homo sapiens
ttgttgtatgattggttcggggcagggtggaggatatcacaaatggtagtgccttgatggaaactcagatggctcagatcctagcctgatgctttttccaccacatcatgctgccacctttcttagaggcttatttggaagcaggataaggaagatacgacgttttgtcaatccactttaagtgcatcctctgccaatccaccttgctcttctctcagtagtgcgggcttgaaaggtcaagaatccacttctgtgatatcacatactctcagtccagctgaggctaaatattcctgctttacactcccaccgttgccttctaatttaaattcttgcct

SEQ ID NO: 150931 - DNA, 124 bp, Homo sapiens
tcagatttgggatttggaaggtcctggtattccaggccccagacaggatttgggcgtgggttgtgttgtttccctgggacatcctattaatatgcaaccaatgcaacccgctgctcatcgatga

SEQ ID NO: 150932 - DNA, 673 bp, Homo sapiens
ggagttccagactagcctggccaacatggtgaaactccatctctactaaaaatacaaaaattagctgggtgtggtggcaggcgcctgtaatcccagctactcagaaggctgaggcaggagaatcacttgaacccaagaggcggaggttgccgtgagccaagattgcaccactgcactccagcctgagcaacagagcaagactctgtctcaaaaataaaacaaaataaaataaaatgagagagacaaaaataagagaaaaaaaaggaaaaagttatcacctcagagcacagaggaatagaaaacattggggaaactgtgatttaggaaacagccatctccatgtgggccttccgaatagctttccgtatttgacagttccccaaagtaatcattcctttgctgagtccttaatagggcagctgcccactcaccggccgtgtgccctggcatgggactgaatcagcctgcaggaagttaggaatcatatccttctgcaatttgctaaaaagaaaaaaaatgctatttgtagagcagaggttctgcctcagcacttggttcagttctgctccttcctgagaggtttcttacacatagacccccccgcaaagattattactttccttcacttttgtacttcttactataatagctaagataaattttatacaacgtg

SEQ ID NO: 150933 - DNA, 414 bp, Homo sapiens
ttcgcatgtgctgggatcggggaagctgggtggctgggaacacagatgcagcaggagaagggaaacatgttggggctagaaagggaagggcttaggaggctagactttaactggtgggcagcagggagccaagcgaggcactcatttgctaggtggctcagggcatgacacttttcactggagcccgagtttcccccaaggcaaaatgaataagctgggggtggaaaaggccctaagttgatagaattttactttccctgtttatgcggctgccacagagtgcacagcagctcctgaaagacgtggctcagcaccgccgctagcagcttgggcaagagttagctgcagcccagggctggtctgggcctctcttggggggcagggacagcggagggctacaagaaggccagccct

SEQ ID NO: 150934 - DNA, 369 bp, Homo sapiens
ccccacaaataagggctcatacaccaaaagtcacctactagctcgtatctttactttcactcataaactagagttccccaagtcactgaagggaagccttccacagatctggtttattttcttcactaaaagtaattgagcctggtgcatgtatgcctttgccattagggtactatgcaagagaagagaatttgccttctgtgcagagatgttgtaaacggatggaggtctccctcctcttctcccaaggggtcttaaacatgcctggaggtttagagtaacaggctgaaactctgcagggcattccttctctccacatcctcagagacctcatggggagaacttgctggcgccaggcctggatcctcc

SEQ ID NO: 150935 - DNA, 437 bp, Homo sapiens
agtgctactgaccagctatgtgaccttgggcacacaatttaacttctctatgactcagtttacctataggcaaaaggtcagcacctaccccttagaggagttgaaaaggacaaatgaaacagagtatataaagcatttgttgggctgggcatggtagctcatgcctgtaatctcaacactttgggaggccaaggcaggaagatcgcttgaggacaggagttcaacaccagcctgagcaagagagtgagatccctgcccatcccccctgtattagtccattttcacactgctatcaagaactacctgaggctgggtaatttataaagaaaagaggtttaactcactcacagttccacatgggctggggaggcctcaggaaacttacaatcgtggcagaagaggaagaggggcaaggcacatcttatacggcagcagga

SEQ ID NO: 150936 - DNA, 337 bp, Homo sapiens
caaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacgctcctggtttcttacttttctccaaggactcctagaaggaccccacccccctccccccacccctgctcctaggaggacaacgtgatcactgtattcagct

SEQ ID NO: 150937 - DNA, 260 bp, Homo sapiens
caaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacaggacctccaggttccgccccagg

SEQ ID NO: 150938 - DNA, 460 bp, Homo sapiens
acaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccag

SEQ ID NO: 150939 - DNA, 324 bp, Homo sapiens
ctgtaaacccaggagagcgatgtcccctctgaaggcagaggatggtgcatgcaaacacttgacaagtcattggaattcagtaaatggtgactgctgtcaccaaggaaatgggcatatgagttggcattaattttttaaaaaacatttacttatttccactgaaaaataggaacagtaaaattgagaaccattaaaacaggaacaaaaagaaccaagccacagcaggggatgctgagctgggtatctcctaagaactgtgctcctggtcccacctggaactctgcggcctggatgccctcagcacgtgctttccaggccaccagc

SEQ ID NO: 150940 - DNA, 382 bp, Homo sapiens
gcagcaaagccttttgaggtttggcatccatctgcctcatcgcagcccctctcacaaggccccctttctgtgaccagccccagccgcagggttgccggtcttttctctaataaagaggttgggatctcctcaccctggtgcacatctgtccttctgtgcttattttcccattttcccctttcaagttctgtagttttattgtgttgacagttgctggaaccactgatttgggatgcgagaacaattcccccaggctcctggcttcttcccaggctgcgtggcatcctgcaggacagctctgagaaccttctgtcctccacacagccctgcccagacacctgggatctactcttctgtcttcccacagtgcctgctgcatgca

SEQ ID NO: 150941 - DNA, 456 bp, Homo sapiens
gcacgtaaagatccttctgctgatcttagtaagaaaggaagctttctaagtggattttgtatctcgaaacccaccttgaaatctttaaaggacactgataaggccctgacaaaatggttaaccatgtccatcaacctatatcataacattatccctttgagtcctaatttttttaaatctcctcaaagatccattactaaaatgcatccattgcctttgtgttagagaatgagcagcagaagaaaatggtatggtccaggataggattcaaggaccatttaggggtagcaggtagaaagagtgtcagtgacaactggggataagataggtcccccagatgagaataggcaatgagctgattctagagagtaagacaaatctcaatggattggctagatcttaaggtcaaagtcagagttaagaagatcatagagtttaagatcacagaactggtga

SEQ ID NO: 150942 - DNA, 588 bp, Homo sapiens
cctgcattgttgctcttcctctaggccctattttagctaatggcaccaccagtcacccaaacagactagagaaaatacttgtgatgtgtatcataaacaaaacattgatactcaaaaaagtgaacttcttatagagatcagtaagaaagttcactttaaaaatgggtaagggcaattcagaggaaagtgtccacaaaaaggaaaaagttcaacttcacaagtaatcaagccatagtacctttatttatgagtctataactggaaatacacaaaagtctatcaacacatgaatggataaacaaattgtatcatatttacacaatagaatattacttagtactaaaaagaacaaattacttacagcaaccacatagttgagtatcaacatttgtatctaaaagaaggctctggttcatttactccaccctgtttatcccacaaaatcctgctattaaactgagagaatacatggactagctatttgaaggctcttacataaaaacagcgacgtgcagattggagaagaccagaattcaaagcaccaccaaactggtggcgtgtttcctgcttttcctgcagtatcgcctg

SEQ ID NO: 150943 - DNA, 514 bp, Homo sapiens
caagttttctgtcactcttccctctttgggctggaatgaggaaaaaaatcagctttgactcagcacgatttgaacacgaatgtcttttaaatgaatatggggggttagtaatagcatgttaccgaacatgtcctttgcttgttcgagacaggtcacccctgcattgttatcattgctgcaagtagaagcaggtttctggtggtttgtcactttcaagagcagggaaggtgtctaaatataagcgaagccttgttttgatagaatgttttattacctgaaaatgatcagcatatattaacattaatagaatagtccatgtcattctttttttaggcaatttacctctgctacagacctgtctgcttaaaaaaaaatcttcctctcttctaaaacatatatttgtttagagagttttcactgaagtgtacatgacaattacagctgttcattaacaaaattgggtatttgttttaaactttaaccaatcactttgatatgctaattatggtgtaat

SEQ ID NO: 150944 - DNA, 289 bp, Homo sapiens
ctttctacccactatcacatttccccacaggcatcaaagactttgggttggcactgatttcagtttctctctttccaagctattctgtgtgtctcatatataaatgtacatcccaatgaatgctcacaaagtgatcacacccagatgaagaaatatattatcagtaccccagaaccccctcctatgcctcctaaaattgctcactactcctactctacaaaaataaccttcatcctaacttaaattacagatgggttttgcctgttttgtatttgtataaaagtagtaa

SEQ ID NO: 150945 - DNA, 291 bp, Homo sapiens
taaggtaatgaggctggagatacagtctgctatcatattgtcaagggcatttaaatgccagacaggcatttagattttttagggtgtctctaatgtctgaggatacaccatggagggaaactgccaagtttttctggaaaatattctttggttcttgggtaaaccctaggatcaagtcaagtagcagattaatttcattttacagggcattgaaagagaaatcaagccacaaattgaaacaatgttgaaagaaggcaactagaataagagtctacctagtaagttagtaca

SEQ ID NO: 150946 - DNA, 341 bp, Homo sapiens
catagtaaatggaatggacaaagaatatgagtgacagataaaatcagtttttaaaaaattttattaaagttgattaagcctattagtgaaagaaagcaggccaggcacaatggcttgctcctgtaatgccaatactctgggaggtcaaggcaggaagatcacttgagcccaggagtttgagataagcctgggtaacacagtgagactccatctctaaaaaaattaaaaagtaaaaaaaaattagctggtcatggtgacacacacctgtggtcccagctacttgggaggctgaggcaagaggattacataagcccaggaagatgaagctgcactgacccatg

SEQ ID NO: 150947 - DNA, 336 bp, Homo sapiens
gggaaaaccactcactaatgagttgaatgttcaagagaaactgagaaagagtactgcttatataaaaattatgtgaaattaaacaaaaatgtagttcagtaatgaatggtgtttaagcacttatggaatataaaattatcacctgttaaataagaatgcatagtaaatggaatggacaaagaatatgagtgacagataaaatcagtttttaaaaaattttaaagatcttaatctaaattttattaaagttgattaagcctattagtgaaagaaagcaggccaggcacaatggcttgctcctgtaatgccaatactctgggaggtcaaggcaggaag

SEQ ID NO: 150948 - DNA, 595 bp, Homo sapiens
ttggcttaaatacttccatcaaaaacaaaacaaaacaaacccccaccccacaaaacacagagcacaaactgctcagtttttcatcatgctattaagcatcaacagagaataaacctagaaacagcatacgggtacagatacaggaggctccactgtattttagttcaaattacagaatctaattaaagactaacttaggaaagatacaggtattctagggaggatcagaatgcttcaacactgatacccaacagaaaggcaatttttaattagcttaagacactgaaaagttttccctccccttattctgcctcttagtcttcccaacagggatgctcttgttatagtttccctttttcccaattacatccacaagcactgacatatctttcccctctgctcacctaggatcagtttatctcaactccacccctctaaccgtcctcaaatttctttccccctcccctattttttattcatggcacctgtaatccctgctgccccatgtggatcatcaacataaaggttttacaaaagggattggggtttagcagagttgtgctaaggaagagtgtcaaagcatcagatgtcttgg

SEQ ID NO: 150949 - DNA, 385 bp, Homo sapiens
aaccatctgaagcaactgactgaaaagcaacacaccagacaggccttctttaaaatccccaggtagcctatttgaagtaatatttccactttgagatggtaagaaactgaaactatgcatgtaattagcatgattttagttgaaactcactggttttcagatttgcttagttggagttgcctttttcattcatggaaccaaagttccttccaatcatagcaaggtaagtaactgggaggcctgactgaggagcttttacccagccatcacttgcctaacgagattctcatcagccgcctcctggagacactcacagaatgcactccacaccctggtctgggcttcttaacattttactcttcagagtagtgtcatccagtgagtg

SEQ ID NO: 150950 - DNA, 487 bp, Homo sapiens
agagctgtagaaataaggaattgatacgtttctgttgtgtaattcaacaaaagtatttaccaaacatgcatactcttggtctcagaaattccatttctgagaattttccctaaggaaaccatcaagaacattcactgcagcattatttataatgctggaaaattaggcaataacttcaataccaaataataatgtactgaataaatactgaaccacacaactgtgtccccaagtgccttagaggttccaagccggagccacggaagcctactgctgcttctactacaatagatctgttcttatctattttacaaactgagattccactttagttacactgatgtataatcgtgaaataatttgaaaatcattgcaacagaatatgtaataacatgcaaagatgttcaagatatttttagtgaaaaccagcaatgacaatatgatttcatacaaggaagaatggcaatgaacatgtatcaaattgcta

SEQ ID NO: 150951 - DNA, 364 bp, Homo sapiens
gcatcagaggataaaacaggacattatttttgcactgttttgaattacagaggccatggtacttgttagaaacggagggaggggcagcccaaagcatatttatgaagcacttaacatttactcagtgagatccatcccatggtctggaaactctgggaactaatgtatccaaaaaagagacaattttagctttcaaaaggctagttaatttactaaattcagtctgtgaccaatttctcttgagaagagtccagtgcagtgggccaaatctcgtgggcaataccgggagagcatgagattgtgaattcaactgagaaagttgtgtttggaaatggctcatatcaaacctggaaatgaaaagctt

SEQ ID NO: 150952 - DNA, 305 bp, Homo sapiens
atctccttctttagaagccttcctggtcgcctgcctgtccctgctcccacccatgccgtcttcctccctttatcagtgattgacatcacagactttagtagccttgtaacaaccttgactcatacactggactggtcttgactccataactagacttgtacctcatcatgggcaggaacttttaaagtttcatctttccatgcccttgggcacagagcagaaatgtagtagacactcagaaggtttgtttgaagggtaatatcagcacattggttaatagtgaaattaatgaatgagtggatgaa

SEQ ID NO: 150953 - DNA, 581 bp, Homo sapiens
agtcaagtcagtgatgatttggattgaaattaaaatgtgactaaagagagagtatgcagttttgtctatctatgaaaccttcctctgttttatgtgggacacctgggcacccactcttggctggaacttacataaaacactactgtgcacgcacatgtcacctcaagtcccgtggctctgaaagtccagtagaagtgacagccagacatcccagtcctccctgtagggttttctcagaactgttcctttaaggtctcaggctgctggaagggagggctgatagcagaaaaagtggggacactgggaactccaaagggaagacgcgcatggcctgaaaccgagttctttcgctttctggagcctggtctccctatgtggagggtcatgctggcatggctggcaatggttaattcaccgatggccatggagtcccaagttggccatattattgcggtaaaagatacattaacccagatgaccttgccgggggccagaatagagcccgtgaggaaggagagcaaggcaggatcggccgggaggcgagagggattttgttgaggagcaaggtcttccacaggaac

SEQ ID NO: 150954 - DNA, 729 bp, Homo sapiens
cattttctgtcgagttccccaaaagcacatgggactttacagtgacgctttttagagtatctggctctagagttagtcgtcttgctgagagaaagtgatggagctggcattgcattccaaagccagtgtgcattcaccagctcaggctgcaggcccatctccctgcatggagaactgttttgtagattggtagcgattggacagccatgccctgtcacctgctggttcagtgctcctccaggaaggcctcaactgcctactgcctttgaccatgatttgtacagcagcttggatgaagagctggaaacctgcttatcagatttgcagacgatgcatggttagagcaatggggaccatctgggagtgagccaggatttaggactcttgagaagctgaacaatggacggaaactgatgtgatgaagtggaacgggaagatgtgcacacaccctctacctgtactcagaaatcacttgctcaaatgtggtgtgggaggctgggcccactgtgcagggatggtgctgtctgcagaggcatccttaacatgcctttagcatttgcatttccattttccatggacatctgtcttagtctgtttgcattactgtaaaggaatacttgaggctgggtcatttataaagaaaagggtttatttggttcacggttctgcaggaggtacaggaagcatggtgccagcatctacttctggtgaggacctcaagctgctttc

SEQ ID NO: 150955 - DNA, 332 bp, Homo sapiens
actcatgtgctctctctttaggtaaataatgtaaattccatgaaaataaatgaatggatcccaaaggatctttagattaacaggaaacagctaacacttttgaatttggttattcaagaggaccattcatgtgagcattttaagattctgaagactagggatatgattctttctaaaaccatgtttaattgtttttgcatttagtttaacatttagcagtcattgatatcttcaatgacaaacatttgaaaagtcaccactccaaagactgagaagaaaactgaagagattctgactgggttcttggctcacgcctgtaatcccagcacttt

SEQ ID NO: 150956 - DNA, 426 bp, Homo sapiens
caggcattggggtgcaggctgtctacacagcagaagaatatgggagtccgtgataagcaatgatgcagggaatgtaaatctttttgttcctctataacagggaaataggtgctcagttaacaaaacagtatttttctcaatttctcgattctgaaaattgctagacatatcatgctttacaaccctacacccacacactatagacatatgccacgagtagatgctttgctgacttgaaggtttcagcagtgattcttcttgcatgcactttgttttgagctaatagaacactcacaagataagaaaaagaaatgcttggacatgcaccatccctttctccaaagattgttaggcactggtaattgaagtttgagaacatattatttaaatgactacaaagctaatgtaaaggtaacagagccatgc

SEQ ID NO: 150957 - DNA, 527 bp, Homo sapiens
actgaatcctcagttcttctaggttcctccatccaattttctcccacttttctgacttggaatcactctgaacaagaactgctctgctcctgaaaccctgcaagatggagatgtatacctgatacaagttcagaggacaaccctcatgcctgatgtgtggaccactcagggagttcaccaaaatgcccactgccataactaggggcattcaaactgcaaaccaggaaaatatgcttagagctcaaatctagaaatcttcctgactaatcaccctctggactcagagaccgaatttatgatttgttcttatcattaagctttgtttttcttttgcttccatagaaatattagttagtttggttcgtggggactttaactaagaagctaagtctctcagtattatcctcctggtagtcatcattataatcttcctggtgcactatattctctcaagggtcttaaatgtatattcaaaaacatcaacagcataccagattgtctcactgtgattagaaaaaaaatgagat

SEQ ID NO: 150958 - DNA, 327 bp, Homo sapiens
ctcccttttgcaaacaaaacgagaataccagtatttcctttgccatgcttgtgcgtcattatacaccacaattcttgaaaagaaacatcatcggctcttctctattatgcgctaagatggcaaaggacaagtaacccgaacaaaatccttgatattttattctaagacttgttacttacctattcgtgcccctccaaaaaaaaaaaacaaaaacaaaaccacagcaactctacttttcaaattgaaattgatgagcaggaaaactatcactgattttttttaacataacaatgaaattctcagaatgagcaatgtggttatgaataa

SEQ ID NO: 150959 - DNA, 284 bp, Homo sapiens
ccagatcataggcatgtgctctgagaccctggtgcaggcaccatggaggctgtggtgggggcctggtgtcacagggaggagagagggtttggaggcacataggccagggctggcattgcagagccacatcatctcatcatgtgaacctgaggttggggtctctgagtctcatctgggaaaaggtacaataagagaaaaagtttaagcagcctgacataatcttcctgatagtcctggtgggagtgtaaattagtgtcaccttgtgggagggtaatctggcaatg

SEQ ID NO: 150960 - DNA, 500 bp, Homo sapiens
tggtcatccatatcttctgcatttgaaacctagaacaggtgtgctaaaaagacaggtatagtgtccaggtttcaatggactgggaaaggaagcctttggcaaggcccctggttagatcaagaacagcacaaaatcacagagaaagagagaggtagagagagagagagagagagagagagtgtgtgtgtgtctgtgtgtgtctgtgaagagacaggggttaacaaaggcaaagggacagatataccaaaaaggggctgagagaaaactgctcaagaaagaggttggggtctctgaggaccgaatcaatatcccatttgctacactatctgtataccacctatgccaccatttcaatacacatctggcaatagactgtttgttaatattatcagacattagtaacttttcaagcttcccaaattatctaattggattagcctataaactaaacaaaattggctcaagatgtaattgtttcgaaaggactgagatgactgaat

SEQ ID NO: 150961 - DNA, 263 bp, Homo sapiens
tgcatttgtgagcagacttggaacccttcccattgtcatgttttttatctttgctatgtgtaaatgtttaccttatgtatgtgcaataactcttttagcctgttcagttatcattgagtgagacctttctctgtggcagcaggtgggactgaaatatcactgaatttcctaactgtgactgttttacttctttttaaccaagagaatctaagaacttaggcaattttgtccacaatttctgttctctcattaaatatcattaa

SEQ ID NO: 150962 - DNA, 443 bp, Homo sapiens
gacctcactgcttcataaacagaactgttgggtatttgttttggcctgggttgccctgaaacaatgactgagatattaacagggctgtgatccaaaagagttggggaaacttggctttaactttgcagaaatctgtaagtcctcttagagtgtcccgtccatgctaaaaatatttccaaccacccagaccaaagaggtgggaggagatacttcaaaatacaaggtgctttagaagtcggtgccagaggagaaagcagcccagccttccaggccaagctggctgcccgtctggccacccctcctctctgaacttccgtgttcctcatccgtaaaatgagggggctggactgcgatgaggatattcatgagaactaagatctaatgcccacttatcatttcccaggcaccggtaaagccctttctaagcattagttattcagatc

SEQ ID NO: 150963 - DNA, 184 bp, Homo sapiens
aggctggtctcgaactcctggcctcaagtgatctgcccaccttggccacccaaagcgatgggattacaggcatgagtcaccatgcccagccagtctctatattattttaactagtgatttaaaactttaaagtaataacacactgatggcaaaaacaaaacaaaatcaaacaaacaaaaaaccc

SEQ ID NO: 150964 - DNA, 304 bp, Homo sapiens
agcaacatgaaatttcaggcaacatacgcttaaatatcaaattagtaatttaaacaataagtaagatctgaggaaagattacatccaagttttttgaagctacttccagcccatgtatttagtgaactatagtttttacaacaagaagttaatcagattcttgaaattattgtaatttttttttaaagcagtagcagaggggtgacagtttctcactattcaggccttccagctagagaagagggacaaggaataactgagtaggaaattagattaaatgatcacttccttaaagtctacagtt

SEQ ID NO: 150965 - DNA, 650 bp, Homo sapiens
gactctgaggatccccgctcaccgactgggtggggggtgtggacaggtctgtgattcccagacccatcctcagatgcctcctggagcctctttgtgggagagtgcatgtgtcatggcgagtatgtggctctgcgattggaggaaatgtcaccggaccagtcaataggtcttcctctttacaattagcttttgtcaatgtacgttttttctttagtccacacaaccttttaaaatttatttatgatcgtagccctggcctttatccatcgaatcctaaagtgatctggctgctcatgaccaggggtgacagccaggatgcttttcttggaccaagaaacctggcttaaatgacagccttgagccttgctttggagcagtcagactctctggggatactgttactattagtgagcattatttgctgcagaaattgattccttctgccgtacagtaggccagggaggcctccaggtgccttcggtgggggaaggattttagttgctcaggccaaataaccgagactagctccctgcaaattccatggagccatctatacttctgagtatatcttcaagtgctactcctaaatttaaggttcttccacttttcatccagttcacatgtagttgagggcctgcctgccttgagcc

SEQ ID NO: 150966 - DNA, 972 bp, Homo sapiens
ggggggtggggggacttggattgttaagaaagtgatcatcctgttcttggatagggtgattttggctgtctgggtaagttctaggaatttgctgtattctcttgattctaatgaactttgctatggcttgggaaggggcctctgcatggagagagagaaggaagctagcgtttcttgagggtctggtatatgctaggcactgtgctggctgctgaattggactgtttgatttaatccttgtcacaacccctttgaagtggtcttgttaccctcttttacaaatggggacattgtggctccagcaggttaagaagcttgctccaggttacatggctatcagtgggaagctgggtggggggtgtggacaggtctgtgattcccagacccatcctcagatgcctcctggagcctctttgtgggagagtgcatgtgtcatggcgagtatgtggctctgcgattggaggaaatgtcaccggaccagtcaataggtcttcctctttacaattagcttttgtcaatgtacgttttttctttagtccacacaaccttttaaaatttatttatgatcgtagccctggcctttatccatcgaatcctaaagtgatctggctgctcatgaccaggggtgacagccaggatgcttttcttggaccaagaaacctggcttaaatgacagccttgagccttgctttggagcagtcagactctctggggatactgttactattagtgagcattatttgctgcagaaattgattccttctgccgtacagtaggccagggaggcctccaggtgccttcggtgggggaaggattttagttgctcaggccaaataaccgagactagctccctgcaaattccatggagccatctatacttctgagtatatcttcaagtgctactcctaaatttaaggttcttccacttttcatccagttcacatgtagttgagggcctgcctgccttgagcc

SEQ ID NO: 150967 - DNA, 244 bp, Homo sapiens
cttttctccaaaactgcaaacactcatactttcttgcttgaagtcatttggtttctataaactcctggaaatatttctttcaggctgttttgaaaattgctattacagtttggggaggaatagacttttcctttttcaaacacatgcttcattgcccaattctggattggattaatgtcgattcaatagctgtttattgcatgtctgtcacgtattatgcctcaagttttgggtccagcccctg

SEQ ID NO: 150968 - DNA, 203 bp, Homo sapiens
gaggagaggaagctcagatggcggcaaactgaagggaagccgactctgagtcaggcctaggtgcacggcctgccatgctgcgtgctgtggggagctgagagcgcatgggcacctaagcacccagattaggctgcggctacagaagatctgactgtctggcctggcctgcagagggactgtggcctcagaggaggatgctggcc

SEQ ID NO: 150969 - DNA, 135 bp, Homo sapiens
acttttttgcttggccttggcctgcttaggatacttcccctcccctctaggctcctcccaaacctgcggctcaactcccacttgcttctgcatctttcttagctccgcccttgagctactcgacttccacacttg

SEQ ID NO: 150970 - DNA, 310 bp, Homo sapiens
tctttcatcctcccatcttccatcctttcctcccccgtcctgtgtttcctcccctcttctcccattcaccgtcaggaagggccacccgcgaagggccagttcagcacaactcggcgccggcagaggctagcggcagcagtggctacaacagtgagtggatttcaatctcaagtggaagtttaataagaatgagaacctgtgtacaaggatgactcccctgtcctgatggtgccactggtgtgtgatggcatcacctgtagcccaatcatggcagcatagctttcacatgttctctggctgtctttgcatg

SEQ ID NO: 150971 - DNA, 291 bp, Homo sapiens
tcttaacagaaaagcctctcaaatttggggaagctgccaagcttacagtaggaaatacacattttccaaaaatcacgtttttatttgaaagcttagattttatcagtggcaacaaatactgtcagttgttttccttgaagtgacagctcactcaccttgttcaatttcaagaaaatgtctcccaaatgcccaagtctgagtaaccttagtttgtcagtcattctttcaagtaaaaatggtgttctctgaaaacagttacttgtgcagcttgccgctgaatcccacaaatgc

SEQ ID NO: 150972 - DNA, 385 bp, Homo sapiens
gggagggatgaaagggactcttcccagcaccaggcagctgtgcaaaccagacccagtactgccagagccaagattttcatgagaagtcagaaatccagacttgcaatgggaaatctgattttaaatgatggccactaattcttttactgaaatatcagtctgtgtttctcactggcctgcgagcagtgagcttgcaacctctggattaggttacaaaatgttgtgggctttggaaaatgcggggccgaatggggtggtcacagagatccacacagcactgcaggggaaagcgcctgctcattctccccaagaagaaacggagtccgagtcaacaaaccacaggtgcctctacaactgtggggcttccgactcccaggggaatgtt

SEQ ID NO: 150973 - DNA, 301 bp, Homo sapiens
aagggaagtcggttgtatgctaagggaagtacgtgcgggctaagggaatttcttctggtgctagatggagaaagtgttttctgctaaaaggtaattttagaccattatatcattaaactcttatgaatgtaattcctggagacagtcttgaaatcttgagctgccaagcaaaaccttcagaaatgcttgataattaaaggaaagcaaaactctgattccttttgccatccatatacgatggcatttaaatgagtgtaccttgtcatattaaattatccttcttttctgttctttaatacca

SEQ ID NO: 150974 - DNA, 250 bp, Homo sapiens
gggcaacaagagtgaaactccttaactcaacagttatgtcatgataagtaataagacattacacacacacccctctaaatccacagatttcccctctgagaaaagcccttctgggaagctactcaacaggagggcccttaggggaaatgtgtgcagtgtgaagctgcaaagaaatgatcagatggcaatcagttgcctaagccacacataaaggtttcacttttggcttttgcagcaatttccccatcct

SEQ ID NO: 150975 - DNA, 252 bp, Homo sapiens
gtggccggtggggcacagctgattttttgggggaacccgttgacgtgaggtggtggattcgtggctgagagttggcagtggttttgcttggaggcacgtgtttgagaaccgtttactcgggtggaggaggtcaggagagagcatgatttttcataagagaaggaaggaggactgaggactcggctttggggagcagagttgggaacacacagaagagtctggggcatgcagagaggctggcaggaggcagag

SEQ ID NO: 150976 - DNA, 417 bp, Homo sapiens
cagctagagtttaccctcccacagaaaacacattcttggcattttgaaagagcatttcttttcttcctttgagaaattatttagcaaggctgtggaaagcagggctcccagtggccattcaaaaattaagaccaagccagaaggcaggaggaaatgtcaccacaatggggagaaaataaatcagttagattaagattaagatctaacccttttctgtggttggggcaggcggatttgagaataatagcatgctatttctggaaagtccctccagagtaaaagctgggagggtgggggtgtgaaactatatgtttcagtgttagattaaaatttgttgaagttgattgaaaacagatagaaatggccaacggtccccctgcccagcacaggtatgccagtcctctgtggctgaggtcc

SEQ ID NO: 150977 - DNA, 427 bp, Homo sapiens
tttacatgttatttatttatttagtgtcacccagcctggcacaaagctgattagtatatgtttcaacaaataagaactaaaagaaaacccatcacggtaccattatcattggtaacaaaattaacactaatccctaaatgccctctaatagccagtgcatagtcagttttttgaattgcctcaaaaatgtgcttttgcagttagtttgaaatgggacctaaacaagatccactttttgcatttggttataatgccttttgtgtgtgtgtgtgacagtagaatgtcttgctttctacatttggctgattgttgccttgtagtgtttcagttttcctctattctgcagattccctgtaaactggcaattatctctggaagcttgattagatttagattcaaatttgagggcaagtagacttcttgggca

SEQ ID NO: 150978 - DNA, 669 bp, Homo sapiens
taccattgagcctgcagggacatttcagtgtgcacacagcaagtcaggaaaacaatgcccagcacgtgggtccacaggtaggtgccctgagcagagggggagggctcttcaaaggaggcctcagaaacaatgacagagcctcaaaagaaaatgccactggggctggcttgcatgttccatcaacaagatacttagagctggattactgaaagtatgaatttgcgtttcataagaaaaaaaggatctagttctacctgaagatttcagatacgtgagcaaccagaatgtttcaatggtttcgaggatgtagatgatgcagggatgataatcattttacagggggaggaagaaagaaaatcaacacacagcaaattctcacttaaatgagaacacacagcaaattctcacttaaaaggccaaatagatttttgtgcgatgtctatacagtgtgcctcttatttaaaatgccttttccaatgccatggaaataagcaattatcagggatttgatctaaaaagaaactttaaggttatgtcatatacatttgtatcccagtttcctttacactttactggcttggtattgtatttttggtaaataattcaaggcaggaggatcccttgagctcaagagttccagtccaacctgggcaacagagcaagactcca

SEQ ID NO: 150979 - DNA, 282 bp, Homo sapiens
tatctgaggccattagaaattaatcctaaaacagtcactcccgaatctccacctgcagccccagcttgcagtttaagtgccgccttgcctccggatagttccatcttggcagctagaatgcaacgaatccaagcagaacttctgttttgtcttttttcctgccctcccaccttaatctgttccttacatactcctgagctctgaaaagatcaccctcactcctctagtcactccagctagaaacacagtcttagaagctactccctggctctttctccccgt

SEQ ID NO: 150980 - DNA, 330 bp, Homo sapiens
aaatggctcagtgcttcctcggagaggtggaaagtccctggggtcacaggcatggggatgaaacgtgacgagggatgccgctgggcctgtggatttattgcttgcgggccatttcattggcctactttttcaacatcggctagaaaggccttcaaagaaggctttgaaaaccagccggccatcttcacaataagctcagacggttaaaagccacgctctggatttcagcaagtggaaacctgacctaatatctcaggtcagggctcaaggggcaagttcatgggactttctattctgctgcctcaagggaaagagaaacagacccgagct

SEQ ID NO: 150981 - DNA, 438 bp, Homo sapiens
tgagccgccggccagcgagcaatacagcctgagctccacctcctgtcagatcagctgcagcattagattctcagaggagctcaaactctattgtgaaccgcgcaggagagggatctaacctccctagattgcgcgcttcttatgaggatctattgcctgatgaaaacatccactcccactccacctccgtgtcttccatgaaacgggtccctggtgccaaaaagattggggacggccattctaagagaccacttccctatttgtcagaaatgtgattgtgtttactccaatttaaaacagggtctttacatacgttcctaatacaagtgctgcttgctactactactcacagcgctctgtgcccaactcttaacttcctccctcaagtccctctggaaagaagagaggagatgccttccttctgacgatgggaccccc

SEQ ID NO: 150982 - DNA, 559 bp, Homo sapiens
taaaatcaactaggatgggttccttattgccttctttgttttttcctaatccttctccttctctccagcccattttcctcatcaaaacggctcccgttcctccagttaccggggctgctcttaagaactgatcctttttaatccaggttgggcaccagtattggccaactgttcttgtgtcaaaacctgtactcctgtacttcctgtgaactggccaggaatagagttcagctgagcccaggcatcaatcctttcctgagctctatttaacatgctcatgtcttcaaggtcaaatgcattctcactgagtcttttctgagcgagtgcccgttcactcattgctgtagagatgtccacaggctctgagggcaaatcgctgctgaaaacattatcatcatctttgttttcttcaccatttttctctacaggaactcattctccataaacactatctgcttcttttttccaatgttgagatccagatgatacagggaattcttttgttaaggttacctggctttttggtgaagctggttttgctgcagcaatattcagattg

SEQ ID NO: 150983 - DNA, 312 bp, Homo sapiens
ttacaacaggttggcacaagggagtttggggggtggtggaggccttctgtatcccgactgtgctggtgattatacacatccatgcatgtgaggagactcatactctgtacccccctgccaaaaatcaatgtgtcagtccaaactgctgcacatgctctacacagcccagcctatctcttgtgattcatccagttccttctcagcctcctcgcccgttctgtcaggtcccgaacacttgtggtcatttttattttctagcagggcacaatcacgctcagccttttgcccaagaacctctcctgcccacttttc

SEQ ID NO: 150984 - DNA, 536 bp, Homo sapiens
atagactcacttgaccccacatgtgctttcatgttacttgtatggtcagcaagacaaatgttctgtcttcccatcctctgctgtaggatttcattgattttacaattataatctctgttccaaaaatggcagagtcctttaggagctggataatcattccaggaactgttatggaaccaagtcttacctggtgcagatacatggggcacactcccatcttcaggttgtatcggaatcttagacactgattaaaatgtcaaagtgaagtcacagctagtagcctttgccattaatataaactgggtagataaatgtaagtgtatataccactgactaaaaaagcaaaattgacatgtgaaactcaaaaattctttcaggaaacactactctttagagcaaagttgttactcagcttaagaattcttaaagttaatttcatcgttttctgttattaagcaagtgataaagaatttcatagactacagtttatatcatctttcctttatctgataatggccaacaagacaaaattgaca

SEQ ID NO: 150985 - DNA, 488 bp, Homo sapiens
ctatcccagggcagcaggcaaagtcccaggcagcaaattcaagcatgtgggcacatcctccagcctctcatcctatcccaggatctttccagataaccgctccctgataccatggcagagttcctggggggagagtgcacagcactgcaaaaaggcagtgctcttgcaggagaaactacagcagcgaagaggaatgagagtaaatcagccccgtaacaatggtctcttcagatcatctatagccaagctataagacgacatctccagaggataggaaccatgtgtgcccagtcacttgtgtgcactgcacacccagcacaggtctgcacttggtagatcctccctctaataaatatctgttggaaaggaaaaaaggaagaaagaaaaaaaatgaatggcaaaactgaaaaattcatagtgccatttaactacacacttaaagatgttaagttttatatgtatatcttaccacaatttttttttttttt

SEQ ID NO: 150986 - DNA, 488 bp, Homo sapiens
gcctcctgggttcaagcgattctcctgcctcagcctcccgagtagctgggattataggcatgcaccaccacacctagctaattttgtatttttagtagagatggggtttttccatgttggacatttaaagacaaagttacagaactttatagctcaagtccctttactctttagagattgttggaggtggtgatggatccaggtccccaggttattataatgtattttaaagcctagagaaatgttactaatgattaaaacatttattgagcattttctgtttgcccggcactgttctaagagtgttatgtgtattaattatttcctttcttccttaagaactctatgagacaggtattagtaatatctttattttatagatgaggaaacaagtaccttatctgaaatcaggcaaccatgttttgattctagaactctctcttaactgtattatattttattaatgagactacataggctaaaatgcc

SEQ ID NO: 150987 - DNA, 594 bp, Homo sapiens
actcctgacctcaggtgatccgcctgcctcagcctcccaaagtgctgggattacaagcgtgatccactgcgcccggcttgcctttctttttagtggactaacccactctaggtctacaaggtaggaggaaaacaacagataaaacattttcatgaatgtcccatctttaggggagacatgaattcaggtgaaaagcatattattgatttaatttcacatgttttggacatttaaagacaaagttacagaactttatagctcaagtccctttactctttagagattgttggaggtggtgatggatccaggtccccaggttattataatgtattttaaagcctagagaaatgttactaatgattaaaacatttattgagcattttctgtttgcccggcactgttctaagagtgttatgtgtattaattatttcctttcttccttaagaactctatgagacaggtattagtaatatctttattttatagatgaggaaacaagtaccttatctgaaatcaggcaaccatgttttgattctagaactctctcttaactgtattatattttattaatgagactacataggctaaaatgcc

SEQ ID NO: 150988 - DNA, 448 bp, Homo sapiens
agtttcctaaaatatctatctactattgattctgtttctctggagaaccctgactgacatgctgatcaatcttagagttggtctccctgcttccgcctcttctttctatgtctacacagcaggtagagggatcctgtcaagacattcaatgacccctctggtaaaaattctctaatgacttcccatctcatgcagaataaaagccaaagtctacgaaactctagaagccccacagaatttctatgaccttcctccttccttccctgatttcatctcctactactttctccctcattccacattccagccagacattagccttctggctattttaacatgccacaaacattcctacctctggggcttgttgtacacttgctgttccctctacctgggattcttttcctccagataactgcacagcttgctccctcatttccttcaagtc

SEQ ID NO: 150989 - DNA, 419 bp, Homo sapiens
agggccccatgcacagatggtgtttatgtaaggaaatggacacttaaaaatttccgatgttcggccgggcacggtggctcatgcctgtaatcccagcactttgggaggccgagacgggcggatcacaaggtcaggagatcaacaccatcctggctaacacggtgaaaccctatctctactaaaaatactaaaaaatgcacagttcttcccatggcccacctccttacttctttcaagtctttacagaaatgtcactgtctcaaagagccttattttgaccaacatatttgaaactgcaaattacctgacatattctcaatctctcttaccctgacctacttcttcttcctagtgctgatcactacatgatgtacttagttgtgctcattgcctttctgttattgcttatcctttgtttt

SEQ ID NO: 150990 - DNA, 274 bp, Homo sapiens
gcacagggagtggttatttctccacacgttgtaaaattccacaatgcctagttatgttttttagtcaaatcattatgttcaaagtaagaaaatgtatatggagaaagaaaaaaaatcaacactttaagatatcagaaataaatgatggtgttgctgttcttctccttacccttaatattattacaagagctcatgcttactaagggatcatatccatgatccagactgaatgcattacatgtttttacctctttcaagtcttcaaacaaccctc

SEQ ID NO: 150991 - DNA, 355 bp, Homo sapiens
tggagaaggaggctgaggatgcagagtggagcaagcagcgaattcttccctgagaagtcaagaaaggcatcccagaaagaagcaaattaaatcttaagaattagtaggctgggcgcagtggctcacgcctgtaatcccagcactttgggaggccgaagcgggtggatcacgaggtcaggagatcaagaccatcctggctaacacagtgaaaccccgtctctactaaaaatacagaaaaattagccgggcatcgtggtgggcgcctgtagtcccagctactcaggaggctgaggcaggagagtggcgtgaacccgggaggcggagcttgcagtgagccgagatcgcaccactgcac

SEQ ID NO: 150992 - DNA, 299 bp, Homo sapiens
ctaatgtccagtggtcctcctggaagacttcctggtttcctctgagatgagactcctcccaaagactgggcgactcagccccttggttcccatggcaccctggctatggaataaacgctggcagtgtggggattactacccccatatagatcattcagtcatcttcttttctgtatgattaattctccagccccctccctactccatttaattttagcatatgtatgataaatcttcattgaataatgaacaactcatcagtgataaaccttttctgaggtattgttgtcctttgaaac

SEQ ID NO: 150993 - DNA, 294 bp, Homo sapiens
  misc_feature (32)..(32): n is a, c, g, or t
tttttgcgatccttttcccgtcattgatttgnaaggagtcggtgtttccggccgcatcgtgatttattattactcaactttgtctccccgaacatttggggatcagagtttttaagataatttggcgggtaggggcttgggaagtggggagtgctgattggtcaagttggagatggagtcatagagggtcgaagtgagtttttcttgctgttttctgttcctgggtgggatggcagaactggttgagccagatactggtctgggtggtgtcagctgatccatcaagtacggagt

SEQ ID NO: 150994 - DNA, 125 bp, Homo sapiens
tgagagcgtgctttggcaattacggatgtgacttggttttgtcccaacaaggacagcctattcctgcagcaaacatttgctctagcagtgagtgctccaaagaaaacacaaggtccacagcagag

SEQ ID NO: 150995 - DNA, 125 bp, Homo sapiens
ccctccgggctctctgctgttccctgcctaggagttgccacgctcatggctaagaaagcaccagcgaccacccacaagggtcgggggatcggttctgctcgtactacacgtacacccacctcctg

SEQ ID NO: 150996 - DNA, 288 bp, Homo sapiens
gatcgtgccactgcactccagcctgggtgacagagcgagactccatctcaaaaaaaaaaaaaagtgaaaacaataagctaattatcagctacagctgactcttctgctcttctgttggtccttactgtgcactaggtacagtggtggtgtttgctggagtgcagtggtggagtcatggctcactgcagcctccatctctggggctcatgagatcctcccatcttggctacccaagtacccgggtagctgggactacaggcacgcgccaccacacccggcaattatttt

SEQ ID NO: 150997 - DNA, 741 bp, Homo sapiens
ctgagatggaattttgctcttgttgcccaggctggagtgcaacggcacaatcttggctcaccgcaacctccacctcccgggttcaagcgattcctctacctcagcctcccaagtagctgggattgcccagctaattttgtatttttagtagagacggggtttctccatgttggtcagactggtctcgaactcctgtcctcaggtgatcagcccaccttggcctcccaaagtgctgggattatcgcgtccaccctgggacactttttatcatagagattattttataatttatctgctgtttagatggcagcattgattgaatctgtgatttttactccataatttaattgaaaagacagatgttcatcaaagccgtctaaaaaaaaaaccagttcatactggctagcatcacaagggtactacctccagatctgggcaagagggtttttgcctagggcctcatgctttagagggccttgcttgatccctctttcagctgagtttatcaccattagctgagaagttggtggagttgtggggacaagttcagctggaacctgtatcccccttctagattatattccaggtaatcaggagcccacagttagtcgaccagatggctggggttctgcttccatgatttgagtgagcttctttctttgtctgtccactggagggcgaatgcaatactggtaggcctgagggattgcaataggcatctgtagctcatggatgaactgt

SEQ ID NO: 150998 - DNA, 125 bp, Homo sapiens
tctggattaggggtgtcagaagcaatctggactgggcaagatggtggatgaccaagatggtggaccaccttctctaggcagtttaaagaagggtagaggcacccttcttcttgggagtgagtgag

SEQ ID NO: 150999 - DNA, 352 bp, Homo sapiens
aaacatctttgagctcctgagtcagtcaagtctgtagctgaccttagctcctgccttgctataataagagatctcacacgtcttctttgttttggcctgtttgagccagacttgtataacctaaacctaaagcatcctagtctatacaaaacataatgaatgtttgttaagcaaggcaagtacaaaacaaaaatacttttctatacaactaaggacgatttttttcaagtatgctcactgaccacttacacctaaatcacactggatacttgtttaaaccgcaaaagaaagaattatgcagcctgtctgaattcttgtttctctgtttaaaaaaatgtgtggattcacacct

SEQ ID NO: 151000 - DNA, 886 bp, Homo sapiens
tcgaacgttcctctgggcctagatccataggctattcctggacggtgcaaacgatagtctctgagaagagagatgagatcacattcttgctttaaaatatatacttttttaaaaaagacgaaaagatatttgtctctgggggaggaggaaatggcgaacaagtaccaggagatgggcattcccttactctaatgactgcagttgagtcttcaggccaaaatagaaacctgtagatggcaactctctctccacctccccgccccgcccgccaccccaagcttataaatagaagtttccagtatcctatttggaagactttccaatactagaggccgaagcattggctagttttaagggttgttgatagtgacagtaaggctagatgctgttcataaaaactgggcgacttgaaggagacagccagaaaaagtgggaattctccaattgcccctttcttcttttcagttttgaagggttttataccaatgctttcttgaaaagactaacttattctgggtttggtggatagggatgggactctaaatgcttaagttgtcgtttgctgagcccttgaagagttccagttattggttgagtaaatggtagccacggctagatgtcaaaacccttccttccctctatcccctacagggtaatgacactcacaacccactttgttgtgaaaaacttaagagatatagaggaggcggtgcagcagcgccacccctcggtgggtgaaactattggcaaaagtcaatttttgaaaaatattgggaagtgaacttatgaaacatttttcccccagagatttaaaaaaaataggggagataaaactaacggataaaaaggactttgaagtttatcaagtagggaagaaaaatgttgc

SEQ ID NO: 151001 - DNA, 735 bp, Homo sapiens
tcgaacgttcctctgggcctagatccataggctattcctggacggtgcaaacgatagtctctgagaagagagatgagatcacattcttgctttaaaatatatacttttttaaaaaagacgaaaagatatttgtctctgggggaggaggaaatggcgaacaagtaccaggagatgggcattcccttactctaatgactgcagttgagtcttcaggccaaaatagaaacctgtagatggcaactctctctccacctccccgccccgcccgccaccccaagcttataaatagaagtttccagtatcctatttggaagactttccaatactagaggccgaagcattggctagttttaagggttgttgatagtgacagtaaggctagatgctgttcataaaaactgggcgacttgaaggagacagccagaaaaagtgggaattctccaattgcccctttcttcttttcagttttgaagggttttataccaatgctttcttgaaaagactaacttattctgggtttggtggatagggatgggactctaaatgcttaagttgtcgtttgctgagcccttgaagagttccagttattggttgagtaaatgtcttgagaactgtgggttgcgttgcctttatgatgccgtgttattggaaccctggcgaaaaatggaactagtgttgcaataatgagttttaaagctcccccatggaaaacaaaaacacaaccaaaccgatttt

SEQ ID NO: 151002 - DNA, 355 bp, Homo sapiens
gcggaacaagcaacacctcagcccctatggacctgaacagtttcatatcccctagcagatgtggggctgttcaatgtagcctttggaaacccatttctgtgtaagtggtgtatgccctgggcaactggcctttagacctggagtcagataccagagtttttttctgggtttgagtatttataccctccgttagcatggataaatcagtcttgctgctagtccctatgtgataggacatgattattcctagagaggagtggctttctgcatcaagctcactgggttttataatcaggatgatggcttcaatttttgcttgttccgctggtaccgagctcgattcgatcatgctccc

SEQ ID NO: 151003 - DNA, 198 bp, Homo sapiens
ccatgatacagtaatgaaggaattgctccactgaatcgagacataaacctattcattccaggctaagctagtcacagatgcatggaagatagaagacccagcatcttcctgaggaagactcatttccaatgcctgcatttcttcacattcccttgttgttgttgttgttgttttaataaacatgtattgagtgccact

SEQ ID NO: 151004 - DNA, 348 bp, Homo sapiens
taactattcggtactaggcttagtactaggtgacaaaataatctgtacaacaaacccctgtgacacaagtttacctacataacaaatctacacatgtaccctgaacctaaaatgaaagtttttaaataaacaaataacatttttaaaaaaaagaacgccagagattttataaaaaggatttgaggaacattacaaacactaaagacaagcaaaagcagcatgatatatatgaacagtaggagtccctaaagaagcaaatcaaaagaagggaagagaaaaattagtttaaaaaacaaaaaaaacttcgctgatactatttttgaaaaaattgaaactaggtactgaaag

SEQ ID NO: 151005 - DNA, 190 bp, Homo sapiens
gaaggatatacaaggattatgtacttataactttaaaagattatatttataaacataaaaattaatagaagctacattataaaaacataatcagctgaaacaaacctccaagttattattattattattttttttttgagacagagtctcactctgtcacccaggctggagtgcagtggtgggatctcag

SEQ ID NO: 151006 - DNA, 311 bp, Homo sapiens
ggggtggcgagcttatcagcatcatgtactgtgccctgaggatgcactcaccactgtgctaagtcatttacatgcattcttctcactgaattttaatcctcacacaacccatgacatgagacactgatattatctcctgttttacagaagaggaacctgaggcacagagagaggttaagtaaccggctcaggattctagagcaccaagtggcagaacctggaggaaaacccaggtgtaactgattccaaagccaaggggtctcaccaacttgccatcgtgcctctcaggccagttggaatatacggagggt

SEQ ID NO: 151007 - DNA, 278 bp, Homo sapiens
gatgcgcacccactctagacacttctttgaaaacttcctgatagtccccagtagaatggatcactcccacatctgctcccatagagaccggggattttcttcctcttttgtgtgaagtttattttccattacagctcccagcaatggttagtttgtaataaccatttgtggaagacatttccccactattaagagcctacaagcccatgcttatgactctaaaatcaaatctataaaactaacagccacttccaaagtgttctcacattttggactag

SEQ ID NO: 151008 - DNA, 348 bp, Homo sapiens
acatcccatatgtcacacctcaccatagacctgggtgccaaatagcctgaagagtctgaactcacgttggcagttaggaaagtgctcctacagacgcatctacggttaacatagcatccctatggccactgtctcccttgatccccacagccattctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatcc

SEQ ID NO: 151009 - DNA, 311 bp, Homo sapiens
ctacaaagacaaaaataagattacttagataagtaactattttaattaagaaatatcaattgttgatgttgttactcctcagaaataaataattcatatcaacaacattaataactggttaagagttctggtagccaaaattatcactttggcatcatagtataggaaaactatgttgtatcttcttttagggcacttaagagactgaactatttcttcctctaaaaacattacaggagaatatttatttgtagtgtgctcagcacacacacaatatagtggggaaaaaatcccttttaacttgttcaaca

SEQ ID NO: 151010 - DNA, 198 bp, Homo sapiens
ggcagtgagtgtgcattagtcaggttgcactagtaaatctgtcagaggacaagaatgtgtgaagagcaagaacagtgccaggtcggaacatcctggtgttggaactgcagcattctgaggagctgcaaattgtttggatgcactgaaggaaaagggtatgtggcttcacaagatcaagagacgaagcagataggagag

SEQ ID NO: 151011 - DNA, 703 bp, Homo sapiens
acaccagtggtcccagctaccagggaggatgaggtaggaggattgaggatcgcctgagcccaggagttcgaggttacagtgagctcgaggttacagtaactgcagtggtgccactgcactccagcctgagctggagagctggagagcaatactccatccctacaaaataaaataaaaaacaaatggaaataaccaaaaagggtagatctgaaaagatggcaaagaaagatgtttatgtcctaactactttttaatcaagtgagaaaaatatctcttctccttaggtatgagtactgccaagatatccaatgtaaattaaaagactcaaaatgaaaagaaaatccaacttggctggacacagtggctcacatctgtaatctcaacactttgggatgctgagaagggtggatcatttgaggtcaggagttccagaccagcctggccaacatggtgaaaccccacctctactaaaaatacaaaaattagccggacatggtggcacacgcctgtaatcccagttactcaggaagctgaggaccatcgttgcaacgatggtcctcagctccctagtagtgggacacaggcgcccacacaaaccggctaatgtttgattttagagagacggttcacgtgtagcaggaggtctcgattctgattgtgaccacggcaggttccaaggcgggtacggggatacggccgccca

SEQ ID NO: 151012 - DNA, 527 bp, Homo sapiens
tttcccagtcctgttggcccttctcccctacattcctcctaccacctgcctctccactcttcttataggaagtcccacgttggcacagatggccaccaccagagaggctgcctggctgctgcacatggccctccaagctcctccatcctttcctttggttggttttctctgctgcttctcagcagtcatccaggtttcaactcaacctcctgcccctccttcactgagaaaacagaagccactggcacgcattccatcttggtgcttctttctctctcctccattttgcttcccatccttcactcacgtaagccattcaccttcttccctctcttctcagaggaagtaagtcccttctcctattcaagacagttccctcacctggtgcttggccccggcctcctgtccatccatgctccctcatctgtgtctcctgtgtcactctcccacagccagatccatgtcctcaaccaaaaaatacatcccagtttcccacctccacccagctctcctcaggaaaaaaaaca

SEQ ID NO: 151013 - DNA, 325 bp, Homo sapiens
ggtgggaatgatatagccactatggaagacagaatggtggctgctcaaaatattaaaaataggccaggcgcaatagctcatggctgtaatcccagcacttgggaggccgaggcgggtggatcacctgaggtcaagagttcgagatcatcctggccaacctggtgaaaccccatctctactaaaaatacaaaaattagctgggcagtagtggccctcacctgtaatcccagctactcaggaggctgaggcaggagaattgcttgaatccaggaagcagaggttgccgtgagcacacatcgtgccactgcactccagcctgggcaac

SEQ ID NO: 151014 - DNA, 662 bp, Homo sapiens
ttgagaattaacctgctgtgcgtggacaggctcttggaccttcaatctatttcacagcctgcaacaagaccttcagtgaatctagatctaggtgatgatgaaaccacattggctcctttccacattctgatgaaaatactctgtaaaaagcctaatagggctttcaaatgattccaatgtaaatatttcctttttatggaagggattcaaactgcttctaggtagagggaacgtctataaaagctaagtgagctagaataagggaacttgtatatttccttttcaaatgccactgtcttatcaagcaaaggtttctccacttggagaattctcttcttctgagtttgggggaaaaagtggtgatcagaaggtttgaccaagatacagtggatttttctcctccctataggctgagccaactgatagggaaatggggaaatgagctatggggagagctgaagagctggcccagaggagagcctagagcagcgtgagggtgggagccacggcgtcgcaagcatcctgactcccacagaccggcccaggagaagtctgagtgcaaggtaaggattcaaccgagtcaggaagcccaggggcagaagaggatcagaggaagtaagatgtgatagcagttattagaaaagcactacattcagctgggc

SEQ ID NO: 151015 - DNA, 499 bp, Homo sapiens
caagctgggcttgtgtatttttcctcacttcagttgttcttcccatagttcatgtagggaggcactttggcttttgaaacactacatttctcaatatttaagcacaatttattgtccttatttttcagaacccattaaatataagggtcagaacctagaaaatcttatgtgctggatttctaccctgtatgattcttttcatccatgctttgcacttacgtaggaatatacataatttggtctgaagaagtataggaacagttgagcacattacttcaccactggaagaataggaaccagggaaaaacatcagcctctgccacttggagcactagaggatgacggaatgtcttgtatatgcggtcaactgttcaggatttactactcaattggttgttcacaatcagggaaatgattggcttcttggttgtttgttgaactttctttctttatatggttaaattattttgttttgataaaaataaaacttaaaatgcaa

SEQ ID NO: 151016 - DNA, 374 bp, Homo sapiens
atttacccttctactgccatatctttgtttcatgcacacacgttttgctggaccaatagtagataacaatgtttcttaaaatgaagatatgggctgggcgcggtggctcacgtctgtaatcccagccctttgggaggcaaaggcgggtggatcatctgagctcaggagttcgagatcagcctggccaacatggtgaaaccccgtctctactaaaaatacaaatattagccagatgtggtggcatacacctgtaatcccagctactcaggaggctgaggcaggagaattgcttgaacccgggaggcagaggttgcagtgagccaagatcgcaccactgcactccagcctgcataagaagagcgaaactccatctc

SEQ ID NO: 151017 - DNA, 268 bp, Homo sapiens
tatcgattgccaccagccagccctgacccatgtttgaaccaaattccagccaaccgtggactagtgcatttcaaatatctgattcaatgtatccaagccactgcccaacagacaccgcacgttggaaacaactgtgaggtgggggtagaaaaggccaaaccaaacagggcggagtgcaataagggttggcaagtgtcacagtcactcatgtcaccaatcctgattccctgtgaaacatactggttcctttctcacatatcgaggcatg

SEQ ID NO: 151018 - DNA, 515 bp, Homo sapiens
agctaatactgtgagaggtaggagggaagtaacatgatgaagggaatagcagatctgtgtttgcaatctgacttgcatgctcattaagtctaaaagcaggcaaactgtcaccatgattttaattcactctcttttatgtttcatgaacccacacagttggttttatatatgttcaatgcacacttgacatgcctccacatcctcattgtgtgttattaatactgtaaatatgtaaggcattgttgtcacagtctctgggatcatagacttgattgatttctcaactctgtatcccgaggtggataagttaccttaaacttaagagtttatttactcagccataaaaatggatactgtgatatccactttgtagtagtcttttgcatgtctgagatgtgtaacccctttagtccagtacttggtacaaatagatgcttagtaaatggagatgtttttgttagtataagaagagccacaatttttatttaatacttaaaattgagaaatagggaaat

SEQ ID NO: 151019 - DNA, 392 bp, Homo sapiens
ccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaag

SEQ ID NO: 151020 - DNA, 315 bp, Homo sapiens
catttttgctctcttcacttcatttatcatttctccctgtttcactcttcatagcacatttgtactctgtccacacctagagacctccctgttgaagttcttcacattctcttccctagagagggttaacttgttgagctcagagacttaaacttaaaataaaatgtaacagatatgtattgaatgactattttattttagctctaggagaaatgcaaagatatatcatccatagaccctgaaatccagctaagggttctgcttatacacaaggtgaaaggttgtgataatgcacattaaacaatagaagagtga

SEQ ID NO: 151021 - DNA, 869 bp, Homo sapiens
atgagggttttctctgtatttcacaaagtcactgtgtggtctgtggcagaaaggagggagatctaaaaaatgatttaaatcgtaaattattagaatttggttgcaacagaatttgtgggggagggttttgggggttttgcaagctattagcataatttaaaaaatacctgctttgtaacaaaaactaaagctgattgaggttacagacttctagttattcttttccttctatttccttctttcctttggtctgtatgtttcagccctgtgaaatagtcaagggtttaaagtctttgcacaagcccagagttcttgtacacatctgtctgtcagtgtatctggcagcctttgtgactgattactcacttccccacaatttgactgtgggccaagaattgtggtaggtgcctgtggtagggatggaaatgaataagacctattcacccctcagggtcaccccacctggtatcacatagcagaccacactcaatacattgtgtacagagtgataagaattaaataggatgctaaggagactgactcaggttgaggaaggatgggcttctaaggggtgatgtgcttgagctgcatcctgaattcctaaatgggaaagagctaaatttttatacacacacacacacacacacacacacacacacacacacacacgtttacctacctagatgttaatactcacctttcatcactatttttaaatgttgattacacaattacaatgacaaaaagagagatcatagatgttataacaaatgtaactttatcttaatttttttgtttgtttttgtttttgtttttgtttttgtttttgagacagagtcttgctctgtcgcccaggctggagtgcagtg

SEQ ID NO: 151022 - DNA, 189 bp, Homo sapiens
gcatggactgtggtcaagtccttccacgataccaaagttgtcatggatgaccttggtcagggtgctaagcatttgtggtgtaagtttgaatcaaggatggtaatagtccctccctaaaactgactctgttcttttctttttaattaatttatttttttattatactttaagttctagggtacatgtgca

SEQ ID NO: 151023 - DNA, 134 bp, Homo sapiens
tctcacccacagggagtaatttcctcacaatgtgcagaattagattagatgttggtatggtgggctgaggaggacggtagaatttcagaattatttattcccaggaaatacgtagagaatgggtatttcgttct

SEQ ID NO: 151024 - DNA, 145 bp, Homo sapiens
taattttcatgcatatgtgagatatcagccttagagaagtttagtgacttatccaatgtctcacaaccagaaaatgatgaagccaaattttgaacctcgatatgacttcaggttcagtattctgaactaatttacaatcaattct

SEQ ID NO: 151025 - DNA, 240 bp, Homo sapiens
ctagacacggtctcactctgtccccaggctggagtgcagtgatgcagtcctagctcacggcagccttggactcctgggctcaagcgatcctcctgcgttggcctcccaaagcactgggattacaggtgtgggccactacgcctggtgatttttattattttgaagacaatttttctaatagtttttagaaagaaaagcattaattttgtttactttttcaaatacatgagttatacttgg

SEQ ID NO: 151026 - DNA, 526 bp, Homo sapiens
tatcagacatccaaatggagacagtatttactgagcacctactatgcaacagacacatcatttaacttttttccttcttttttgctaatgctaataaccacagaactagaaattaaaaagtactaatttatttggaataccaggaagtgtgttatatacaataatgccagtaaacaagtattctcaggtctaaaaggtataaacctaaaaaagaaatgtagatgtatacatatgatagtgatataaatttgtcatgtgttagtgatggggcaacacctcaaggttcccctggaggctgtccacataaaccagcttagtttatggttctataagaggggcccaataaccatttattgatattgataatgatgctaataatgttaaagatagtgctggcagtttgaccccttgtagggagtatttgaatagagcagactctaatgtagcatgaaaaagcataatcaacacttttaaaagtttgttttttgtctggatagttaatttactttggaatttcaaaaaaaaa

SEQ ID NO: 151027 - DNA, 257 bp, Homo sapiens
aactccgacacatctgagcatcagaaggaacaaactccggacgcaccaccttaagagctgtaacactcaccgcgagggtctgtggcttcattcttgaagtcagtgagaccaagaacccaccaattccagacacagagtcactactcaaatcattctcatccaaagcttgtaggataggggtttttcaaaggcagtttcggggaaggcgtgggggtggccagggaacgggtgcctgctgctgattggttgggcagaga

SEQ ID NO: 151028 - DNA, 572 bp, Homo sapiens
aatcgaggctcgtaccggtgttatcgatgccacttaagttgggcaatctagcagagcaatgtcttaatgctcctggcaaaagatacaggatatttctgatgagatttggtttcacagttggattctccatagtggagacatttaagtttatacagctagagaattaaaactgcagtgaccacggctttcgtcacacacccatttgtttggacgatttccctccctaaaatcaaggttttgttggaaagcacagtcccgcccattcgaacctccagggtggagttgagaagttgtgacacatcactggacgctcctcgctggacatttctacccggagctctacagacctcggggtcgcggtcaccagctcatagcattcccacttcccaggcccctttcctaccgcttacacagcccattcctgggtccctaccaagaagtctggaatctgtcccattgggagttccaggcactttcgggactcagatacctccaacagcaccccgagcattcaccctatcttcatctagctccccttcactccgcggcccaccttccttatgacctggaag

SEQ ID NO: 151029 - DNA, 467 bp, Homo sapiens
  misc_feature (10)..(10): n is a, c, g, or t
  misc_feature (17)..(17): n is a, c, g, or t
ggtcgctctngaggatncagtgctactccacaaacaggagtaatggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtacggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtggaggtagcact

SEQ ID NO: 151030 - DNA, 204 bp, Homo sapiens
tcatggtgaaacacacatcacttaaaatgtgctgttttaccatctggaagggcacagttgagcggcgtgaagcacgttcacattgctgtgcaaccgtcgccaccatccacctccagaaccttctctctccccagactgaaactctgtccccattaaaccctgacccccagcgcctggtaacctcttttctgctttctggctcgg

SEQ ID NO: 151031 - DNA, 809 bp, Homo sapiens
  misc_feature (45)..(45): n is a, c, g, or t
  misc_feature (51)..(51): n is a, c, g, or t
  misc_feature (526)..(526): n is a, c, g, or t
  misc_feature (555)..(555): n is a, c, g, or t
  misc_feature (600)..(600): n is a, c, g, or t
  misc_feature (627)..(627): n is a, c, g, or t
  misc_feature (636)..(636): n is a, c, g, or t
  misc_feature (656)..(656): n is a, c, g, or t
  misc_feature (665)..(665): n is a, c, g, or t
  misc_feature (678)..(678): n is a, c, g, or t
  misc_feature (688)..(688): n is a, c, g, or t
  misc_feature (692)..(692): n is a, c, g, or t
  misc_feature (701)..(701): n is a, c, g, or t
  misc_feature (709)..(709): n is a, c, g, or t
  misc_feature (724)..(724): n is a, c, g, or t
  misc_feature (737)..(737): n is a, c, g, or t
  misc_feature (745)..(745): n is a, c, g, or t
  misc_feature (754)..(754): n is a, c, g, or t
  misc_feature (756)..(756): n is a, c, g, or t
agatgccttctgccatgattataagtttcctgaggcctccccagncatgcngaactgacctgtgagagaaagccggggaagcagaaccctttgatggagacaacagagtcaggacaatattgtttaaaactcctaaatccaaacatgcctgaagctataagttacttctgaaatttaaaaatttgtctgtggtatctgtttattatggcagcccagtaagactaagacaggccatcacaagacgtgaacgttttggaccttctcttgggccctagtaaacagaaatcaggctatttattaaactaatccacgttctgaacagttattgctactggaaaccagtcccgatccagaccacaaaagacgattcttggatcttgcacaagaaagaaaggctactcctcacagtaaaagagcacttggtggaaattttgttctgaagtgaaggctgaaaccccagagatcaaacactgtactcaagtatacaaagctggactcagaccctaacactggctttaaaatttgncctaacttagaccataatgcctctctttncagctggatctacatgcctccactctggcttttacaaggctctgnactattgtcagaacttgggaattctancattgaggnaaccattgacacatttcctngatgaaaantgatacacttatncaagtcgatntgancatgtatgnctatttgnaccttacaaaactgnatggtgccaaatngattgaantgaaagtgncncttatgtcttagaatacttggttaaatctcagaatcagttgtctgaacaattt

SEQ ID NO: 151032 - DNA, 342 bp, Homo sapiens
agagtagcgctctaagatgtgctaagtatatctgcccctttgtgggcaaggtaccagaggagggagatatacgtctgccccttacagcaaggattccatagccgatggtgtctggatagagactgtgataatgttagccccatttgaaggggacggccactgctcagctccagctgcttgttgccatgtgctgggatatttatgtatccacctaacctttatatagctcttgcaatgtgtcaaacattgttctgagcacgtcataaatattagcttgcttaattacattgtcataacactgtgagggaggaatattgttatgattctcatttcagagttgaa

SEQ ID NO: 151033 - DNA, 190 bp, Homo sapiens
aaggaatgtcctatagggaatccatgtgcggttgtccagaaaacgtaatgagggtgaagattcaccaaataagctctatactttggttacctatgtacctgttaccactttcaaaaatctacagacagtcaatgtggacaagaactaatctctgatcatcaaatacatcaaataaagttataaaatagca

SEQ ID NO: 151034 - DNA, 186 bp, Homo sapiens
cccatgaaggaagtggaaaagaatgatgaatgtaatggtgatcgatcttatagggactttttggaagaataagaaagggaagcctttcagctttatggccattcactaggaatagaaagaagaatgatcttttcttcacgtgatatatgctcagtttcttctagcatccctgtattgttgctattg

SEQ ID NO: 151035 - DNA, 395 bp, Homo sapiens
cttgggttccttggaagcccaagaatgagatttgggtaggtgcggtttattcaaggtgggggttctcaggagatggaaagcgaggctaggtggatgatgttggagacgactgagccaagcgggaattctcgctctggctgaggctatcctgcatgtgacgtcggatcttggagtggccactgctgtaggactgcttgagccgactttagaccagcctactctatatggtgaaaccacatctctactaaaaatacaaaaaattagccgggcatggtagggcatccctataaccccagatatttgggaggctaaggcacgagactcacttacacctaggaggcagaggttgcagtgaactgagattgtgccactgcactccagcctgggtgacggag

SEQ ID NO: 151036 - DNA, 1051 bp, Homo sapiens
aattatttatcaaattagttgagaggcattggtgggggttcgggatctacacattaagaaacatagacatgaacgtctccatggaaagactgggaaaatggattgcaggttctagcaggatgtcataataaatggtgcatatccagagtgcaagatgattcagtctcaccaagaacactgaaagtcacacggctaccagcattattgtgataagaactactattttgggagatagtttagcaaaggtgccatgtagaaattgattaagtcagaggtatctttaacttgccaccacagagaagagattaatttcatatacttccattgagaagagagataagaatacaaaaccaagctgatttgcaggagtaaacttgatattcaaatactatttcctgaatgacattttctgagacatgctaattgtaattactttcagcttcaaaacataataaatttatctcatagtaagcatatagatggaataaataaaatgtgaacttaggtaaattataaattaataaagtatatttttaaaatttccattttaatttctgtttaaattagaataagaaacaaaaacaactatgtaatacgtgtgcaaagccctgaactgagatttgactttaccttgagctttgtcagtttacgatgctatttcagttttgtgctcagatttgagtgattgcaggaagagaataaatttctttaatgctgtcaagactttaaatagatacagacagagcattttcactttttcctacatctctattattctaaaaatgagaacattccaaaagtcaatcatccaagtttattctaaatagatgtgtagaaataacagttgtttcacaggagactaatcgcccaaggatatgtgtttagaggtactggtttcttaaataaggttttctagtcaggcaaaagattccctggagcttatgcatctgtggttgatattttgggataagaataaagctagaaatggtgaggcatattcaatttcattgaagatttctgcattcaaaataaaaactctattgaagttaca

SEQ ID NO: 151037 - DNA, 308 bp, Homo sapiens
tgaaagaataacctccatgagaaagctaggtcttactggctttctgaaataaggatgagctgcttgtgaattgttatgtcccgtggaactggatcttggcttctcctttttctctacacaggtttgactattaataatagcattaggacctatggctgtctctgagggttgtcgtccattactaatgtgaggctcctcgtaagtgctggttatggtttatgagtagtggtccccttcattaattcagccaaagagcttccaagagaggactatggaagtaagaagtgagagaaacccatacctgggac

SEQ ID NO: 151038 - DNA, 211 bp, Homo sapiens
tgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgatttt

SEQ ID NO: 151039 - DNA, 569 bp, Homo sapiens
tcttctcccctgacaaggatctagacccagttgtagagggaggcaaaaacaatccaggcctcttggaggttctaaataacagacagaccagttgacattgttagagaggatgactcaagtttctaattcagcacatggacagatgctcatagcttcagtgaaaggtaagttttgacacattaaattgcccagaaaatccagatctggaatcaacgtggtagagtaagttagatcacccaaaaagtcaagagtcacgtgaactaaagatggttaagaactgatttggggcgaagttttatagaacagtatttctaatttagaaaacaatacatagactaacaggagatacaagacaacgagggttgggggaggattaagaagcccagtgaacagaattcccagaagagtataattaaatgtggtccctgagtggaatcctggaggaccttacctgcagccacgtggctgtggacagctgcatttcagtggtgacaaggaggaagcagctgtgagatgcatggtgcaacagggtctggttactgcattgtggtagtgtggagccactgagt

SEQ ID NO: 151040 - DNA, 354 bp, Homo sapiens
aacgggtgatgcggttgtgaggaccagggagagtgacctgggagggagcttagggatcacctcagccaactcttcattttaaatataggaaaaagaggtgagaagaggtgaaatgacttgcccaaggctgtctactgagggagggacccgctcactatgcagctttgcggtggcccatcaccaatccctggacaagtcaggctcacagaccagctcagctataagcagaaccaagtccagaacctgccttactttcttcatggggttcaatgagaagaagccccttcacactgggtaaggagcgccatcccgtcaagcactccaggtggggggacttctaagcagcctggagaa

SEQ ID NO: 151041 - DNA, 340 bp, Homo sapiens
tttgagaccagcctggccaacatggtgaaacccgtctctaccaaaaatacaaaaatttagccaggtgtggttgcatgtgtctgtattctcagccactgggaggctgaggaaggagatttgcatgaccccgggaggtggaggctgcaatgagctgagatggcaccagtgcgctccagcctgggcaacagagtgagactccatctcgaaaaaaaataaaaattaaaaaacaaagatgtatcggacatggccctggtcatttgtgagtgcatagattaataaaggagtttgacattataaattatgacatagtatgatatatatatatacacatctcatatat

SEQ ID NO: 151042 - DNA, 676 bp, Homo sapiens
tgcgcgtcgatctagaggtcccctcaacgctttatacttccctgcctcagagtgggtcggtcagaatggtttaacaatctttgtcctctttttatcctggctaatatggactatttatgctattctaagaagcatgtcatttagtatttctcatttcattcttccaacttggtacttttatgttttgctaaggaggaagaaaggtgataagtttagttacagtttctaaaatgggtttgaatgattgggttttatcctgaataaagaaactccgctatattttgttatttactttacttgacagcagtggcttcaccctaagatgacaaatggtcattatgagagagctgtcatttatatcttctcagcaaaatactcctctggtttaggtaaatgttaaataggagagaggaatgaaatgcattagtaaatatgctgaaaaatgttcaattcaactcaaagaaatgccaaataaagcaacaataagatcatttttcacatatggattagcaatttttttaaataatgatctttaaatctggtgaggtgctactcatacattgtcgaccggcaagaaaattggtataaactttctgagaaataatttgatgctgtatatcagaggggtcacaatgtttatgcccttttgagctaattcttcattgcggagataaag

SEQ ID NO: 151043 - DNA, 323 bp, Homo sapiens
ggtatgtgggcatagcatctgtgctacagctacgggaaaggtcatgaagctggtagatgggggacatgtgaagggggaagagagaaaaacgatatttattgtgcacctttatgcatcctgctagatgcttacgtcacatttatctcaattactgcagccatacaacaatcagtaaagttctgagtataagatatgttaaataggttaggccagaggataagatacattagactattaagaatgatttttaaaaagctataaatattttgaaataccaacagaaaaggaaaaaccatctattaaaagtgagttaagctatccct

SEQ ID NO: 151044 - DNA, 521 bp, Homo sapiens
tatcacaatgtctgacatcaagtgtactccaatttctgtgaggggagagaagtgattactcacccgtgggccttgcacccatctcccacccttgcttagtgccaagtggcatgctcttggcattcaaagaagtttgtgaaagcatcttacattgccagcacctccacgaggccctccagatcacatctgcctgggaaggtatctgctcaattgccatcattcctggcttgcttgcacagtgtctctggctatcttccctaccagcctcatgtctcaattacttatgggtcagtctcagaggccacactggaccatccacgggttggaagaataaaaatgggaagggctggtaggagaggaaaggtagaaggctattctcttcctaaaggatattccaccccttttctgtttaaccaccaccacttcttcgagccctcctagtgtcctagccttgatgtcttactaaacacacagacacacagacacagacacacagacacacacacacacacacacacaca

SEQ ID NO: 151045 - DNA, 299 bp, Homo sapiens
agaaaaacacccagtaggtgtgctttttgttttagataaatgcatttgtttgcaaaatattatcctatttcaaaagtattttttaaatattcagtattgatatgctgagattaaggtgatttatgtcccagtgacgttaaaaagtgttgacttgattttgttttagtgaataaaataactagaccactgttaagtttcctgaagaaggcgtaaaattaatctgaaaataaaagaatcagaataagttattgcttggaaactaagtactatttagacatcttcatttctgaattgtgagg

SEQ ID NO: 151046 - DNA, 550 bp, Homo sapiens
  misc_feature (3)..(4): n is a, c, g, or t
tanntgagcagaagaaatgcttggacctggaaggcaggttgcagtgatccgaaattgccccgctggagtgcaggggcacaatcacagctcactgcagccttaacttcctaggctcaagcagtcctcccaccccagtgtctcaaatagctgggaccaggtgtgcaccaccacacctggctaattttttgttttaattttttgtagagatgaggtctcactatgttgcctaggctggcctcaaactcttaagctcaagctatcctcctgcttcagcctcccaaagtgctgggattataagcctgagccaccactcccagccatacgtaattttgtatcatgagttttcacttactaattacacaacaattttatcatcttaaaaaaaacttcataagtatcatttatagtaggtttatatttccattatatatatgccaaatttttaaatctttattatattgtagcacacatgttatttttaaactttaagatttaaagtatttgttcccttaaatgtgattattattttcattattaaacatcgactgat

SEQ ID NO: 151047 - DNA, 362 bp, Homo sapiens
cggcgccactggtgcccactgctggctcccactggttgccctcccacttggttgtggctcccacttggctgcccgacccttgctgtgacctctccattcatttattcccagttggacatcagagtctgccatattttggctctaaaacttttgctccaagaaaattaacagtgacaggccaggtgcggtggctcacgcctgtaatccgagcactttggggggccaaggtgggcagatcatgaggtcaggagttcgagaccagcctggccaacacagtgacaccccatctctgttttttttttttttattttttaagtgaaaaataaataaaggagatggtggttagtgggctccggccaaca

SEQ ID NO: 151048 - DNA, 223 bp, Homo sapiens
cagccccttgttcaaacacagcctctgaatcgccagaggcttccggtgcatactctgaggcgcaggtgggactcgggagtgagaggtttcggcgaatgaattgggattgcctacttcttcccagtgcagtggagcttggttctgtggtcaggtccttacgccctgtctgcctttctcgtttctttatttctcgggtagtagttgtggaatcaaatgacctggg

SEQ ID NO: 151049 - DNA, 437 bp, Homo sapiens
agcaagctaatcactatcttatttgtaagaaataaatgaaaagtgattcattatgaaatgtttggatatattacagtataaaatataactaaccctttcttcacttttggttagatgattacaacaactacttcgcaaagaaaacttggcctgcaggaagaaattcattcattctaccctcatacgttaccatacattaaaagtggaacactgattacttaaagattagtatcaggaacgaaataaccattcttgtatatatttgtaattcagagttttatgtatgcattgcatgatgaaagtagtatttctagaccactttttgggtcaatggctctttttattctgagagccaagtaaaatagattgttttaaaactactattgttatgtatttaatatgttttccaatgctttttatgggaaaaagttatttgt

SEQ ID NO: 151050 - DNA, 188 bp, Homo sapiens
cacagcttcagtggatgcaagtatgatctctccgatgatcctgggtcccttcagaggcctttggatggttctgagcagtagaactcaaactgtgatcccaggaaggcagcatcagcatcacctagcaacttgttagaaatgcaaattcttgggccctaccccagacctactgaatcagaaactctggg

SEQ ID NO: 151051 - DNA, 171 bp, Homo sapiens
taaatcctgacaagtccacagatttgtacctggactctcttcaaatccattgatcaaaagctgccatggcagagaaaaggagagaccatgaaatacacaatggctcatgaagcatctccctgtagtgacatatgtcaggtctgctcactgttcattgcaaaaaaagcaagt

SEQ ID NO: 151052 - DNA, 202 bp, Homo sapiens
tctgctttcccagccactctgtcttctcctgaggggttggctcctagggagagaactcggttcaccgccaccttccactgcccagaacactttccagcccccacgggggcccgtaagtatttaggaatgaaagaaaggccccctccaactggatggggagggcttcaaggggggctgtggcgcattcacaactcccagtgcc

SEQ ID NO: 151053 - DNA, 739 bp, Homo sapiens
tttttcaaccaacacatcataacctttttaagtgaaatcactttaatatggttttctgaagcctctctatctgtttaccaaagtttatctaacagtctgcataaggtaaagaatatactgtgtcacattttctatttgttgaaggaatttgtgtggaaaatagtttcccattgaaaatgtcaacctgaattgtttaaatgggcttattctgtacattgctaaacaaaaaatggggtagcatggataaagagcaaactaagctttattagtgctgcaactaatataaacaaatgtttatatttgttgcttcttttggttagcaatgatatgtcaaagttatatctgaaatagtcaaatctttgggaaacagaatctagtaacaatttgaaaagtaatacactatcccatttttattggctttatgatggttgacataatgttgctgtgacatttaaacattcttgtaccaatattgtcttttaccattattatatactgcagttaattggctttacagttctttatatatatagcaaaatcctgaaagaacatatacctttattttgatgtggcttgaagcttttgaatgggtgaataaggatgatagaaaggtttcaaaatcaagcaacaaagtcttaaagtgataaggcatggcttaaagatcttttgatcaaacatacctgtgtttgagatagatttaagagccctaaatgcttatcaccattcactccaaataaaa

SEQ ID NO: 151054 - DNA, 432 bp, Homo sapiens
gctcgcgcgtgtgtgcagggagtctataggataccctgtgaccgcaattgctggaacccgggaggcagaggttgcagtgagccgagatcgagccactgcactccagcctgggtgagaagagtgaaactccatctctaaataaagaaataaaagagaactctggggcaccatgtgaggggaactccaaggagagtcttgggtagagacggagcgaggagcacaggcaggatgctgcgccttccaggaaaggtcagtaagatgtccccactggcaatgtgattctgggaccatcgagaatgggttatttgctttgctgcgtgcaaactcctctcatcgctccaatcttttagggaagctgctcacacaaaggccttcttgcagaatcaaggagaaggtacccatttcctctgccactcttctctgcccccagcc

SEQ ID NO: 151055 - DNA, 395 bp, Homo sapiens
gagggactatcccacctgggctccatccctcttgaaagggacacctatctgcctctcttagttcagattgctggaaagttcttctatacaccaaacctaatattgtggtcttggaactgtcactcctgatccatgtctgctccccaaggccccagctccccaggtagcacatctgctccaccccttctcttctcccactcccaaagagcccttctgttcttggagacatttgtcagaggcaggattcatggggccttcctagtctgtggtcctttctatgaattccaggttgtcacttagcccctccccagtgcacctgctgtgtacccattactgtgctgaacactgggcagatactaagtcaggcatcatctcagtcctcatggattcacagt

SEQ ID NO: 151056 - DNA, 411 bp, Homo sapiens
gcagggcattccaagaaagcaaatgtatatattaatacatacagtctattttggagcataagtaggtggcaccctcaaagaggccttacctatttttcttttcatagcagccattctcctttctagcacttactcccatttacactttggatacactggctagcttcatggcaacacactttttggtagaaagcaagaaaaacctaggccctggtgtccccgcaccatggtttaatacctgtcatagacaacctaggttgctgccatagggcaacctagaggacaaacaaatatttaaagtgtatacaaggaagaactcctaaactggttgtccaaatagcctaggagttctcaatttgccctctacagaaaggctccaggaactgggtgaaggaacctctgaaaatcatg

SEQ ID NO: 151057 - DNA, 304 bp, Homo sapiens
aatgttattgagtacttctgtgcaggcaggttctggtgttggggacaagggtgtgagtgagaggactgagttgttgcctttaggaagtgtaccgtctagccaggagtaacggcttgagtcgaagtcggctcccattgggcctcttagggagtcccagtttgctctgaggcctgctcctctctgggaagaaatcaccttgagagcttctgggatttggaactccctgcatggttggatcccttccatcttcatgtgaattgtcttggtaatgaggctgcccaggaaagccataacacagggacat

SEQ ID NO: 151058 - DNA, 317 bp, Homo sapiens
agttggaaattatgccagagagtgagtttgccatcgccaggcttttacaaatgtcgtcatccctatgtattgagcactgtttcagtgtgcagatactggctagtacttttttaaataaagattttattttgagtaacctggctattagtcataacctgtcttaattcaccttccctagaagtagaacctgagaaggaatttgggtgcatgtggtttattgagtttacactcttaaaaaacatcaccaaagaatgaagaaaacagaacagagaagagctaagcaagaatgtaatcataggtaaaatgcagtcttattc

SEQ ID NO: 151059 - DNA, 562 bp, Homo sapiens
ggtgcctttcagttaggattttggatttataagcaaactccaagaaagagcctggttctgagtttctctgaatagcttaggtcaagtcctaaattctgaagccaactcctataattccttctttatgtctttggcatgtgaagtaggcaaatttcgaactttataataatagcctagacttacaaatacttgccttggtaatcaggatgagtttttgagagacaacatagtctagtgttaatcgcgtggacaccagactgcttgagtgaaatacaggttctaccatttattaacggagtaatgttgggtaagctatttagccagggtccttatctgtaacatggtgataataataaagattaaataataggtgaaaaatgtttagaataccactgtgttattagtaagcaccatgcataggtgtttggatttaaaaatactggcaaaggccaggttgggtggctcacacctataatcctcgcactttgggaggccaaggcagaaggatcgctttagcccaggagttcaggaccagtcgaggcaacatagattccgtctctgc

SEQ ID NO: 151060 - DNA, 528 bp, Homo sapiens
tcccactgtggttacctgccctgtgtttccaggacttgttcatgatcttgcctatcaactttcccaggaagggctcttgtaaattccatgggaatttcccagagactctgtttagcttattccctttgggaaggcttcatttagcaaaggcagtatttttactcctccatggtgttgtgggtagaatagtgtcccccacaaccctccacacaaacaataagttgaagtcctaacctgtgaaatttggaaataccatctttgcagatgtagtcaagttaagatgaggtcatactggattaggatgggccctaatccaatgaccgatgtccttataaggacacatagacaaataggagaatgttaggtgaagatgcagacagatacacaaagggaagatggccatgtgaagatggaggcagagattagacttaacgctgctacgagccaagggacactaaaaactactggcaactgctagaagctagaagggtcaaagaaggatccttccctggaacctttgaagggaga

SEQ ID NO: 151061 - DNA, 158 bp, Homo sapiens
ctgagccgggtcatctgactctgagagctatgctttgagttactccctgccatctctcactccaggacacatacaggtccatgtcccttacgcacaacccagcgctggccgtgggctggaatccaggatactcacatttcagaaggttcatagagtgc

SEQ ID NO: 151062 - DNA, 299 bp, Homo sapiens
gcaaaacttcgtctcaaaaaaaaaaaaaatgatgaatgatgtatttctaattctagtgagaaggaaagagtatcagtgcatattgtcaagtgaagaaagcaagctccagaacaaagcctatgtatgttcctatttattaaaaacaaaagccacatatgtatacaaatgtactctatctttctgttataattttatgaatgcacatgtatgcaaatacatatattcatatacataagacttagtctaaacaggaatattctttcaggagggaatcttgcttctcctacagaaaaatacct

SEQ ID NO: 151063 - DNA, 164 bp, Homo sapiens
tccctgtctgaccctggaccacccttctactctcccctttcatcactttcaccacgcctccttcctgtctaccctgaagttttcttgtacctcaagctcccttcttgggtctaagtctctgctgttggcttccagtccattgatcaccagcatcacttgcccac

SEQ ID NO: 151064 - DNA, 562 bp, Homo sapiens
  misc_feature (544)..(545): n is a, c, g, or t
gcaggaagtaaagtgcagaaacacctccacccctgcacaaagagcacctaggagtgagtgcgcaagcgtggacaagccctgcggtaccgtgtacacacacacacacacacacacaccacaggcaagctcaggcagggtccttcacagacgtctgcagtcactctggaggtgacccaagcacctgggcccttagacagtaacaccactcacaccgagcacagaccagctcgcgcccacaacacgagcctgtgacacgcaagtctctgtttctgagctgatgccgtctggctttggccatgagaccctcgtgtgaccaggtgcgtgcctaagttagaatcgcccaggctaagttcgtgaaccccctggatgagggaggcccgactcccgcaaggagccctgcccttctgccagctctcaccgggccggattttcctgcggggcttttggattttgtttttgagtcactcattgagtgttggtcgcgtgccagacaccatgccacactgcaaaccatgtgcaacgttgttagcgcgtgctgtccggnntcctctagaacagctca

SEQ ID NO: 151065 - DNA, 489 bp, Homo sapiens
aaaaatagttaaggtgataaatcttatgttacaggtatctttccatattttttaaaaatagaaaaccaacttgttgggcattgttttcctatcacttctagaaacaggcgaggtgtaagaccagaaaaacgaggatggtaactggtcttttctcgtcctctctccattggcctgtcagcccctcacaaagggaagataagctacaggaactatccctgttgttaagcgatgaatgactgcattgcacttcctagaaaaaccttccaactatatagcatcacagaaaaaaagatgcctgagatttaaatttctgattcatagacaacttccactactttcattgacagccatgaaacgaatgaacaaatacaatgtacacaggtccaactgacccctcagctcaggaacctgccagaagtggcaacttaaattactgttacaggaggtcatggagcaaaaccatggtttcttagggagctcagttcttta

SEQ ID NO: 151066 - DNA, 473 bp, Homo sapiens
tccattggtgcgatcttaagagtcacatgacttcgggatgtttgaataaaaggggccttgacttggacctacagggcaggtaaaatggtcaacagtcgttccagctcttgctgctaaagaacagaacgtccctgtgaacacgggccacattctctcagcaaaccacaacagaaattgttcgggaaaagaataaactcaatccatcatgatttccttctgttttctgaaattctcccggcaagtcagtctgcatctgcaattctgcctgctctgtgagtgatcctttgcacagggttccagctccccattgtccaaaggtgtccctggggcacggtcctctcctaacccctggggcaggctggcttcccctttcatcccacagatggagggaagacgcacaggcgttcgtaacgggccagaagtcacaccacatgtggaactagattcacagccacaccaagattccttcctgc

SEQ ID NO: 151067 - DNA, 242 bp, Homo sapiens
ctgaagcggctccccttctccctctcccctccttcttggcccctccctctgaaagggtagcagctagggggacctcctggctggcctccgtgccatgcacccatgggcatctgccttcttgaccttggcatgggcatcaagaaatcactgggttcatccatcaggaatgtcactgaaactccagagtcctggctggtgggggcagggaggaggtgcgggagcggtggggggggcagaggtag

SEQ ID NO: 151068 - DNA, 502 bp, Homo sapiens
cctgatattattgtatctctgggattaagccttggttccctgaaattgcattcaccacaaactacatgtgcttttagctgctccagagaacatcctagcataatctggcacatcctctggacaaaaccctggttggacctagccaataagacagaagttactgctgggataatcccagttgctgaagaggaaaactatgtttatctatgcatactaatatgactgaaaaaatattttctttattaatctatggagaaaaatgtccctaacacagtctgggacaaaaatcactttacaaggttctttacaaccttcttctgggggaaaaaaaaaattaccattcctgaatagaaatgctgaagcaattttatgataaactttaattagattaagatcccttttgagaacttacttcccatatctccggctgcgtgtttgtcaggaacctgatggtattgaaagagatgtagcatttattatattcagtgaacacagattatct

SEQ ID NO: 151069 - DNA, 179 bp, Homo sapiens
atattctatgtcttcattttattcctgtctagtgtgggtcccaatcacctcggatctgggctgccaccatgaactaacatggctctctctctacatctaagtgtttcctctttgttaaatgctattatatcactacttgccaaagaagtctcaaaaacaaacagtgtaaaccactgaag

SEQ ID NO: 151070 - DNA, 263 bp, Homo sapiens
taatcagtgattatgtgccgttgtacttcctctgtcccgtattgtctgacgtgcattcgtatcttcagtgtttttggtagctgcatggtgtgtgacatagaaaagtcccagtttcctcgactgtgatttgggtgaggtctgtatcctttggtgcacagtggaattacaaggtcagaaggggatagtggcatgagatgaagctggagaggcagggcaaggttatccagggccttgttaccatggtaacaagttgggaagtttca

SEQ ID NO: 151071 - DNA, 273 bp, Homo sapiens
gtgaattctaggtcaaacaagggaaatccacttgctatttaccataaaaattatttttggtaatgatatcaaatctccatgtggtagacttttttttgacagatacgtgttatatttctttttattctgtaagacacattgttatatgtaatgcacatcatttctatactataccagtaagtctttcatagatttctaaagtaaccatggtgacatttttcactaggaaaagttgtagtaactcttagaacctaaattggtctagtgactgaa

SEQ ID NO: 151072 - DNA, 248 bp, Homo sapiens
ttactgcagagaaaatgttaattaagcacttgggcttgattagatcgtctttcttcagatacagaagcataaaatcacaagaatagaagggagtggtagaggagtgttttttgcataataatggacttggggttaggtaaatgtgagtttatgtctatgttattgctcagtttaggtggtgaagtcaaatatgacctgtagaacaataccctttgatcacagcctcagaaatatcagagacagatatg

SEQ ID NO: 151073 - DNA, 371 bp, Homo sapiens
gaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggagacagtgattcagcccagcaggctgtattcatgtgctgttcctctgtacacccagagctgtcttctcgctcatcatttattaatctttcccatgcaagtcatacgtgaatatatccttgtggtaaagttttcaggtgatagcgaaaactcagtc

SEQ ID NO: 151074 - DNA, 286 bp, Homo sapiens
attcactttattgtggtggtctggaaccaatccctcaatatctccaagatatgcctgcatgtgctttgacacacctgtgcttttactccctttctgatgttgtcttcatgccttttctatgccaatccaaatcagaagcaggcaacatatcttaaatgcctttttatcaatattctcaaaaaacagtcattgactaacatcctacatattcttttaagccttatttaaatctctcctcttccacagagccttccctataccctctacaggccacagtcatcactat

SEQ ID NO: 151075 - DNA, 352 bp, Homo sapiens
tacaggcactggcttctctaatcccccattggcccattctggctcattcatgtaactgatatttattttgcacttagcacttgtgagctgtgcgcacagtaagaactacagaggcgaagacttggtctcgcggagcccatgtgctggtagagaggctgcatgggcaaagccaatggtattggcgtcagggacgctgccgtaggggaaataaggttgggtgagaagaaggggccaagtgttgccacacagcggccaggtggcttcctgcactgagcgatgttttaaacgcggtggagccttgcacacctccagggacagcaagagtctcaggggctgtggttggggtgtgagg

SEQ ID NO: 151076 - DNA, 334 bp, Homo sapiens
atttctttctagttagctattcatgtacattttaaagctcgccacacaaagtcattacattgaggctattaacatgtttaatagtgacaataatagggtgtgacccatggcatataaccgcattcagataagaagaaagagttttcttttttcttcttcctgtaattgctcagtcaataccattttcacggaaatacttgcaaacaaacttttaaaaagttcattgtccaaagccttccctgattccttgtttccttcctcttcaggggttctataaacttttcctgatcagtggccggggattagcgagatggtgcactctgtcctgattttg

SEQ ID NO: 151077 - DNA, 391 bp, Homo sapiens
tgccacaaagaaagagacatacaaaagaaacagcccagtggtaagtacgtttgaagctcacaacatatctctaagttacagaggacaggtattttacacatgagaaatggtcccaaacctaggtctttttgttccttctgaacgatttcaccccctgtcaatgagaagaaatgcagagcaccctggaggtcaggaggaggaaaagaaaaaagcagaaactttgacctgctaattgatggaatcaagtcagacaaattctaatgtggccacttcttttcactgccatcatggaaacctaaagccctgggtaggttccttgccactgccctgtctatttctagaaacatgaaagacctgggctaatgtcctacctgacagccattagctgact

SEQ ID NO: 151078 - DNA, 639 bp, Homo sapiens
agttctaccatccatgaatgcaagctttgctcacttttgaattttatgaaggaaacaaagaaagacattttcagacaaagaagacaaagagtttacgaccaggagaagcttgctaaagggaattctaaggggcatattttaaaaaaagaaaaatgatcccatatggagagccagaaatgatgatggaatgaagaacacaggaagctctaaatgtgttgataaatctaacaaacattgactgtataaaacaaaaataatgatgtctttggggattaaaaaataaatgatagaaatgtaattagtttaatctctatggagggaaatttagcattactgtacttatcaaaattacaaatgtacatatcctttgatttagcaattccacaaagaattgtaggaatttatttgaaggttgagtatttcttattgtaattagtcttcacattgttttgactgcaggcaaggatatttcagatatgtgagcgcttactggaaccaacgaaattcttaagttgtataattcttccaaattctttgataattcctggttcaatctgtgtttacccccactaaatttatgactacttctgtttctaaatgctttacaattgaatcacaattaaatgtaatgagaagatc

SEQ ID NO: 151079 - DNA, 361 bp, Homo sapiens
ggagtacttgctcttctgacctccaagcaggttaggggaaggcctgtcttcatggtgggggtctggagtacaggtttggatggtgcccacctgaaggacagaggcaaggaccttacttggccagtcacaagtaaggatggggtgagccttgggcagctggggagcccagtgctcttcaaacttgaacatacagcacacaggtcacctgggaggttgttccagtacagattctgactctacaggggggtctaaaaccctgcatctctaacaggctcccaagtgatatggatgctgcttgtctagggaccacacttggaagaacagggcaccggcccatggccctgcctttatccgagatgag

SEQ ID NO: 151080 - DNA, 287 bp, Homo sapiens
gctgcaaaaagtatttcccagaagctaccaagctagaattttagtgagtgaagactaaatgaaaggattcctacaaataatcagctgagtatggatccttcaattcagatttctaatttagatgagtggatccctctgtgttttgatcaatattctcattttcataatgggctaaagtgtgactataatgattttcagacatctaccctgatttgaattttatgaaaattgaagatacagtagagttttctaaaatcaagtgacagaagaaaggcaaccttaccgat

SEQ ID NO: 151081 - DNA, 701 bp, Homo sapiens
gtgggcggagagcttgagcccaggagtttgatactagcctgggcaacatgatgaaaccacatgtttacaaaaaatataaaaactaacctggcatggtggcacatgcctgtagtcccagttagtctggaggctgaggtaggagagtcgcctgagcctggggaggtcgaggctgcagtgaaccatgatcgtgccactacactccagcctgggtagcagaatgagaccctgtctcaaaaaaacaaaaaaagatattttgggacacatgaaaattatataaaattgagtacttgcaacaaagacttcatagcccaaaatatttactatccacccctttacataaaaaaggttagcaaactcctcatctagatggttctgtctgcctctgtttgcctttaggtggggagagaccattatcagctcacgtcctgagctctgtcaaacggtgcttctaggaataagagacacatttggaagtgtgataggccagagagacattttcaggagctacaatttagaaccctggccctcccaagctggaaggaccctcataggttacatgtcctgctcagaggttcccacatgctatccagaactgatccattcccaccagctcatgacaaaatgataaaaataaggcaattctataaatcagtttatgtaaactaaattctttccatttataaaaccaaacttttactctg

SEQ ID NO: 151082 - DNA, 398 bp, Homo sapiens
caaggattacttcaaattttttgtcctgagcaactgaataaatggtgatgctgttaactgagatagactagtagaagagacaggcttgggccccaggatgggaagtgatgcaagagttctgtcttagatattttacgtttgagttaccttaaaacctccaagtagaaatgtcaaataggatttatgtttctggaggtccagggagaagactggggtgttaaagaggactggggctagggtaaggcaaacaaggtgcctagggtggaaaaggtaaggtggtagtcaccctccagggccagtcctgcacttgcatgggcctgataaagaatgtttccttaaactttatgtgctaagtgcctcaatgacctctccctagtcctagccctagtatttaaacc

SEQ ID NO: 151083 - DNA, 615 bp, Homo sapiens
ccggccgcgctccgaacggcgcctcccgccccaccatgggcaacagcgcgagccgcagcgacttcgagtgggtctacaccgaccagccgcacacgcagcggcgcaaggagatactgggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggacttgccctggaccttgagtgtggccctccctttctgggcctccccaggtgaggcctggccctgccccaccatgacctgggtgctctgagcccacggttcccacggagctgacttctccggggtgcctgtgccctacattaaacccggcgtttgtttcacagcccatgga

SEQ ID NO: 151084 - DNA, 1357 bp, Homo sapiens
ccggccgcgctccgaacggcgcctcccgccccaccatgggcaacagcgcgagccgcagcgacttcgagtgggtctacaccgaccagccgcacacgcagcggcgcaaggagatactggccaagtacccggccatcaaggccctgatgcggccagacccgcgcctcaagtgggcggtgctggtgctggtgctggtgcagatgctgacctgctggctggtgcgcgggctggcctggcgctggctgctgttctgggcctacgcctttggtggctgcgtgaaccactcgctgacgctggccatccacgacatctcgcacaacgcggccttcggcacgggccgtgcggcacgcaaccgctggctggccgtgttcgccaacctgcccgtgggtgtgccctacgccgcctccttcaagaagtaccacgtggaccaccaccgctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctacacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggacttgccctggaccttgagtgtggccctccctttctgggcctccccaggtgaggcctggccctgccccaccatgacctgggtgctctgagcccacggttcccacggagctgacttctccggggtgcctgtgccctacattaaacccggcgtttgtttcacagcccatgga

SEQ ID NO: 151085 - DNA, 1354 bp, Homo sapiens
ggccggggctgaggctctgtcagtggtaactggtaaaatccaggaccaaactgccagagccacaaggggatcctggggctccatctcccagccacagagctgcccggctgcaggccaagtacccggccatcaaggccctgatgcggccagacccgcgcctcaagtgggcggtgctggtgctggtgctggtgcagatgctgacctgctggctggtgcgcgggctggcctggcgctggctgctgttctgggcctacgcctttggtggctgcgtgaaccactcgctgacgctggccatccacgacatctcgcacaacgcggccttcggcacgggccgtgcggcacgcaaccgctggctggccgtgttcgccaacctgcccgtgggtgtgccctacgccgcctccttcaagaagtaccacgtggaccaccaccgctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctacacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggacttgccctggaccttgagtgtggccctccctttctgggcctccccaggtgaggcctggccctgccccaccatgacctgggtgctctgagcccacggttcccacggagctgacttctccggggtgcctgtgccctacattaaacccggcgtttgtttcacagcccatgga

SEQ ID NO: 151086 - DNA, 640 bp, Homo sapiens
ttagtttgtaacttcaagacagagatggaacatatcaattgtgagaaataacattgattttttatgtggagaggacatttattttcaggctgcaaagctcagttttgctgaattaaaaaattgtgcttcttttatttcctaattgtcttagttttgtttgtcttattatgtgtatttcagctgtgtatgcatcacagccctcctttttgctgtgctgtggctacagttttctcactgttctcttcacaccatgtcatttcacatggtatattgtaggttttgatgagaaatcggtattttaaatgcactgcaagattggttttaactggagattttgcatatcaatataattttctgatcagttaaattaaaacaaaaagcatacagtgtccacagatgaaaggattaaatcatttagcgttgtttttctctgtttgttaaagaataatcttattaaattcttacacaaagtgtggcaaatataaaatttgcttgaaaatatatcttagaaattaaacttttaatttaattttctacagtatacttatgccacaatgtacgtttccatgcaaaatcttctgtttgtaagtgtgaacattaaacattgcaaaatagtaaaatgacctctgtgattttgaaa

SEQ ID NO: 151087 - DNA, 334 bp, Homo sapiens
ctaggacactaaaatgagggatcaagagtaagggaaagacaattccttttcacatttgcctgagttagaaggaaggtttgccatacagtcaggtgcagaactagtgcagtcccacagtgtacggtgtaggtttaggaaggaaaaagtgcagggtacaccgatgactattgttactagttaactggcgttagaggtggagtgttgtcctaggatctaggaactagactaattggaagttgatgagggaagtgttggtcataagatgattaccttttaatgcagtatatatggggcatattatgtaaatctgtcagatgcagcagaagaactgggg

SEQ ID NO: 151088 - DNA, 286 bp, Homo sapiens
gctaggtgttaccccattttatgtgtgagatatatgaagattgctggacaaataaatgcccaagatcacacagtagtaagggctgggtttattcgcaagtcctgttttgttttgtttttaatctacctttctgaagttgctcaaacaattgaagttgctaagggaaatcactatgtatggtgaagatttaaatttaataggcactctaataataaaaggtgtaccagtgtaagcagactagggaaatgatttcactttgcttagggaaaagagatggaggtttagg

SEQ ID NO: 151089 - DNA, 354 bp, Homo sapiens
gtcgagccggcccccagtttacaacagcttagtgtgacagcagacaagagacaagtagaggaagtggcaaggattcctgcactgtattattgtgaaatccacccagggctagcctacaaatgtgaagacaggaaaactttataggtctcgctgctcttttatgcgagcagatttccaggcacgatgttgttcacccatctataacttggccccaaagtgtgaggaacatatgaatttttttaggcggtcctgagttgaaatatctaaaaattatatttgcattctattgccatattatagactggtgatacattctatacttggtaacacaatttcatttttaaaaaaattttt

SEQ ID NO: 151090 - DNA, 623 bp, Homo sapiens
cagaggtccaaaatgggtctcactgagctaaaatcaagctgttggcagggctgtgttccttcctggaagctctaggggaaaatctattttcttgacttgctcagctcctagaggctgcctgcatttcttggcttgtggcctccttccatcttcaaagccagcagtggctagtagagtctttctcagatactgtcctgggttccggctcatctgcctcttccccattcaaggaccctcatgattatattgggctactcagtccaggataatctctttttgagtccgctgatgagcaaccttaatttcatctgtaaccttcattcccctttgccatgtaacaaaacattcacgggttccagggattagggtgaggggcatcattctgccaaccacacatgacccagcagacagaattaggatgagactggaatgtagtccagcagggcagagaccaagcctagtcctctgttcacctctccatgccaagcatagtttacaggcgctcaggaaatgcttcttgaagaagtgaataggtaggagtgcacgtctccttgtaccaacttgtctgaaatgtgtgttgaaactagagccatagaatgatggccaacgaggtggctggaggc

SEQ ID NO: 151091 - DNA, 516 bp, Homo sapiens
tgtattctgcacccctatgtggtagccattgttgcaggccctaggagactggataaataagagaagtccctgcctacatggaggaacctatctcaatggactctgagctctacccactaggagttctcctgcagtccaacagcaatactctccctctcacacctccagcactgacagggcttccaattctagacaaaatactacctggcccactccaatggcctgctacaccaggacctcttcagattggagcagctacaagcaccactcctcaactgagacccctccacaccaccacagcccaacatcgggacctttggataactatcaccgtcccctaggagagagaaagataagaatagaaggagggagggaaggggggaacaaatagacgatgagtggatggatagatggatggatgatgggtgaatggttggatggatgatggatgaaaggatggatagatgatggatgaatggatagatgatggatgaatggatggatggatgatgggtg

SEQ ID NO: 151092 - DNA, 322 bp, Homo sapiens
ttctgtcctcagaagcttcgcacccacctcccaggccaatgtctcctccgagttctggctcccacgcctcacgctcttcaggaacttcttcctagccatctctcatcattcctcttttctactacagccgcccaactaggcctacagatagattcgaatccttctagtctaacccttaaaaaaggaaaggatgggaagggaaggaggatggggatgaagagaggccctccttccttctcgagtaaccgcatttccttcccgtgtccccatgctgccaatgttcctggaacagcgtctgcatggggagcagcagggaaagaca

SEQ ID NO: 151093 - DNA, 229 bp, Homo sapiens
actgctttctccttccacgtaagcagtcttttaaagaggcttttctcacttttagagggtaggatgaatatgactgttatcctttgtgaattaaacactcttaaggcactttggttcttgagctgaattattctaaccatggagaaatctgaattgctgaaatacagatttttcgcattccagaactatctgtcttccattatttttatttatttacttattttgagac

SEQ ID NO: 151094 - DNA, 340 bp, Homo sapiens
tggtatgagatggcttctaggcacggccgtgggcgggtctcacgtcagttgcgtgtcgtctgaggaaagttcttctgcagctacggctttgaaagcagcatccccgacgcagatttccccgaggcagatttcaccacagcagatttctgctgcctccctggacatggcctctgtaccctggacctcccgagctgcctctccccatctcctctctcaggtaagcacgcctggacctctctgtgacctcagagctcccttggctgccaactccgggctgtttcctttgggtcttcagcacttgggcccattgctagagcaccccgacatccctgaacacccc

SEQ ID NO: 151095 - DNA, 156 bp, Homo sapiens
acatagataattaataaataattgattaacagatggctgataggttgataggcgtgcacacgtgtgtgtgtgtgtgagtgtgatttatcactctagtttaaattatcttactcttttgctcttgtttcactttgcaaagatttctttgtttctcat

SEQ ID NO: 151096 - DNA, 132 bp, Homo sapiens
cacaacatacacagtaatgcatcccagaggaaggaaccagggatgccacttggagaactagttttcaactgaagttgtttaaactatgtgatcactttatgcctccagggaaatgaaatcccatcccacaac

SEQ ID NO: 151097 - DNA, 256 bp, Homo sapiens
gctgccggaaggatcagttcctgtgtcatctcctagcagcttgggcgaggcgcggtaccgaaggttggagcgcagcggagccccggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatgggga

SEQ ID NO: 151098 - DNA, 830 bp, Homo sapiens
ggcaggttctaggggtagttggaggattctgggtacatttgtcatggaatgaggcaggttctaggcaaggcttgggggaactagtggcatggggtcagggagtgaggtcagttatagaggaggctcaggaggatctggggaaacgggaccatagggtaagatgggttatggagatggtccagggaggcttgaagtaccaggctcactggctggaataggacatgaggctggacccagaggccataaagccatgggtcacaggtcaggatattgggtagcatcagagggcgacacgaactccaaggatggtccagagcgagccagggaaaccaggcttgtggatggggcaggacctggggtggaacctgtgatggctggaatgccaggcactgcaggtggcatggcacacagagacagcctcaggggcacaggggtgctggggtctcagggagggcgacagactctttcagatgagcgaggctccaccaaagatcttgggggctatggaacttcagggatccctgaggcctcggaggctgctggtgccaagggaaaaccagatgtcaaagaatggcaagacagttctgggactccagggtcttctagagacagaggggctcccagggtgaaggataggtctccagaccaagcagggataatgggggcttctgggtttcttgatggcaagggggcagtggaaggtgagacctgggcaggaatggctgctctagggtctggatatgaacgggacatctggaaagcaggcccaggaatgacagacaggggtagagttgctggccagggggggttggcatctcagggaggtgggg

SEQ ID NO: 151099 - DNA, 470 bp, Homo sapiens
ttgggagtgaaccttgtttcccttccttcctctgtgatcttccttcctctttaatgttgagtagatggtttttttattaatatcccaggtcagtggtctgtttaaattccaggcaaccaagcaaaaagacccatatagctttccttactaaaatggctttctgctgctgtttgattaaataatagagaagttgaagggtgtgctgatgatgaaaagcatctccctgagccttcagaaggaaccgagcatacaccccctccccccggagagcctccctcccctcagcttcagctggagtgcatttgcttctgttgagctgcaagttcctgcaaagcagaaacattcagatgattttctttggcgagttttgaaagcgctgatgactgagctgatcttttggatcatgaacttcatttggagggggttactctttccctgttaacttgggctgtgaaatgatcaaagtgctt

SEQ ID NO: 151100 - DNA, 541 bp, Homo sapiens
atggggggcgtatataggttcgtctgactagtctagataagtgaatttgtgtagtaattgtttttttgtaactggcttagtttacttagcttgatgtcatcaagatttattcatgttggagtatgtgtcagaatttccttccttttaaaggctgaataatatatccattgtatgtatatatcactttttgtttatccattgattcttccatagacattaggattgcttccaccttttggctcatgtgaataatgatgctgtgaacaggggtgtacaaatatctcttaaagacccctcttaaaactttttgcgatatatacccataagtaacagttgctatagaatcatatggtaattctgtttttaattttttgaggaatactatactgacaaatttgaatccttatttaaacccaggattatggaatactgctgcttgatttcagctgtcattttgttgtctacattgtattttattgaattggcgttattcccaaatattggaaaatgtggaggtttctaatttttgctactgtaaata

SEQ ID NO: 151101 - DNA, 329 bp, Homo sapiens
cccaggagcaagacccagccctttatggttacacagaagccatgaggacagtcacaccagcttggattcccatacacaggatagtctgtcttcctcttggaggcccctgccctgtgccggtgggaaatcagaaacatggctactgattgcaaacgtgttaagaagaagaaaaaagcaaatcagtatcccaggcacactaaggtgatgggcttgtacatcagttcttcagcaatcttatgaaattagctaaagccaaacttccaggcacagggaaaacggaaataaaccctccaaggtcagatgcacagggcttgtcctgcctgctacaa

SEQ ID NO: 151102 - DNA, 457 bp, Homo sapiens
caggcagatttcacagtccctaggcagctattaagctctaaatatcaggcatcttgacaaagacagctccaaacttgccaacaaacccacattccaggggcaaaggatatcaaatatcatactatttgtttaagttgacccctcttcgctatctgaatccccacactcataaccatggatgaatctgagtgctgcttcttttgttcagacggaatttaaaaatcagttttagagtgagaaatgcgcaagcccatcccatataggcaggtccttttccccaacaggtatgccctccttttccctggcctcctgtcttctcagcacttccagggagccacatgctcactgagagctgtctccaccccttattcaacgcacctaaaacttgacagtctgagcagatgggggaagtagagtgattccagcaactgtctccttttctggagcaggaagctgg

SEQ ID NO: 151103 - DNA, 317 bp, Homo sapiens
gtgaaaccccgtctctactaaaaatacaaaaattagctgggtgtggtggcgcatgcctgtaatcccagctactcgggaggctgaggcaggagaattgcttgaacctgggaggtggaggttgcagtgaactgagatcatgccagtgaactccagcctgggcaacaagagcaaaactccgtctccaaaaaaaaaaaataaacatttatggagcaagcctaagaaggttcatctaaactgtcctctgcccagcccctgcagtttgagatgagtaaagggcttgagttcaggtccggacaggcctggggagggcaagggca

SEQ ID NO: 151104 - DNA, 203 bp, Homo sapiens
tacggtcgcaagtcaatatgttcctgctagtacacccagtaacaaaggccagtaagtggtacttgctttgtggctaactccaggattgatttacgggggaatggtatggtgaggtttcatcctacagaaatgtgtgatgagtcagggctaaggttcacaaaatcaaaggagtacaggggtcaggggaaggacatacattgact

SEQ ID NO: 151105 - DNA, 415 bp, Homo sapiens
acacatgagatggttttcacatgttctcaacaactgttctgggaaccaacagccctgtgaagaatgcggctgtccctatctcatagatgtggaaataggtcctaggatctgatgcaagtcttttgatagaccaactctgatcaataaagctttccccttagttcatcatgcgagggggtgggcatgggggcagacccctccatctgcaggattgggtttcatggagtggcctgggctctgggccaccccctcttctgaccaccattactctgctaccaagtccgtcccaaggattctatggcccgggctgtcgtcacacactgggtaccggcattcttggtctctcttccagagtccctccaatgtgcattcctcagtttatgtaataacccttaccctctcacagtgctttaca

SEQ ID NO: 151106 - DNA, 416 bp, Homo sapiens
ggccggccccagttacaacagcttatgaaccatcatggcattttgctgctgcctctaaaacatgggaggctaagagacccagctactagggtctttgagaggagattgtgatgggtttcattggatttcagaactgaaaaggaccattgtgttcattcggcctcacctcttacctagtgcctgaaagtctcacaatgtccccatcatgcttaatctctgcttaaagccacttgggacttgccccttagggaaactcccttagacctcttcttccctaacttgagctctgatctggctcccgaactgtctcctcggatggaggtttgccctccgaagccatttcttttcagcgtggactttgcctgcagaagagccaacacatttccatggcaggaatgggttcagcatttcaccac

SEQ ID NO: 151107 - DNA, 329 bp, Homo sapiens
tgttgaaaagattatcctgtctccactgaaatgttttctcccttgccaaagatcagttggctgtacttgtgttggtctatttctgggctccctattctgttccattaatttatttagctgataccacactgccttgatcactgtagctttatactttatagttagacttgaagtagggtagtattagtcctctgactacttctttagtattatgttgactattctggatctttttcctttctatacaaactttagaatgtttattgatatccaccaggtaactttctgagattttgactgggaatgcattgtatctatagatcaaattg

SEQ ID NO: 151108 - DNA, 375 bp, Homo sapiens
cacattgcgggtccgtgaattctagagggggtcacagacatttagtctgtaagagtaatggtgcccacgtgtcaccagctcactactgacgggcccttccgctgcggacgtgctgcgtgtgcgatgatgatatggttgtgattgccatctgcggttcccttattacttctgaggccgagcacctttctgtgcatgtattgggtggctgtttgtgtgtcgtctttggccatgcgccagtttgggtcttctgcctgtttttcttcaggcttgtctgtttcgtattgatttgtggtcagtccttgtatacttcagaagcaagacctttgtcagtggtgcaggtgtgcggatgactgctcccacagcgtggtttgcctt

SEQ ID NO: 151109 - DNA, 284 bp, Homo sapiens
ttgtcagactctttgccacatcctggatgtatgtttcaagaccacaaacccacccagttgcccggccaggtctgagcccattagactttacaaactaccttgatgagtttcttcctttttgaggaactagcatcattccttcctaaagtatgatcttttaaattattagcagtcagcataaaatggtcctatgtcatcagaaggtttgacatttctttgccagaaggcactctgctgtgctttctctacccatctttcctccagcgttaccttctcgtcttcta

SEQ ID NO: 151110 - DNA, 337 bp, Homo sapiens
tggataagtaaatgtaaggtgttctccatgtttccattagctgaatatccttccaatttgtcactttgaagatgacagtccatctggaatattagaggaaaggctggatgccccgttgatctactgattgctcctcaacccgtatttctactggtgattttctctatgtccatatgcaggtgagcttctactgatctggaaatgccatgtccttcactgacacactggacaagaagaccatcagtcatatgcacttgacttctcagaaaacatgagggctgcctcctgattgcagccagcagaaagtggtagaaagaagaagactttgaaatgagac

SEQ ID NO: 151111 - DNA, 396 bp, Homo sapiens
ccaagtaaacactgcttgatagtttagaattccaaggggtcccagccacaaggagagtctcaatttactcaccaactttttcccacaagccttcattcagcgctcatgtaaaaaaagtagggacaagtgtaacaggagggctgagggagactccctaagatacagatgcacagagcctggtgaaaccttagggcagcagagaagaactgagagtaacccctctaaggcactccaggctctcatggagaagatggcagccacgggaggatggctgagaaagaggtcctcaataccctctctgtcctgccaatgataggtgtagatgaacacctagtctgatgaacacctaggcaaatggcaaaacaagtgaatttatggaaatcctctgagccactc

SEQ ID NO: 151112 - DNA, 316 bp, Homo sapiens
aatgagccgccccgcttactgccccatggggcgggggacgggaatacggcaaacagtggtttctcatcagcacctggaacaggtgcaaagggaagcctgagcagggttggcatcgcaggccgtgtgtgtgtagaaataatctttgtctgtgcaagctgggcgcacgttacaggaagaagatcctttctctaaattgccaaagcaagaagaaatatttggagttacataagaaagctgagctcctggcctcttcatggccctgtgactcccaagtccctgggtgcattgccacacaaatattgccggaagtagaaaa

SEQ ID NO: 151113 - DNA, 209 bp, Homo sapiens
aataaactgcaaaatttgacatattcatcatcatatagtaagagctttcaacatacctgtctcctttattgacaaattaagcagacaaaaatttaaaaagaaatagattttggctgggtgtggtggctcatgcctgtaatcctagcagtttaggaggctgaggaagagtttgagactagccagagcaacatggtgaaaccttgcatcta

SEQ ID NO: 151114 - DNA, 175 bp, Homo sapiens
ctgaaggttctttcctttagaatcacgtatttagttgtcttctagatacatgggacatttttctttttcaattttaacatgttttattgctttgttctgattataaacccaaacaatgtgtgtgatggtgcaattctttttttttttttttttttgctttgtataaatctcttgc

SEQ ID NO: 151115 - DNA, 340 bp, Homo sapiens
aaaaagacacttaattgatgaaagttaataccatgtaacttgaattttctagaaagagttcttaatttcaactcagactcaaatatctaaaataatgatggagggaagtgaagtagggggatactccctgaataggaagagattttaatgggaagccctgagcatgacagagcctcatggaaataatcccgagctgactaagtggaagtaagtcctgtcctcagagaattctgcagagagtcagtaaaaacaaggacttggatgatatccactgtgtaatatgtgcaggtgtccagtgaggactgtggctgcacgaggttgaccatcatttatgctaatc

SEQ ID NO: 151116 - DNA, 391 bp, Homo sapiens
gagtcagtaggctgggcatagcagttcaggcctgtaatcccagctactaggctgaggcaggagaatcatttaaacttgggaggtggagactgcagtgagccgagactgcaccactgcactccagcctgggcagagtgagggagggagggaaggaaggaaggaaggaaggagggaaggaaggaaggaacaaaggaaggaaggagatggagtccatgaatactaacaaatcttttgaaaggcttgactaggaagaggacagtaagtggagtgacgcatgagatcatcagtggagagaaagggaagagcaagagagagaagtgaatatacaagacaaaaaaaggggtaacaggtgaagaacacaatgggtgggatttacattagataggaagac

SEQ ID NO: 151117 - DNA, 578 bp, Homo sapiens
ggcttctgttcgtaggtccctattacatgtttccaagacactggatttgtcagcctctttctttggcctctcagcttcttcagactctgggggtaggtttccgtagacctgtccgctgcacattattattttaaatgtttttaggcactgtgtaaaccaaataacacatgcctgtctgtgggctaaccagaagctacctaatctagtccaatcaccccatcagagaccacatgacctgccctgacagcatccagctatatctacagaatccagactagattccatttccccaatccagttctgagtgttccttccactccaactctcctgctttaccatttaatggtacatcagaattatctgttactctacacaataaaccagctacctggactgcttcttttaactctccccagagaatgattttaactaaaaatattaacaagtgatccgaaaaaatgggaagaacatatttgggttcttcaaataaagtcatcaataatgataataagaacaaacccagagaggccaggtgtggtggctcacacctgtaatcccagcactttgggaggcggagg

SEQ ID NO: 151118 - DNA, 344 bp, Homo sapiens
atgtttgaaactaaaattgccaggtgctttctttacagtgtccctaggacttaaaggattaaaggattgaatctgagcttatggaaacccaagaaaaaatattcagtagtctgtgtcattcgttatataaaaaaatgcacatcaatgcagaaatttctactccgttctgttatctgaaaagtcacatgccacctgtttaggaagtatctgattgaaaaaaccaactgtgcatgcttccctagagtcccacataagcccacatgaagagcaactagaaaaagacaaaagcaatggccctttcttggcagcaagtcagatctctccgttttaactagctgcttgga

SEQ ID NO: 151119 - DNA, 393 bp, Homo sapiens
aatctgaatttgtagacaatggaaattctctatacattgattccgctgtagaatcatttgcgtgaaagtccatacacactcacacacacacacgtacacacactcacacacacacacaactttacttttggtgggatttttgataggaaatggaaaagagatttaagctactagctttttcttatctgaagatagctgcttctctggttcttattgttatactttaggcaattagatatatagattccatatttccttacatcacagatgacgattcaatctatataaccataggaaagggaactggttaagttagagtatataaaacaatagaataacaaataatatttagataaatgaataatgcaggtgcgaagcactatttaaataaca

SEQ ID NO: 151120 - DNA, 334 bp, Homo sapiens
agcactgctcctcggactccacaccccaggtccagaatagtcagggtggctactctaggactaatctctcttcctatctcctggtaaaatggttttagcagacatttgtccctggcagctgttagtttcccctctcatcactatattaagacatccttggccaagcatggtggctcatgcctgtaatcccagcacttttggaggctgagacgggagaatcactggagcccacaagttcaagaccagcctgggcaacacagggagaccttgtctctaccaaaaataaaataaattagccaagtgtagtggtacatacctgtgattccagctactt

SEQ ID NO: 151121 - DNA, 449 bp, Homo sapiens
tgtactgaattctgcaggcaattgtaacacaatggtaagcatttatgtatctaaacatatctaagcatagaaaaagtacggtaaacgtatgctattataatcttatgggaccactgtcattaagcaaaacgttatgtggtgtaagactgtatttttaaagctgaagtaaatatcagctcttcagaaaatattgtaaggctattctatggaatttatctcaggttttaaacccagggatagctataaagagagtttccttacgtctggagattggatctgtgcagtgaacagctcttgccatgcccattcaatctttctccaaaaagctacatgcaagaaaggacacaaaatccttcattcaactagtttgcttttgcttggcttagattgtgatctagttgactcaaataatagaaaaggaattgataatcatatagacttggtctgtt

SEQ ID NO: 151122 - DNA, 410 bp, Homo sapiens
tgtaaatagaatctttggtttatttcatttaaagtgatgttttgatgatgcaactattttacaacattttttcatttctttttattgctgataataatctgttgtatgaatataccacattttggttctccatttatcagttgttgaacatttgatgtgtttcctttttttggtattatgatcaataccaaatgttgctatgaacatttgtgtactagcttttgtgtgtgaatattaccacagttctcctaagtatacattcaggaatgaaatagctgaattatatggtaactctgttgcagttttgaggatctgccaaactgttttccaaagtggctgcattttccaattccattaacaatgattgaagcttctgatattttcacccctctctctctctctctctctct

SEQ ID NO: 151123 - DNA, 434 bp, Homo sapiens
tgagccagcacgcccgccctagatgcagatttttaacttcaactgggccctctgtgtcacttgataagtctcttcttccattagtcagctccctcttccacttctcaaaggagttatacctaaccttcagatacctactttatcacaacacattaaccactgcttagtgtgtatcacctagatatcgcatgcttagttcaaattcaacatatccaaacactaaacttctatcttccatctctaaacgtctcctcctgtccccagccagacaatggatctctccctctctgcactctgtccctatccaatcactcagccctgtactttttacctcctaaatatctctggcatccactgctgcctttccatttcacactgccactatcatctcttaactggactataacaggagatgatagtggcatcgataaaca

SEQ ID NO: 151124 - DNA, 433 bp, Homo sapiens
tcacgccatgtccacaatgctacagttatgtgcgtatgtctctgtgtcagactcagagtataatgtatccatgattatacatgtctgttggggagcgtgtaacagtatatctgtatttttctgagggcatgagtctgtgtggaagcagctaccaatctgtgtgtgtatctgtcaggtgtgtctgttcagttctgtatatcttattttgtttgcatatgcacatgtgtgcatgcagatgctctcaggtgaggcacctgaccaagcataggccttgttccaagtggggaggagccagagtatctctgggcagtgtgctgacattaccacaacctgtgagcctttggggtcgcatcattgtggggggggactggagagagaataccaggaccaaaggacccagtcacctccttcagagtagatcctttatccattc

SEQ ID NO: 151125 - DNA, 243 bp, Homo sapiens
tattgcctcacctcaccttttattcacatctcatatcattgcaatcaggcttctgcccataccactcccctgaaacaaatcactgatgacctcttcacaaccaaattcaaggaatgctttgcaatcacctgctttcttgatttccctttccaggcttcctcctctccaaaacgtggttgttgcagagttggcccagttttcattccacatattatctgtgggtggtttcaattatactacaga

SEQ ID NO: 151126 - DNA, 339 bp, Homo sapiens
gacaggttttacccaaggctgcaggccagtgtctaaccgtctctagatccgtcctggtttagcttcttccaaatagttttgtgtctgtgtgagagtgtgtgtgaaatggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagac

SEQ ID NO: 151127 - DNA, 266 bp, Homo sapiens
tggcacaagcaagtcattttagaaggaacacctactacatctctggacctcagagccgctcaccttcacagtgaggacttgaactggacagatttctaagttccctttgcaccttgagtgtctctgaaagccctggcaacaagtgaggaattacgctagataatgaccaaactctggtgttcttgcttaactctgtggctttcagccctaaaagcaccaccacatagatttggaaaagaaagcagaagatattttgctctactctt

SEQ ID NO: 151128 - DNA, 569 bp, Homo sapiens
ggaaacttcaccaccggggacatcagctgctgtggccagagaagagaacatggtgaataatgctttcataccttagggcagggcttctcaaacttaaacgtgcataggcatctcctggggagcttattaaattcacattctgattcaggaggtcctggagggcctgagatgccatgtttctatcaaccttctaggtgatgcccatagtgctggaccatgggccacactttgagtaaggagggcttcctggcttttgcccagaagtgacacatcacttttgctctcaaaagaattaaagcaagtcacatggccatgcccaacttcaaggcagcagataatataatccattaactacatcagggagaagagaattggaatttttgtgaacagctccaatgaagagcaaacaatgtgaagctaggatctgaattcaggcaggctggccccagagtctgtgctcttaattataactatatacagtcatgggtgttggtccattctctataaagagaatgcctgccaggcagacagctagtcagggagttacagttgacttgtgtgacttgaca

SEQ ID NO: 151129 - DNA, 359 bp, Homo sapiens
aaaaaacctatggctttggaaggctttctcggtaacgtcctagaattaaggttaagcctgcgtttcctgttaactgaacaggaaaccagcctgaccaacatccttctgcccggtggcttgctctcagctcctcttcgttgggccttgggcagccagactgtctagttttaatccttgctctgccacctgtgaccttggacaagttacctaccttcagttacctcatctacaaaatgcagatattaataataccctctttttaatttatccagaggattaaaagagttaataaaaagtaaaaaataaaaagacttggtaagcataggcacagaggaaaaaaaagtaaaaataaataatta

SEQ ID NO: 151130 - DNA, 874 bp, Homo sapiens
ctttctttctttctttctttctttctttctttctttctttctgtctgtttctctctctctctctctctctcatatatatatatatctggctctagaaggaatttaataactcacatttagttatcagacattctggaaatttatagtcttaaattcaaatgtgttgagagggaaacaatgtaattttactatccttctatggtcatttatttcatttagtggtggaagacttgcccatagagatactgaacatactgctgctctcttctccttcaaaggtgctggctcaatgactcacaccttccaccagttcttatgttaattcctttccaggcttttgattgaagagcattctctaatagattttcaggaaagactcataggaacaatattccgtaagttcttgctagttatgtagcaagaactcagatatagcttttttaatctgtagcctttatacttgaaggtcactttagctttatcagatatatttgatatgttgattattttccccagatataagtatgtcctttccgtatgtcctttcaagttatcttttattttaggagagttttaaaaattatagtttttagtattttttgttttgttcctttggtcatttcttgagggactcctgttacacacacatgttggaccttctttgcctatgttacatattactttctcttgaaatcttgtctcctcatttttttaattctgtagtttttttcttaccatttcctatttctgttaaggcattatccattgtgtttattcattcttgtgtttcttgtaacttagtcttcatccctaaaataagttttgatatcttttctaagtttttcctgagtttgatcacctctattttcatatc

SEQ ID NO: 151131 - DNA, 767 bp, Homo sapiens
tcattttaagcaagtttttaataggaaatgtctctgagagcatgaaaaaaaataggaaaaggatgttatatagtacttaatccaatcctgtacctaatccagcacagaacatgtttatctatgtagtgttaacaagacatttctgagttgaatgggaaaagcttttgctgtgtgatgtagactgtagagagcctcttgtctgcctttttcctttttctgtgcttccccttgtcccggtgtgccatcttacctttcagtccacttatttggaggcttcatttggagcctttctcagttatccttagggcacctcttggctccttggggttggtttctgccccttaagaggtctctccaagtgatcaggccacatcacacagaccttctttttgcttttgcaacagtggtggtttttatctacaagactgttctcccacttgagacaatctgccctgaagcaaacagatgtttgcattgagatctcccctctagatgaataaaatcttcccagaggctaatgctggctaggaaaggttttttgtgcacctatgaagcgtaactgagccctgagcaaccaactttgatgtatattttgtgattgaggaagaagaaaaaatcaaatagcatttctttctgccaaactgttttttgcagataaaaatttttgttgactgaagactttatccaatgtgtgctttgtcctcttccattaaaaagagttcagttgagattgctttttcttatattgtccttgaattttgttctct

SEQ ID NO: 151132 - DNA, 205 bp, Homo sapiens
atactctgccctctactatcaaaaggtgatgtaaggagcccattaaataacacttagttataaacaaataagttttccgaaacaatcccgcagttaaaaggaattcctatgcagttttcagaacaataaaatctatcctttgtttaaagaataggtaattttaaaattgtatcctttatttaaagaaaaggaagcacagctaaga

SEQ ID NO: 151133 - DNA, 139 bp, Homo sapiens
ctctgagtctggctaacaacagggctcaatttcctggctgcaagttacagcagctctaggaagatgctgcttgcagatgcgtggttcataaatcaaacgctccccaattctagggcagcattgggaatgcttccgaggg

SEQ ID NO: 151134 - DNA, 356 bp, Homo sapiens
gccacaggtgcaatctgaatgtagctgccagggtagggtggcccttgagtgaacatcatctttatcatgttccccagtgatgtatccagtggtcttgggctttttagacatgcatctagaggtttccaggtcttctctggggtagagtccttctgttccaagttctgttctcaggcacttgtggggcaggcatgcaggaaggcacaagggaagtgggaggaggcgagattgggcacaagggaggaagccccttttttagagccctgagcctgagccccatcacatgtaaaccaaaaaatatctgagacaggcctcaatcaatttcgtttattttgccaacgttaagaatgtggttg

SEQ ID NO: 151135 - DNA, 242 bp, Homo sapiens
tgggtggatcgggcttcctgcggctgccacctctgaaacaatctaagttgagcatcatggagcatagttatcccaaggccaaggcattttccacactacaggagatgaaagccagtgtgactcacccagccactgtggaaatagaacagcactgaccacacacagtcaggatacagcgccaggatgggggcagtgccccagagggcagagcgcagcctcttacacagccacccacaactgtg

SEQ ID NO: 151136 - DNA, 467 bp, Homo sapiens
ctgggcccagtactacagctggctatgggaaagtacatttattcaccacgtgcaaataggcgaaaatgaactaaattgtcatactcttacctgccctgcatcatacagctttgccctagaacttgaatgtttgtccaactgttcgcttttctctagctccctatgctaggagcaaacttagaagcaagatttattggctgtgatgtgtccactgcaatcgtgtatgggtgctggcctgagtagagagcacttgccaggtcacctcactcatccagagacagcctcatggtggatgagtagttacaacagctttcaccaacatttgttgttttctgttgttctgttttgaatagtagccattctaatgggtatgagtggagttcagtgagtgttggcagatgtatatatccgggtacactaccccaatcaaggtaaagaacattttcatcaccccttgatgttgcctc

SEQ ID NO: 151137 - DNA, 580 bp, Homo sapiens
gctgggattacaggagtgagccactgtgcccggccgtctctctagttttactttgcaatgtcgttcatatccatcccctttctagtgccactgctgaagtcctaagtcactgcctcctaactggtcctcctaccctaactcctctctgaccagtcctcctgccctgacttctccctgaccggtcctcctgccctaactctcttccctgaccggtcctcctgccctaactcctccctgaccggtcctcctgccctaactcctccctgaccagtcctcctgccctaactcctccctgacctgtcctactgccctaactcctccctgaccggtcctcctgccctaactcctccctgaccagtcctcctgccctaagtctcctccctgaccggtcctcctgccctaagtctcctccctgacctgtcctcctgccctaactcctccctgaccagtcctcctgccctaactcctccctgaccggtcctccagccctaactcctccctgaccagtcctcctgccctaagtctcctccctgaccggtcctcctgccctaactcctccctgaccggtcctcctgcccta

SEQ ID NO: 151138 - DNA, 132 bp, Homo sapiens
acctgtcctcctgccctaactcctccctgaccggtcctccagccctaactcctccctgacccgtcctccagccctaactcctccctgacctgtcctcctgccgggctagtcggggggattcctctaagtaac

SEQ ID NO: 151139 - DNA, 424 bp, Homo sapiens
agggtaattcttctgataaagtttcagagggtccttaggcatttataaaaacaccatgttctatggtggcccatcctttgtacagtaacactggagggatgttgggggcagggtgagaggcatgtatcccaattgaatgaataaatgagtcttctatataaggcccaaggaaggaagcaatgcctagcctaattggcaaagaaagagatatgcccacttgtcattcttattcagaaggcacttctatgttgaaacacattaaaatacaagaataaaaatatcaaccgcccctcaactagctgtgtagtaccacaaaagcaagtatcaatcagtctgctatcacaagataagttctgtccttgattagtcaagatgaactctttattttcaaatcctattattaacgtatataaggatggaagcc

SEQ ID NO: 151140 - DNA, 387 bp, Homo sapiens
agggaattacagaatgtaagctccatgaggagctttgattttgtcaggaaattttgttttaacaagaatctttattttatcatttgctgatatgtgccaaagagaaatcaggaaagagaaactagaatggaaaagactggttctctacaggggtggggtagaaagaggtgtaaggcaggggaagagcagttgggttgacgagggaatgaaacctctgtgattatgtatttttgagtagctttgacttatagtcataggaatatttcatatacctaaaaataaacaacaatgaaaaccaaccaggttgtgaggggaacccaaactggaatacaaatactaacaaggctattgaaaatgaacaacataaccacaatgaggtgggtgtaa

SEQ ID NO: 151141 - DNA, 234 bp, Homo sapiens
ctccctgggtattaagattgaaagtggggagctctttaaccaagtaagataaaaaaatactaagtgacataaacattctactgagatacactttaaaaccacaagggaagagattgtctttaaattcaattgctcacaattctcatttgaaatgtcaggaaatgaaccttgagatggtgtcaatcaggcaggagtcagggctttccagctttatattttatgttttcaatgtgc

SEQ ID NO: 151142 - DNA, 826 bp, Homo sapiens
gattggatttaattgaacagttttggcttccttaattttattttgaagatagaatttaatgatttgtgtaggcataacagttacaattaacagtgattccgagatgagcgtagggtttaacttaacagttcacattttcttgggagttgaaaggactggagagttggatgtgtgtcttctttgtgattaaaaaagcatgctggaacttagctatcagaagattctggtggtccatctttgggaagaggaaaagattaagaatgctttgctagtcagtatttacaagagggtttctttacttaaaggcattttctctttggggaggggaggagttgagagttgtcattaatggaaggatcttagaataaaaaagatgtatacatgttttcctttggagtgaatttgtgactggagatggggtttcactgtgttagccaggatggtctcgatctcctgacctcgttatctgccctcctcagcctcccaaagtgctgggattacaggtgtgagccaccgtgtctggcctatgtgctttttaaagatggaactgatttagaatgcagtatattacagtacatgaaaaaattttggaatttctgtatgtttttcactgttggaaagccatagtgagtgtaataacagcattggctcctgttcataaggcatttaaatgatgtgtttcctatgacaggaagacaagcgtttctcattccttcaaaatttggctctcagatggagtgccctttaagctccctgaatgcagggacttcttctgtttcactcattgtcttttttctggggcctagaacagaacctggcaaactga

SEQ ID NO: 151143 - DNA, 847 bp, Homo sapiens
gcttgctgtttcccaaactggagctgaagaagggtgagaagcacttaatgggggaggcagatgtgagcaaaaagcttccaaaggctcagcaaccataaatttcctgctctccgttaaccagtcagctccctgggggctctagaaagttttctggggcccagctcacccagcagccagggtggacggacacctgtgggggtcacactgaggtccctgcctcttctctcctcctgcactggccacagcccagagctgagacatcagtcaagcagacctgatacccagggagcagggctgagagcgtgaccatgcgccacacgatgcacagcattatttctcgtggagtccgcacacagcctccgaatccttcttaatacggcccacaagcacattaacaactgggatgctagacatcaccttgttgctatgcccagaggaagctgagggtgcacaagctgggtgcctgtctgtggctttcagctgcccttcaacacagaactggccagggactgtgctggggacatggttcatagcctgccctgagctttcaaggagtatacagtctagtggggaaagagcagatggctggcttggaggaacagagacaaaaaaaggccatggggtgcctgtgtgcagatgaaggagggaatgggctggggaaagaaaggggggctgttggctcagtacactcaaactccgcagcccttgctggtgggaggaggtaggcccccgggggagctccgctttgggtagtggcaccagccctgtctgcagtggacggagacgagcacctgaaccttccatgactccctgccacactgcctgagcagaggcaaacaagaggtag

SEQ ID NO: 151144 - DNA, 516 bp, Homo sapiens
aatagatactttgaaacatgcttgttaactctaggaatgccattttttcttaagcatatgctcttcctctcctatgctttgcataatagtcctacatctattttcactttctgatgactcaatacgtatttatcagctgtctgtaatacgcagacacttgctttttctcaccactgtaaacctcaatatattttatacttagaaccttagatgttagaatttactcatagacagttaaattcgctggcaggccaggagttctgacaaagaggcagcagagagagagagctggacttctgtcaggagacccagttagagcctgggcttatccagtaaatgctaagtaactgttgggacactagcttcacacctctttgagtcccagtttctcatctgtaataagagtaacatgtattttcttgccagcctcataggatattatgtgactcttacatgaaaggtcttttctaagctctaaagtactgtacggaagtttattactgatttgcatatgtg

SEQ ID NO: 151145 - DNA, 284 bp, Homo sapiens
gctttgaggagctgctccatcagatgaggagacggggccccgagcaagcccaggcctggaccatcccggagtgcacgctcagtgtgcacacacacgttctcatgtacacaccgtctgcctttggcccatgtctggggaggccgggtcccctgggtgctgaagcccttccatgacccaggcttgggatgagggcaggtgggtggatgcagctgacaagagacccaggggcactggaaggcagcacacgggggctctggacatgcctcaccttcgtgtgtgcacgt

SEQ ID NO: 151146 - DNA, 507 bp, Homo sapiens
cagaatagaacatccctggggcaggaggcaggtgcattttgagctcttcctaaagtggactcctttgctttgcacttctcgagctttctccccgccaagagccttcatcaccacttagaacattgccatcttcctagtgcctccgatttctgaggcgagaggactgaggctgaaaactgcccggctgcaggtcaccctcaaggccaaaggtagctcctgcacctgtgccagctcctgcaaatgcaaagagtacaaatgcacctcctgcaagaagaactgctgctcctgctgccccatgggctgtgccaaatgtgcccagggctgcacctgaaaaggggcattggagaagtgcagctgccgtgcctgatgttgggacagccctgcgtccagttgtaaataacgcaacccctacaaatctagtttttttttaaacacaaacctaacccatttactatgtctgttttcttaaatgaaatatgggaatgataataaacattgttggcctta

SEQ ID NO: 151147 - DNA, 543 bp, Homo sapiens
cagaatagaacatccctggggcaggaggcaggtgcattttgagctcttcctaaagtggactcctttgctttgcacttctcgagctttctccccgccaagagccttcatcaccacttagaacattgccatcttcctagtgcctccgatttctgaggcgagaggactgaggctgaaaactgcccggctgcaggtcaccctcaaggccaaaggtagctcctgcacctgtgccagctcctgcaaatgcaaagagtacaaatgcacctcctgcaagaagaactgctgctcctgctgccccatgggctgtgccaaatgtgcccagggctgcacctgaaaaggggcattggagaagtgcagctgccgtgcctgatgttgggacagccctgcgtccagttgtaaataacgcaacccctacaaatctagtttttttttaaacacaaacctaacccatttactatgtctgttttcttaaatgaaatatgggaatgataataaacattgttggccttaaaaaaaaataaaatttaaagagaaatatcaaacgaa

SEQ ID NO: 151148 - DNA, 180 bp, Homo sapiens
ccaaagggctaaaatgtggatatacggggtgactgcaaaagaacagcaaaccctgaatgatgatgaaaccagacagaaggaacccgggtcctttgatgacatcatggattcaatttgctctaattccttggattgcctaccagttcagacttttacttcaggaagaaactttccatgtcc

SEQ ID NO: 151149 - DNA, 277 bp, Homo sapiens
caaaagctgaaaatatttactatttggcctttcagggaaagtgtgccagcacttgtcttacagcatcactgtattacagtgcagtataataatgcatccttaaaatacacataagttgaacaagaaatgttaaactctattgattacaatgttttaatatggcagagaaatatgtaacatttactagggagatatatcaagcatagttttaaatttttaaagtttgatgtttaagggtaccagtgaatatgattagacaatgctgataaacaggagc

SEQ ID NO: 151150 - DNA, 288 bp, Homo sapiens
agcagtatcatagttacgggctttgacatatgcttacttgttagaaagctctggctaaatagtgatgtcaagatgcttttacttaagtgaggctatgttcataaagagagagaaatttcgtgctgggcacggtgacttcttttaggcctttaggaagcctctcagagttcagagagaatgccctccctgacctcaaaatcagttttccacagtgtacgaaactcatctccgcggtttttaatctgtcagaagaactgcattttgatatcttgattcccttttcagaag

SEQ ID NO: 151151 - DNA, 493 bp, Homo sapiens
atgataaaagccccagcaccacgagagtcccctccacccgtcagatgtcgttatggactgaagcctcagaagagctctccctaaaggacagcagagcatgtagtaggtctcattcctgctcacccatctaggtgttagaaagcacctactgcctggtacagcctagcctacaacagctaaaggattatttttttaaagctacacttttttgtgtgtggtggtgcaatacacataatctaaaacttaccattttaaccattaagtgtatagttcagcacttaaaagcattaagtacattcacattgttgtgcaaccatcaccaccatccatctccagaatcattttcatcttgaaaaaggttgttactgaaactaccaattaaacaataactccccattcccccttctcctggcaacctccattctactttctgtctctgtgaatatgactattctaagtacttcatatatgtggaatcctacattctttgtcc

SEQ ID NO: 151152 - DNA, 403 bp, Homo sapiens
agcaaaaaggaaagaggaagacaagatcaggctttcctttatccaagttctgccactgccagtctcaattaggggaaggaaaaaatttcattttaaatcaaatcaaagtttgattcttatctgggactggacactttttgttaccgaattgagaatgtgaggtgcgtgtgatttcagttacctgagagtaatcagaaaaaatttcatccagttgtcaaggtggggccaacaccattgattagatttgaagagacttgaggggacaaaataaaattgcttttgcaattataccttgtgaaaactgcttgctcaatgtattagtcatatttatttgctaactttaatcttaatatcctgtcagaaaatataattagcatagctgaaagttttttaactgaaaagc

SEQ ID NO: 151153 - DNA, 1273 bp, Homo sapiens
ctccttataatttgcttttcccacagtgttcctcatcaaagaaaaaagcatccaactgctcaggccatcactgaagtcatccttgactcctcttttaccctgatcccacatccaaaccatcagcaagttattatctccactacctccaaaatatacctcaaatccacccaccagtacactcaacaccacaatcagctgttgcctcaactatcacgatagcctcttttttttttggagacagagtctcgctctgtggcccaagctggagtgccgtggcgtaatctcagttcacggcaatctccacctcccgagttcaagcaattctccggcctcagcctcctgagtagctgcgattacaggtgtgcaccaccacgcccagctaattttggctttttagtagagatggggtttcaccatgtgggtcaggcgggtctcaaactcctgacctcgtgatccacccatctcggcctcccaaagtgctgggattagaggtgtgaaccactacgcccagtccacgatagcctctgaactggtcaacctggttgcattattcatctttcaaagtgcatatatcagatcaagtcatttccctgcttccaatcaaacttgaaatacaaaactagatacctatcaagtctttaagtccctatgttatctggtccctggctacctcttctatctcctatcactattcccccctttactgttttagcccttttctattccttgaacacaccaacaggtactcctgtctcagggcttatgctcatgccccagatagttgcactgggtccttcatataattcaggtatctcctgaaatattagtgcctcagaggacttccctaactacccaacatcccttaccttgtttatacttcctttaccacatctatcatcaaaatgctaggacatatttcccatttatttaatattgtctatcttactcaaaaggaagcactatgaaagcaacaacttttatctgttttattcactgttgtatactctgggcttaatacagtacttgacataaagatccagatgggatctcatcttgttgcccaggctagagtgcagtggtgcaatcatggctgactgcagcctcgacctcctgggctcaagaaatctactgctcagcctcccaagtagctgggaccacaggtatgtgccacaatgcctggctaatttttaaaatttttttagagacatggtctcactatgttgcccaggcggtctggaactcctgggctcaagcaatccccccacctcagcct

SEQ ID NO: 151154 - DNA, 158 bp, Homo sapiens
gggggaagtgagcacaggaccaggggtcatgagatctgacactgaccagctgaggacctggggcagggggcttctctctggccttggtctcttccttgatgctgtaaggattggtttagataatgtaaggatggagaggggagttggatgcctctcgt

SEQ ID NO: 151155 - DNA, 370 bp, Homo sapiens
tacactgatatagggagtgctatgaaacaatttcaatatgtggtattgacttaatgggttaaatggtagatagcaaggacaatttattacagactaaaagggtaagagtccttgttatggaatggctaaatacttggtaaaaggggcaactacagaaacttagcaggcagtatgagacattcatatatgctctaggcccatagttaagttgagaaagacagagaggcaaggggaagagaaagcaaaaaatattcaaagtgagaattgtgactcaaaagaaacgggtgtggtcattgctcatagagccaactgcaataaaatagagaagccaaaaatatgtttgagagaattgtgctgtcaaaagagtcaa

SEQ ID NO: 151156 - DNA, 229 bp, Homo sapiens
atccgttataaataacatgagatacgaggggagagagaggagccttggcgcgaactttggttctttttttataatttctatctctttgttgatattttctgtttggtgagccattgtactcatactttctttcagttatttagatatagttccttttacctctttgaatatatgaaaatagctgatttaaagcttatgtctaataaatctctggcctcgctggcctcaa

SEQ ID NO: 151157 - DNA, 247 bp, Homo sapiens
ccaggagtttgagaccagcctggacaacatagcaagaccccgtcccatttaattaaaataattccatggcctcctcccagcagccctgcgtggtatcatgcccaccatgtatgtgaagaaactgaggctgcaagcagtgaagagcttgtccaaggtcccacagagaggctaccagagtccaggcccacaccttggtactggcttcccctcttcatcctcggcaagagccgtgtgggagggagcctgc

SEQ ID NO: 151158 - DNA, 256 bp, Homo sapiens
gatggggaaaaggatggatatttaattcacaaaactgtggccttatagacttttgcttctttggtttagtgattttgtttagggagagaaagagttgatgtggaagttaaaggttgagaaagaaagaataattttgaacaactgagtttcaaggtgcaacatcatacccagattttaaaggatgcccctcagggaaagttaagtgttggctccagatctcgggtcagagtttggttccttaactctctaatgatgt

SEQ ID NO: 151159 - DNA, 448 bp, Homo sapiens
acgtcccttctcattaatacacatgtttggacatgaggatcaataaagtgttaataaactgacaaaaccacagctgaaataggacttcaccagtgtcacaagacagccagtgggccacccctccctgtcgcaccacggaggcagaagcagggcaggtctgcacacatatgcatttaagataaggcacaatagcagtgtgccaggctcctcagccccagaaaacagagaggttcttcagtctggatagagaagtggaaaatgctttcttttctttttttgttataactgctggtgccatgataatcctctgtcggcccggtggttatttggcacttcgatttcttactctttttcactgtgcaagtcactgaatgtaaaaggtgaataagacatgaggcacacagacaaatacctctgagaagggtaagtgctgtcatagatgtgtgtt

SEQ ID NO: 151160 - DNA, 224 bp, Homo sapiens
agtttatgtgcagcttcccgtctccccaacaaagcgatcagctcaccagcatcagataccaagccctgttagtccggcccttggcacccagatgcctgtagggccttaggtgtagggagcactcaactaagatttctctgtttaaaaacttctgccacacaggcctgggtgtgggaagaataactaaataaataaaaataaacacttccaaactctgcctcttg

SEQ ID NO: 151161 - DNA, 309 bp, Homo sapiens
gagaggctaagggactttcccgaagtcacataggaaaccaggactaaagcactctgccagcaccctgactaaaagccaggctttggcacctgcagggcagtattttggttcattttgtgagatccctcaaccccaactggctctggggctcctatgtggcaagtaaagcctctcagccttgaggggcttccgagggccaaatgccatgcactttataggactgaattgaggagcagcccccaaagactttggaggccaaatcacactgcatttcccaatggactgtacaggttagcccagcgttgcaga

SEQ ID NO: 151162 - DNA, 352 bp, Homo sapiens
aatttttttaaataaaaagctattataaacgttttgatcaaaatttgcccatatgaaaacatgtttttgcttgtatatgcttctttgggtgggttctcaagacatcacctgactgttaaacagaagagggaatgatattttcactgtatgtgtctcttttgtacctttagattttgaaccatgggtgagtgtattataaaaataagtatcctattgcaattaaaacttaagttggtctgctcttaggttcctttcacttccagatacagtcactttgttgttatacctctacactttaggtaggcaagcaggatctttcttcactgcagtttgaagtgtatagtgataaaat

SEQ ID NO: 151163 - DNA, 255 bp, Homo sapiens
tggctctgtgaacagggtaagtaagagtttgcaagtgggagtcaatgaggaagggaggtggccactagaaggcagtgaactatcattaggaaggagtctcccacttttagtgtgagcttgggaggctccagtcctaggtacctgtccttgccctgacaggaagcatcatcctctctctcttcttcggaactgggctccgtgattggctgctcctcttcctcctcctcctccctgagacaaagccaggaaaagaga

SEQ ID NO: 151164 - DNA, 321 bp, Homo sapiens
taacaagaacaaccactaccaccggcatactgatctatgcctagcttatgggctacctcctgtgctcagagcagacattactaatcacaccactctcagcagagtccagaaaagatccaacattcttctcagcacagtaacgcaggcacctgttgccagacatcctagagcacaggataagcctccttgcaatacatagactctacttatttgacaatttgcagatcagttatttcctaacttgtatgactacaaaagcaatttcaacagactaatatctatgtaatcattggcctccactatggagttaaagaactgtcc

SEQ ID NO: 151165 - DNA, 133 bp, Homo sapiens
ctcttttagggaagcaccttattctaaagttaatgtctttttactaggtaagagcatccagccatgaaaggaattgagtgtgtctgttgggaaggcacagaaatgcaacagacactgtagcataacgataagg

SEQ ID NO: 151166 - DNA, 270 bp, Homo sapiens
cagagggagcagaatgaacaaagcccttgttcagaaggagggcctgtccagaagagaggtgaggctgaagtgcagggagcaggaggttgtggagatgtggagagaggccacattacggagggctctactgtaggccaaattaaggaatttttttttttttttttttttggaaatgggttctaacccggccaccgggcgggagtgcagggggcgtgatcggggcccagggcaacctgggcccccagggtacaggtagatctcgggcctcat

SEQ ID NO: 151167 - DNA, 369 bp, Homo sapiens
tgacctctctacccagctttgtgcgagaagagtgaaaataactggggcgctcagggccaaaccccaaaacaggctccaactgagagccctggcaaggcctggtcttgtaaggagcatgtaccccctgctcccctgacgcattttagaacatgatgcagaagggcagagggcccgccaccatctctgcgaaagtctggaccggatggcagaagctggggctgggaaacaacttcagaactgccagattcaggtgtggaaggagaaaggcattatcccaatggggagaaaatggcactccaatctagttcaccagaaagagctggaaaaggttgcctttttgttgttgttactttttttttgagatggagt

SEQ ID NO: 151168 - DNA, 206 bp, Homo sapiens
gttgtttattctcattggccttctctcctctctatttaaaatagtccctccatccccatctttatgtatattagaaagcagttattgagattaaccatttggtttcccattggaaccatttggatatgtttctgagggtctacttagattttgttttgccagtctgtcactggtcttattagcagtcaaatcttaagacttcaata

SEQ ID NO: 151169 - DNA, 351 bp, Homo sapiens
ggactccctcaggctggtcgctgtccgagaggggccggggaagagctgcaggcctggctgccttcggcaggctgtgacccagcaggccaaggccgagtgggcgggggtcgagggaagctgcctggggcgcgtgggttacgcggcagacgctcctgagtgtgtgggcagcgtgtccaagccacggatctgggtgcctggccgggcccgggtgacacgggaccgtgtgtccatgcggctcacggagggtccagtctccggacatctgagtccttgccatgccctaccccgggcccatgcctggcatagaccccccagtccaggcctcagggcagccccctcaccactcctgct

SEQ ID NO: 151170 - DNA, 546 bp, Homo sapiens
caacgatggtcctcagctcaagaggtcctcagctcaacgatggtcctcagctcaacgatggtcccagctgcccaggaggatgaggtaggaggattgtttaagcctgggaagtcaaggctgcagtgagccatgatcgccccactgcactccagcctgggtgacagagcaagactctgtttcaaaaaccaaagtacctgaacctttgaaacaaatcctatctacctagagaggatcctctagaatctcaggtatatgaacatacttggtagcatgttatttaactctggtactcaaaaactgagtattaagttattgtgatttgaaattgtggatcttcagtctttagctatttgacatatctgcagcttttgtacattgcttccattcagttacacaaatgtccacttgtccatttagaaactaaagaccttcagtatcacataaaactgatcatcagttgttctttggatataacacattagacttgctgtggtctactcaaatggagagttcccagtaataaaggctgccagaaacttacccatg

SEQ ID NO: 151171 - DNA, 358 bp, Homo sapiens
cgacctcagcccaccatgcccagctaatttttgtatttttgtagagacagggtttcaccacattgcccgggctggtcttgaactcctaagctcaaatgatctgcctgtctgggcctcccaaagtgttgggattacaggtgtgaaacatagcacctggccggtgatttccatttttttttctttactcttatctctgttttctagatgtcctacaatgaacacgcatggcttctataaaaaagaaaaaaaagcttatacttttgcaaattgtatcaaactaagcaagcataggaaagaacaaaaatatggagaaataagtatttttaaacattgtgggctgggcacggtggctcatatc

SEQ ID NO: 151172 - DNA, 437 bp, Homo sapiens
gtcctggtttatctacatattgttacaactggagaagccagataagcaaaggatgtgaagacaagcagggagaagtgtcttgatcctcaagtcctcacattacaggaagcatctgctctgagaacaataactcccagcctctgtataatacagtaacattctcctttgaaacaggagagtgctcctagcaatggcattttcaatgaaactctatgtcaatagagtcaaaaacagcccatgaaagaagcagcgttttccctccttccttcccacagatccattctgctcccaggacagctttgcccgccccagtcttgagtacttgaactttcctatgggcatacaaggaacccttctcccaaaagaagatctaagaataaagctgaaaaccaagccacaacaacatgcacccaatgtaggtactatttgttgcaaaa

SEQ ID NO: 151173 - DNA, 349 bp, Homo sapiens
gtttttttccactgtcagataaacctccacgctttggcttctagagtgatgggtgggcttgctttccttttgtggacttgatggcatttgactgtataattattcttctcagctgaatatccctgcgtgtcctttgacatgatggtggtataggtagctttaccaggcataatttctataatccatagagtgtcaagaaggtacttattttcctatcaaatgctgctgacctgattaagccttctgcctggctttgtagctgaagataatgagtttgtccagtgcagtggctgttgggacctggggtctttctgaagatgattgtaacctgggtgtggagtggggcctt

SEQ ID NO: 151174 - DNA, 913 bp, Homo sapiens
gcatatgacacccccagtgcttggttcaaacctgtttgagtcacctgtcactttctaccttgaatttttgtcaccaatggacatgcagtaacttctatactagactgtgactcagacgctcacaatcacactcaaacacagtctagtgtttttcacagcctggtatagaaggtactgcctgtacatcagaacaggggagcaggagcctgatctgatttattatgaagtctcccaaggcctccagcgcacagtatcaggcacacaggaaacaatcaatgattaatgtgtgcttcctccatcctatgagaaatattacttaggtctctttatgacgagtggccaaaaagcacaaagccgaatctgatgcttattaatagtaatcccatacttgctgtaagccctgcaacaactatcattatccatgttttgtttttcaatggaggtataatttacatacagtaacatgcacacatcttaagtgtatagcttgatgaatttttacctaaatatacctcctggaaaccactgaccacacaaacatctatgtctttccatcactctagaaagcttcctttttcccttttcctagtcaattaacccccatgcccctcacactccagtgaaccactattctgacttctactcccataaactaggtttgcttgtttgtgaacttcatataaatgaaattgtacagaatgtactcttgcatctggcttctttctcttaacataatgtttttgagatttatccaggtgattgtatcagtttattctttctttttttaatctgctgtgtattattccattgtaagaatatgccataatttgtttatccattcttctattgatggacatttggatcatttccagtttgggcatattgtgaataaagctgctatgaatactggtgt

SEQ ID NO: 151175 - DNA, 1058 bp, Homo sapiens
gcatatgacacccccagtgcttggttcaaacctgtttgagtcacctgtcactttctaccttgaatttttgtcaccaatggacatgcagtaacttctatactagactgtgactcagacgctcacaatcacactcaaacacagtctagtgtttttcacagcctggtatagaaggtactgcctgtacatcagaacaggggagcaggagcctgatctgatttattatgaagtctcccaaggcctccagcgcacagtatcaggcacacaggaaacaatcaatgattaatgtgtgcttcctccatcctatgagaaatattacttaggtctctttatgacgagtggccaaaaagcacaaagccgaatctgatgcttattaatagtaatcccatacttgctgtaagccctgcaacaactatcattatccatgttttgtttttcaatggaggtataatttacatacagtaacatgcacacatcttaagtgtatagcttgatgaatttttacctaaatatacctcctggaaaccactgaccacacaaacatctatgtctttccatcactctagaaagcttcctttttcccttttcctagtcaattaacccccatgcccctcacactccagtgaaccactattctgacttctactcccataaactaggtttgcttgtttgtgaacttcatataaatgaaattgtacagaatgtactcttgcatctggcttctttctcttaacataatgtttttgagatttatccaggtgattgtatcagtttattctttctttttttaatctgctgtgtattattccattgtaagaatatgccataatttgtttatccattcttctattgatggacatttggatcatttccagtttgggcatattgtgaataaagctgctatgaatactggtgtattttatggacctgtgctttcactcctcctggctatgtacttaggagtaaaattgctgggctgtagagaaggcatctgtttaacttaatagaagttagtatcactatttttgatttggatatgagaaaaaaagggtttttttaga

SEQ ID NO: 151176 - DNA, 374 bp, Homo sapiens
taaaaacacacgaataaaatacagaactacacatacacaaacacacacactccaccaccaccaccaaagaactaccttaaaagtaaccagagaaaaaggcaggtttagtgcaaaggcacagtcattaaatgaaagactccttaacaacaacaggagacgcaaggatacaacaggtaatatctgctaaaagaaaaaaatcgccaacctctggtttggttatccatacatacctagactaacattcatgaaaaagaaaaacattttccaggcaaacaaatatagggaatttgctactcagagaccttcaatgaagactacttcaataagaagcgactggatccagaagtggaagtggtttgcaagaagccatggtt

SEQ ID NO: 151177 - DNA, 256 bp, Homo sapiens
ttggataaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctac

SEQ ID NO: 151178 - DNA, 301 bp, Homo sapiens
ttccctttgatacaaccataatacttgggatgtggcacaaatgctttttagggtacctctcatttattcacatagaaaattaaataggacacttagtcaagggtgcagatgtgaggatttaaagagacaatgaaaaaaagcacctaacattcagattgacacgtaagtatccaaagtttggttttccttgctctgttcttctcgtaagctactctccatattttccacctttcctttatttcttaaattcctaatacggtcaatacttattttcattttcttacttaattccttgtagcct

SEQ ID NO: 151179 - DNA, 334 bp, Homo sapiens
atgttcattaatataaagcatgtatcatatacaataaagtcactttatttctatacaaaatatatgattctcattaatctctgactctggctgtaatgtctctgaatttccagcctctacaacctggaaaatcgagagctgagtaaaatttcatttttgattgagtacatgtaagctgagcacttagctagctcatttccttctatttaactgcaagagacaatttaagaggaaagtaggaaatggatatagccctagaagctctgaaatatatccttactgatgattcacaaagagtagaaggaataatgatgaagtgcctctaaagcatatt

SEQ ID NO: 151180 - DNA, 313 bp, Homo sapiens
agggttttgcatccgtcacccaacgctctcatcaaccttctggggaaactgtgttctactcttattctccctcacccctacttgggactaaacaaatccaaagaacagcccaaactgattttctgttctgggatgtgctgaattccactgcctgaagacgtgcctggtggctgctgttgagaagcctctggccgcagagcatccacagtgtttgtcacttcagtgggaataggctgcccttccttctctgtgctcctgtcagtcctgggcttttccagctgtctcacatctatccaggcatctgccttccccc

SEQ ID NO: 151181 - DNA, 557 bp, Homo sapiens
cgagctcggtaccccaacgatggtcctcagctgccagacagcagattgtggcagctgaggttttccacggtagagtagaagcatccatcatgtgtgacattcagcagatggggcgctgtgggtggcttggagcactctggttgtaactgaggcaggcacagtgtttaggaaggctgtgcagtaatctaggctgaaggaaggggaaagcctagactaagattgtggctgtgggattgaaatagcgttgaaggagctgactttgactcccggagatgatggggaaagaggaaatcagaagggaccaaggatggtgatgttcttaagagaagctgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttag

SEQ ID NO: 151182 - DNA, 457 bp, Homo sapiens
gcttattccattgtttcttcttttaaaccttgttgatggtgaatagtttgggagaaactgttcatttgccaaaaaatttcggttcattagcttacacagcactctccccttgttaactggatggtcctgccttcaattgagggagatagatgaatgtacgagggtccctggttggcctaatcatggctttgtttggatttttttttaagggaccaacttctagagcaaggcctacactttactgcttcaaaaccaagatatttaggtcaggctaagatatttttagttaactgtgggcacttttgactgttgatttggggtactgcgtgtatcaagtaaacaattccctgtgcacatgcatgtggtggtggtggagtattttcgtagtcctgatttctttccatttgtcagttaactgctttttaaaagtttattctggtcatatgggggtgtaagt

SEQ ID NO: 151183 - DNA, 938 bp, Homo sapiens
tcacgcccattgttatcaatctccttccacttcctcctcagataagtagtcatcgaatttctatcactgtacgttagtttttcctaatctagaactttatataattggaatcacagggtatgtgttccttcctatatggcttctttcactcataattgaaacatatttttttcatccatgttattgcatatattagtaatttttccctttcatgactgaatagcatttcagtgtacatgtatagcacaaattgttattttatgctctggaattggatatttatttgtttccagtttttgacatcttcatttttgaggaaacagtgggcccttgcaatctagtggctcagtgtttagctttccatgacatgagactcaaggcttatggttctacattcccagatatatggtctagtcatggcttctgtttctgggatgtcactctgacatgcttcaactcagtggttcatggctctggctgtgggcgaaaccctcatgtgaaatactttagttaatagaaaaaaaattgaatcatttaaaagtacatgatgggaagataagtaatacacaggcaatttctgctttcttccatgctacaaatcctcccagtggcaaggagcacaagtttgtgctgccatcggattaagtcattggcaaagtaaagataaaacaccatgagaggttgggcatggtggctcacatctataatcccagcactttgggaggccaaggtggccagattacgaggtcaggagtttgagaccagtctggtgaacatagtgaaaccccatctctagtaaaaatacaaaaaattagccaggtgtggtggtgcctgtaattccagctacttgggaggctgaggcaggagaatcacatgaacccgggaggcggagatggcaccattgcactccagtggggtgacagtgcgagactctgtca

SEQ ID NO: 151184 - DNA, 337 bp, Homo sapiens
cacacacatgtctgtcaacgtaaatggagaggagtccttggcctggtgcccaagttgagcacgcacagtacagctattatgtgcaagttgccctcacattgccatgcctggccacagagtgctttccagggtacacatctagtacttgatatgaaagttttcaatttttcagtccatgacctcactgattctttaaggtaagtacatttacacaagaagcccagctcctaaagaggttgtgtctcttgccctgatcagagtggttgagctgctttgtaaaacaaggagcctgagtccatagcattcactcttagcattcactctttcccactatgct

SEQ ID NO: 151185 - DNA, 534 bp, Homo sapiens
  misc_feature (490)..(490): n is a, c, g, or t
cccacgatggtcctcagcttctatttttctcagaaaaacagaagctgaattttcaaaatatccggggagctgtctttgagattgttttgagaagaagccagcatcacgagaagtggaggtggtttcatgcctcctggagacagggcttaacttcatacagtttggttttgttgcagtaaaatgtcactgggatcctgtaaagacaagaaggagaaatggtgttttgcctttctttcatttccttttttttttttcaaagacagggtctcgcctaggcaggatgtagtggtacaatcataactcactgcagccttgacctcctgggctcaagcaaccctttcacctcagcttaccaagtagctgaggaccatcgttgcaacgagggtcctcagcggcattaaccagccccagttccgggcggtctggggggaagtgaaccggtgtgagaagatgcgccagttggatgctaaaaagttggcagagacccaanctataaaggacacaccacggaaagagaagggtcacgggaagaga

SEQ ID NO: 151186 - DNA, 118 bp, Homo sapiens
gctccttgtttacatatccacccttcaggactggataacagatagtcttttccgacctgaatcccattccattcccttttattatgtgtccctgaaattctattacctgctcatggtc

SEQ ID NO: 151187 - DNA, 264 bp, Homo sapiens
actgcagcaagtctcatcctagaagaggctgcgagaacaatggccaagctatagtgtaggaggttctcaggcctttcatctctggctgcaaaatgcaacagagcagatggtagtaataaagccaactgggatcctcagggctctgggatggattcttgttacctttgatcactgtaaaacaaacctttctctggaagagttccctcaaccttagccttggtgttctaggtgtgcagcagcaggcaggctgagcaacatcaaagc

SEQ ID NO: 151188 - DNA, 442 bp, Homo sapiens
attttaaattgttatttttggtttttcaaacattttttgatgtgctattggttgaattgacagatgcggcatccatggatacagagggccaaccgtataaataacataaaggagaatagattggagtgaagggggcatacttggcttatcctaagaaatagattactttcttgaagtgtcacagtgtgtctatatctgttagccttaaaaagatgctcccccattagtgttctaaaaataaatcttcaagtgttaattaaaaaaagaaagtaagaaagaaagaagtaacatactttcaagcagtgattatgcccagtttggtgtcttctcatgtaaatttcaccaaagtgcattttgagtgaatatcatacagtgaatgaaatatatgagtaattctccctcatcaaaattataaaaaaatacatctatacaatcaattctg

SEQ ID NO: 151189 - DNA, 477 bp, Homo sapiens
tgagatggaatcttgctcttttgcccaggatggagtgcagtggcatgatcttggctcactgcaacctctgcctcctgggttcaagcaattctcctgcctcagcctcccaagaaactgggattacaggcacacaccaccatacccagctcatttttgtatttttatagagacagggttcaccatgttggccaggctggtcttgaactcctgacctcaagtgatctgttcactttggcctcccaaagtgttcggattacaggcgtgagccaccatgcgaggcctgccttactttgtatacatggtttgaggtgcacatgtaggtattcaactgctcctgcaccacttgtttaaagattatcctttttctactgaactgtctttgcacttttgtcaaaaattaaatattcataatgtgatggtctattttcatattcatattctttattctgttccattatttgcccatcttaacaccaa

SEQ ID NO: 151190 - DNA, 944 bp, Homo sapiens
gagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaagacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaa

SEQ ID NO: 151191 - DNA, 436 bp, Homo sapiens
gagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttacttggagacaggtgtatcagttcgcccccgagacattcgcccccgcgag

SEQ ID NO: 151192 - DNA, 549 bp, Homo sapiens
aaatcactaatcatctcaacaatagtttgcaaaatcaatcacaggcagagacacagatgctggcagagttcctaaaattgaaaaaacacaaaattaagcctatatgaggcttaatttagagttcagagtaaatatcaataacttattccattttacacattctcatataaatctgtcttatattggcatttattcccaaaagttacggaagggaaaacatgtttttttgtgtcttactacatactcatcttaataaataactatccttcccatctggtcttaaccattatgagctcccttcctgagaaaatgtgtctgtgtttatcttgcttaacaaagcaaataactcttgcactgtgccatttttgaagtttctatttccttatcaatatcttttttgttgttgttgtttttagacaaggtctcactctgtcacctaggctggaggacagtggtacaatcatagctcattgcaagcttgaaatcctaggatgaagtggtcctccctcctcagactccccagtagctgggactacaggcacatgttat

SEQ ID NO: 151193 - DNA, 750 bp, Homo sapiens
cagtatgtattagggaacatgaagaaaatctgcagttatcactaacagctgaagctgatgataggcttgaataaaagaaatgtaggaagcagtgcagtttgcctcaacaatataaaaacaacccaagaatatatcctcataaagcataggcgtggactctgttactgactgagttgtgtcctccccgaactttatgttgaagcctaactcccaatgtgactctacttggagatatgccctttaaagaggcatttttggttaaatgaggttgtacaggtgaggccctaatccagcatgactggtgtcctgataagaggaacagacaccaagggatgtgcatacacagaggaaaaggacatgtgaagacatgacaagacaagaggcatctgcacgccaaggagagaggcccccagagaaaccacacctgccaacaccctcctgaaattaaacttcaaaactgtgagaaatacatttctgtttcttaagccacccagtatttagtattttgttatggcatctctaaccagaaccctgactaatgcagaccctaataatgggcatcaacaaattaagatttgtatatggattatatgatgagtttttgttctgccattaattaccagagtgatttatgggaaggtatttaatctctatgggtcatattttcctgacctttgatgaaggatgaaaaaagaactaaaaaatatctgtaaaatagacacaagtttaaatgtaatgggaataaagaca

SEQ ID NO: 151194 - DNA, 267 bp, Homo sapiens
agccgtggcttagggttgggaagcagaagagagggagagaaggaggtgggttcaggacatatttctgagcaggaaagaggcagtgagggaaagaggggcataatggagggttggcttgagcctctgcatgacggcgagccatcgatgctctaaggcaggaggaagagcagttcagggaggaaatcatcatgagtcctgctctagccgtgagaagttggagatgcagattctgcattaagagaggatgttgagtcgggtaaaaatctg

SEQ ID NO: 151195 - DNA, 314 bp, Homo sapiens
tgagatgcagtctcactctgtaggccaggctgaagtgcaatggtgccatctcggctcactgcagcctctgcctcccgggttcaagtgattctcctgcctcagcctccccggcaccaacacgcccagctaatttttgtactttttagtagagatgggggttcaccatgttggccagactagtctcgaactcttgacctcaggtgatccacccgccttggcgtcctaaagtgctgggattacaggtgtgagctgacgtgcccggccagaagctgtgtgctttgaataagccacttcgcctctttgggcctctctgt

SEQ ID NO: 151196 - DNA, 264 bp, Homo sapiens
ttcttttacgtctctcaccgtctcgcttcgcccgttatgatgttcggccgcatcatagttgattttattggaaaaataaaggccagcaaaagttctcatttggcaaatatcaggtcaaataacttaaaaatataatttcctgcctgactttctttttctcaatgtgaggtgttcttgcctttcttggttgtttgctttctctctggtgcttcttgggtttccttttcttgtgctacctcttcttctgggaccagtgacttctgt

SEQ ID NO: 151197 - DNA, 342 bp, Homo sapiens
gtgtgtgcatgtgtgtacagaagaatgcatatgaacctgtgcctattacccctgcagacagcatgctatcccagtgtcatggtggaagaacaaggaacaggacattcaaacagtggatgaccaggtccctacttcccaggactcggctttctttggagggaagcttatccatgttccccgaggacctactacacacgtgatttcagagtggactgttcagtgtggcttgtctgggacttatattctcaatctcatcattgcctttctgtgtccaaaaccaaagcatcagaggtacaagaaggcaaaactccatttcctctgtgagcactgttcctgtttgac

SEQ ID NO: 151198 - DNA, 431 bp, Homo sapiens
cttcccccatatgtgttcaaactttgagggcaaatgatcatagcttaacctaagatttaagacagattagatttcctaagatttaacaacagtgaaatcaggttgaaataaatcacacaggggaaaaggggacaccttgggatggaaagagatggggatatggtgaaggaggcatgagtgggcaatagaaaccatccggttttgccttgtggggtgaggagagaatgatggtctttgttgtggtgagtgaagtcttgctgggagccaccagctacactcctcttctaaaactcattccccaatccatccatttggggcgcagaaacgaaatattagacctagtattttaacttatgttttctcaccgaaagcccaagaaggaaactaagtttcaatgttatttattatgcaggttgagtctgttggtcagg

SEQ ID NO: 151199 - DNA, 396 bp, Homo sapiens
ccactttttgcccccttagaggaatataatcctgttgagaaggcacaccctagagtccaaaatctgggtttggatcctgctcctgcccttacttggaaaattaccttgggtaaattactgtctcggtgagctcagtttccacaactgtaaaaggggggtactgtccacctgacgggactacatataataaggtggagaatgttgacacctaatcaagattactcttctcccatctactctctgcttgcagcctagattcagccctcagaagttagtcttgcctaaacttggcccaggctttcaagtctgccccttcttgctctttactttatatagcctgcccttccctcctgttctcacctgctgtacactcttctcatggaagtccagcgcatg

SEQ ID NO: 151200 - DNA, 589 bp, Homo sapiens
ccagcgcgttaccggactggagatgtctgagcacacggatgacgtttaagaagtagccatggctgggcgctgtggctcacgcctgtaatcccagcactttgggcggccgaggcaggtggatcacctgaggtcaggagttggagaccagcctggccaacatggcgaaacctcgtctctactaaaaatacaaaaattagccgggcgtggtggtgcccgcctgtaatcccagctccttgggaggctgaggaaggagaatcgcttgaacccgggaggtggaggttgcagtgagccaagattgtgccactgcactccagcctgcgtgacaggagcaaaacaacatctcaaaaaacaaaacaaaacaaaacaaaaatctaactagccccaaacagtgctcccgatattgtcctaatcctgtgactccttcaaaattcgccactgcagtgaatgaatagtaacttcatctttccagctcctcagccttaaaaccttgggagttatccttatcttttttccacaccctacacttgacagcaaacactctatcttcaaaatatatgcccaatctgactgcttctaccacctcctctgt

SEQ ID NO: 151201 - DNA, 475 bp, Homo sapiens
gcccaatgccgacatacacatatccagtttgttatctggtgacagattggatacaccctgggagctcgctgacggtattctgtctataatttcaatgcaaaatgtaattcagagttgatgctgatgagaagtgacagtacagctaagtcaaaagcataaacactggatagtctttggaaccttggatttgcattctgttatagcacaaataaccctttatatttggatttgaacttctctctaagcacatgactgatgatgaatctgaaaagacatatttataagtaaaggagcaggcaaacacagtttatggaggggatcatttcaggaaaggcaagtagttccaggtcattggcactgtgaggcaaagcctaaaagggaagaagaatcagatgaaaggccttttgtatgctatgatgtatttgggttttatcaaggtaaagagaaaatattatttaattatttgactgacaag

SEQ ID NO: 151202 - DNA, 208 bp, Homo sapiens
tatgtcttaattagtggcctgagaacagactaatacaccatagcagcacttcaagtcctacagattaaacacatctatctatcaattaccatttgccagctgtttttctttaagaattttttaacaattcatcagatatctttgtgcatttccaacttgtttgttaagaaatctgctcagtatcttaagagcagattgaaaatcataa

SEQ ID NO: 151203 - DNA, 438 bp, Homo sapiens
agcaacaacaacaacaacaacaacaacaacaaagttcagattccaagaaagcgaagaagaaatagagatgctgggggagtccatttcttagtaagaaatggttgtcactagctccattttttccacctagtagaatcacttgactgtctctcaagctcttcaaacttgacatatctgaaaagaaaagctcgttttctttcccaaacctgttcccctcacttcacaatctcaatctttggtatttcctccatgatgcattcaggcacccaggctgggagtgtgggtattgtctatagtcctattcttcctcactccccattggccacatccaatcaatcaccacatcatgaaatttttaacctccagacatttttctctattctattctgcctcttcatcttcctccatactgcagctccctagcttaagcctttatct

SEQ ID NO: 151204 - DNA, 612 bp, Homo sapiens
tgtagatggagttttgctcttgttgtccaggctggggtgcagttgtgtgatctgggctcaccgcaacctcctcctcccgggttcaagcgattctcctgcctcagcctcctgagcagctgggattacaagcatgtgccaccacacctggctaatctttgtattttcagtagaggcagggtttctccatgttggtcaggctggtctcgaactcacaacctcaggtgatccgccacctcaccctcccaaagcactgggattacaggcgtgagtcactgcgcccggcctaatcctgccctcttttagcagaagtagagatagagactttagaagttcagggactcacctgggatcccagggatatcccagccacgcctcggctggggactgacctaaacccatgcacagctgcagagctaccagcacatgcctccctggctctggaaagagactcgggctgtcactgctacctgaggacagctggcagagcgtgaaatcccagaaagccctcttttcccacgcctattctgatcttgccagctctggttctttctgggggcactgggacacggtcctcctgaacagcagcctccccctccctgccagtgcggccgc

SEQ ID NO: 151205 - DNA, 300 bp, Homo sapiens
aaaaaagaaggcaacttcctcaacctataaagagcatccacagaaaacctacagctaagatcatacttaatggtaaaagactaattgccccctctaagactggaacaaaacaagaatgtccactctcaccatttttaattgctattttactgaaggtcgtcctaagcagtggaataatgtaagaaaaagaaaaggcatccagattggaaaggaagaattaaaacaggttctattcacaaacatcacacacagtaaaaaacaaaaaaaaactacaataaagtaactggaactaagaagtgg

SEQ ID NO: 151206 - DNA, 565 bp, Homo sapiens
acagcgtcttataatgaggtggccaggaacagaaagttagcacctgtctgggtttgtagaaatcagtttatcttttttcagctaggaagaaatagttctttgatgaagagcccatgaaagtctgggtaattagtattgtttacttagaaaagctctattgaattcttcctgccacagtttgatgaatgatcatgaatgtctttgtggccactccctgctcaccaccagattgtctgggttcatttccagttggtttggatttggagatgggagtatgctgttggaggcgggggccttcggggagtgttgagggactgtgtttccacggctgttctctcagggagtggcctcctggctgtgctctctcaggcagagaagctgggctaaggtggaatgaacccaggatctccaggatggcctttgccgctgccctaatactggtcctggcctgccctttcccaagagtgtttccaaaaactgtattcttttcctggggtgaagcccagcactgcttcatttggttattagcaaacacttacacgttgcttgaagggtctggtttttg

SEQ ID NO: 151207 - DNA, 156 bp, Homo sapiens
tggcaggatagatcttgattctcttcaaggcaccagatccaccaaggtgttgcctgttccttctgcaccagagaaagttaggatatatataatataaatggctttgacgacatgcactaacgtgtgagtgatcaatgccccttaattccctaaata

SEQ ID NO: 151208 - DNA, 674 bp, Homo sapiens
tgcagaagcctacttttatttttaaaaagttattttcacaaaaattaatacccccttcctgcctccacacatccataatcccaccccttcagaaaagcagggctgtcttccagcctctgtctcgcaggcattttactagtggggaggatgaaaggttcaagaatcaaggacatcacactggctaaatgcccccaaaagtcagtgtaacatctcccatctcagaggcatcttcttggaaatgaagcaaagcaggaaggcaaaggactgggggtgactggccgtgtgaccttgggcaagtgacttaacttgtctgagcctcagttttctctctcctaaaatcagagaaatcttaccactgacgggggaggaggtggtgaattcctctctgctcgtgctttctgagctactcttccaagccagccattgtcacatttatcatatcattcaactctgatgagaacccagtgagaaaggaactattcctttctttgagaaatttggtaagtgtgcataggggtgaagtgacctgcctcggggcagagacctggccagttatggagctgggggcccaggtttcctccatggctgacacgctttccaccacaccacagctgtctcctgatgggcgggtgtcatgcacactcagggcctttgggaagtttgagggttgcgga

SEQ ID NO: 151209 - DNA, 475 bp, Homo sapiens
tggcagcatgtattcctctgcttctggatagcagaaaggggaaggggaggccgacaaatgagtgttgcttatgcaccctttattagggccagcaggtggcagtaaggggacttacattgggaaggttttggtggttaaagaggttggataatagtaattctgccctagttagatatgagaatctggagttggtggatttctaaactccatatccaaatagactcaagataaaaatacataccctatctacccacacttaactttcagaaacttatgtttttataacacttaaagcatgtattttaaaaatatatttttagacggcttcattcagtagatcctcttagaagggggccttgggctgaaagaaagttggtgtgacctggtctactgctgacctgccttctagccctgtgaggtctgaccccccagcccgccccacctacctcacctctctgtccaagagagggactta

SEQ ID NO: 151210 - DNA, 417 bp, Homo sapiens
cagctattcgggaggctgaggcaggagaatctcttgaacctgagaggtggaggttgcagtgagccgagatcacgccactgcactccagcctgggagacacagcaagagtccgtctcaaaaaaaacaaaaacaaaaaaaaagttacaatccaaaaagtctcagcaagcaggtaggagtcagatcacggagggctaagcttgcacagtcatccaaaaacatctacctacaggcccagacaggatacctgaaatcatgtctgaaatggcagcctcatgtgggcaagagctagggcatcacgctggcctaaccagaaggaactgtgccaagaggactaagagttttaccccaaaatgatataacctaccatttgctagggcagcccagatgcacaggcactaggctttctatataagcctt

SEQ ID NO: 151211 - DNA, 289 bp, Homo sapiens
tccaagcagaattcctatttttgtgggctagcagatgactgacccacccagaggacaaagacaacatagaacacagtaatttatgctgtgtttttctgatttcaaatggaactatgttccaaagtcattctgttccaatcctttatatgtcgtcctctcccaaccacgtggtcctgttgaaagccacatagcacaagagataaatacttgttccctcagagacctgtttttatattcaatgaagccccatgttatttttattcttttagcaccagcatttcagtgaatg

SEQ ID NO: 151212 - DNA, 310 bp, Homo sapiens
gagacccagtacagtgcaatccaagctgctgcagccatgtggagagactcctgcttgaggaaaagagagggaagaagggactttgtctcgaagcttgattagcagctcagccatagtggggtagccgtaacaaggtagctcctgaggtctctgatttcaggccttggctcctggatgacatttctggaaccaccctaggtcagaaaaaaaacccacttcccagccgggcacggtggctcaggcctgtaatcccagcactttgggaggccaaggcggtcggatcacgaggtcaggagatggagaccatcct

SEQ ID NO: 151213 - DNA, 342 bp, Homo sapiens
ccatgccccggaagcaatcatgtgacccagacctggccaccaacaatattccattgcccttgccacagtgactggttcacagatgggtgtgagacccaagccaagccaaccaaagtcctttctgggacttctggtgccgcaggaaggacactggctctttccttagatcataagccatcttgctgctacctagagacagcctgtctagggaactgtgcagggagaggcaagtggacgagacaggaaagagagacacagctctatgaacattatttgaacacctggatgcagctgtgcctgaactccacaaatgtaaatctgctttcccctgagatgatttgg

SEQ ID NO: 151214 - DNA, 657 bp, Homo sapiens
ctttggtaccaggatgatgcgagcctcaaaaaatgagtgagggaggattccctctttttctattgattggaatagtttcagaaggaatggtaccagctcctccttgtacctctggtagaattcggctgtgaatctgtctggtcctggactttttttggttgaaacatgttccaaatcaagtatcgatattgagaatgggtttatttctgaatctcagtatatatatgacttacataaacaagcaaaatatcaatgcaaactaggatatataacagcagatggtgaaacatcaggatcaattacatgtcagaaaaatggatggtcagctcaacccacatgcattcccccatgagatgtacttaaagaagacttggaagaagagaaagacaaggcattatctgtcagcagctgctggtaacagctgagatcaccaacagtagctttccttgcttctggaagttttcctgagaaacatccactgcagcaccatggataattagtgagggcatcactaagattcctgaacttcagaattttctggaaatagcatttctgacctttgtccctcaatgcttccaatagttgcagaagcctttcattccctgtattaaaactctctttacttaaaaaataagaaataaaaatgtatcggcaagc

SEQ ID NO: 151215 - DNA, 794 bp, Homo sapiens
caaggtgtccaagtcacacagaaccacagaatctcacaggtgtctcagaattccttctcctgggactctcagaggatccagaactgcagcctgtcctcgcttggctgtccttgtccatttacctggtcacagtgctggggaacctgctcatcatcctggctgtcagctctgactcccacctccacacccccatatacttcttcctcttcaacctgtccttggctgacattggtttcacctcggccatggttcccaagatgattgtggacatgcaatcgcatagcagagtcatctcttatgcgggctgcctgacatagatgtctttctttgtcctttttttttcaattattattatactttaagttctagggtacatgtgcacaacgtgcaggtttgttatatatgtatacatgtgccatgttggtgtgctgcacccattaactcgtcatttacattaggtatatcttctaatgttatccctccctcctccccccagcccacgacaggccccagtgtgtgatgttccccatcctgtgtccaagtgttctcattgttcaattccaacctgtaagtgagaacatgcggtgtttggttttctgtccttgcaatagcttgctgagaatgatggtttccagcttcatccatgtccctacaaagtacatgaactcatccctttttatggctgcatagtattccatggaagacatgtctaatgtttaaaggttgtaaataaggcaaataactcataaataaaacatgtcctgttctcttatcttgatacatataccttaata

SEQ ID NO: 151216 - DNA, 421 bp, Homo sapiens
agcgctcagggagttggggtgggttggtgcctctggagcttctgtagaaattgctaaggtctttggtttgcttagtttcctttgaggaaactggcctggtatctagactaagggcttgataccatagatataattcagcctgtccccctgccccccgcactcctagatagctgggtacagaccaaactgattgctaggacattttggaatatgcaagtttcctgtattagactgagatccttgagagaggacaccataccttggtcatagctttattctctgtacctagtacggtgcccgatacagagaagttgctcaagaggtacttgtcatttgcttgccaaatgaagaaatggaacctcctccaccattaatgggtgaaatgacacaaaataatgctagctaacatttcttgaacaca

SEQ ID NO: 151217 - DNA, 771 bp, Homo sapiens
tctccttagggaacaagaatacttggacacaattcaaagaacaccatcagatacctgaggtctagcttctggtcccaaatctgtcattcagaagtgtgtaacttgacaatttgttgaatctcactggattttatttctgtcaagagtaaaattaaccagataagaattatgctgagacatagcagtacctcaaaaagtggtggaggtaataagctgcaaagttggaacttgaatcccggacctcaagctccaaatccagaattcctcactttccccccgctacctgatacagaactggagaaaaataaatttgatttaattaagtgtagcagatcccaggaactattttatgtttaatgattactttcaagcttaatttgcctctatttaagtgtaactaacacataatctttaggataaacatctcggaattctttccgaattatccccaaattttaagtttaggtgtgcatttgacaatctgcattgctgccaacagtagttggaagattactacctgaaagctgaggaagtttgcttcagctactacatgcccttccttgtggtaaatgtgcaagtcacggcacaataattgaggaaataaatgttggtgccttaaaataaatgttgatattcaaatttgtcctattttaccctggtaaatgtgtaagtcatggcacaatacttgaggaacttgagcagataagtttggagtaaataacctgtgttataaaatgcacaacactcaaaataaaatgaaacactacaact

SEQ ID NO: 151218 - DNA, 325 bp, Homo sapiens
ctggtctcaaacacctgggcacgagtgacccacccaccttggtctcccaaagtgctgggattccaagtgtgagccaccacactcagccaacagtttctctaacatatttttttttctctagatcttaaaaacatttggtcaaggaatttagatatggactttaagggtacataattcaggataataaaaagctcagcttcatcttagctcagtgttcccttcttcctccacactttacaactaaatgcattcaaaggaatacgctattgatgtgtgtacaacaaagtggtcttaaattgaattctgtcaatggccatatatatta

SEQ ID NO: 151219 - DNA, 213 bp, Homo sapiens
tcagtttagcatttgccccagatttctaaattttttaacaaagtattattattaaaactgcattaaaatgagccgtgatgagtttgggcttccatattatccacccaacttcttctagctcttgtttaccagggaacagttatctcttaacacatggttaaatctttaagttgatcataaatgaatctctcattttccaacacttttcaaatg

SEQ ID NO: 151220 - DNA, 540 bp, Homo sapiens
gctaatttttgtattttttgtagagatggggtttcgccacgttccccaggctgttgtcaaactcctgggctcatgcagtccacttgcctttgcctcccaaggtgctgggactagagcacccagctgcatttagctcttacatttaagttttgatccatcttaagttaatttttatatatggtgtgatgtggggtccagtttcatttttttatatgtccagttgtctcagcaccatttgtagagaatactattttccctctattgaattgtcttggcaccattgttaaaaccaattgatatatatgtaaaggtttgtctgggctcctaattctattccattggtctctagatctatcttatgccagtaccacatttgttggattactgttgctttgtagtaaattttaaaattaggaagtaggagtcctccaaccatgctcttcctttgtaatgttgttttggctattcttggttcctggcatttccatatgaattttaggatcaacttaccaatttctgccaaacaagacaactataatt

SEQ ID NO: 151221 - DNA, 342 bp, Homo sapiens
acagtaaatgccaaaaaaatagaagtaacaataacatatctgatcactatgcaatacaactaaaaaatacaaattaaaagactaaaaactagaaaataaaactccaccattgggaaattttaaaactccccttaggtcaacaagaaaatcaaaaccaaaattctaggccatgtagaaaatgatgtgaagccctgtttctactaaaaatacaaaaaattagacaggtgtggtggtgcacacctgtagtcccacctactcgggaggctgaggcaggagaatcgcttgaaccgggaaggcagaggttgcagtgagccaagatcatgccattgcactccagactgg

SEQ ID NO: 151222 - DNA, 106 bp, Homo sapiens
ggtgagaggctggatgttttctcccgagatcaggaacaagacaaggacaccactttccccatttctattgaacattgtactggaagttctgccagaccaataaggc

SEQ ID NO: 151223 - DNA, 158 bp, Homo sapiens
gggaagcatgatggagaaggcatcattttaggagagataatcgagtgcaaatgcacagcgtggactgaggtgaagacagaccgaaggggccacagtcttcgccattcttaccccacagtctgcgggtgatagaaaagttaccacagtcttcgcctgat

SEQ ID NO: 151224 - DNA, 272 bp, Homo sapiens
atttggtgcctttcttagcaaggacattgtccaagtttttattaaatgtatgctgactgtgtgttaagagttcatatcttaatttaagaatcctgaaatggcttgtctccttgatacttacttaaattaaatttagaaatattcgtatctgagatatatcacagtgtagagtaaatagcttaggtctttatttaaatcagcaatttaaaacctggggtctatgtatcacttataaactcctctcctgggagtgccagatgtatttagaatgt

SEQ ID NO: 151225 - DNA, 193 bp, Homo sapiens
tttgtagagatggggtcttgctgtgttgtagctgggaacacaggtgcacatgactctgcctggttaatttttaaattgcagagatgaggtcttgctgtgttgcccaggctggtctccaactcctgagctcaagcaatcctcctgcctcaccctctcgaagtgctgggattataggtgtgagacacctcacctg

SEQ ID NO: 151226 - DNA, 481 bp, Homo sapiens
gagcaggatgtgggtgtgctggggaactgagttccactgtggattcatctgccaagtggcagggtttgaacgcaggtccacatggctcagagctttcctccacgccacaatgcctccccagctgtgggcccttcgttgacatctgctgaagcctccgtgtccaggcactcctggggatactgtcttgtcacactcagcagccaagacttgagaggcccccctgggccttcactcctaatccagtctgatggaagggcaggctgggtgggggcacgggctgctttggaaagcatggaaacctgaacttgaatccgccagttaagtgctgtttcccagcctcagctcagcagctccccgcggccgacccatgggtgggacctgtcacaggttctcagttaatcagatgtgaagatattagctccccccaccctgcaacaggctgtaagaaactgacaggaacaaccttctttaccaacaagaa

SEQ ID NO: 151227 - DNA, 285 bp, Homo sapiens
ttgcctttcctctcctgcctagtctctgctgagtgagggtccctccctcctgtgtgacctgtcctggaccccacgggtagtgggaggaagcacaaagtgggccccggggcccccacctccccaatggctgtacaccagcctttcccatgggcctgtgcagcaggaaagatgcttaaaaccaacccctcccaccaaatgtggcctgaggctcagctcggtactcccaccaccatcgccaccaccacaagggacccatggcccagagcagacgctgacgctgagctc

SEQ ID NO: 151228 - DNA, 615 bp, Homo sapiens
  misc_feature (33)..(33): n is a, c, g, or t
gtgactctgaggatcccctcaacgctttatacnttcttatctccacactcactgccccccagcactacccttttcctatccccaagtctttttccccaatgttattttactccaccacatgaggaggctagcattatctttgcttgaaaactgtttattaatttgcctgtcaaacattctatagaacagtttacatcttactacagaaacctcctgggtacatattgacagctcagcaagtatttacacaaagctctgaaacatttggttccttcagagacgatagaagatgctgtgtcaagcacagaattatcaaacactgttccctctacccttttccctcctttataaagggaagcttccttcctctaatatacctaaattacacttctaaactactaagccaggaagagaaagaatggaaattcaggtgtgctggagaagagaaagaatagcatttccaggaccacgtgcaaagcacaccatgtagttttttaaaccatagcgatgagaaacaacaaatgcacctatgaaattgaccctgaaacgcagcttttcctcttccagtctcaggaacatttgcttctctctcagcaaaacttacagggcaagtcc

SEQ ID NO: 151229 - DNA, 299 bp, Homo sapiens
gaattctgtcccaatctgagcccctgcattgtgccttcaaatcctcctggactgcaagtccgtaagaaacgctcctggtttcttacttttctccaaggactcctagaaggaccccacccccctccccccacccctgctcctaggaggacaacgtgatcactgtattcagctccatcaagaatggtccaggttcttctagatgatctgcacaaatggttcctctcctcctgggttcacgccaccgcactccagcctgggtgacagagcgagactccatcccccccaaaaagaaaaaagac

SEQ ID NO: 151230 - DNA, 320 bp, Homo sapiens
ctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaagttgtaggccgggcgcggtcactcacacctgtaatcccagcactttgggaggcggaggcgggtggattacctgaggtcaggagttcaagaccagcctggccaatatgatgaaaccctctctctaccaaaaaatacaaaaattggccaggggtggtgccgcatg

SEQ ID NO: 151231 - DNA, 530 bp, Homo sapiens
tgataggaaggcaccatgcacttaaaaggagtttacatgcaactggcaatttgggaaagacaaaggctcttggttttacttatttcatgctgtgaacccagttgagtccctttattcatacaccacttattgaacaatctatgcacgtgtaagtaataagtacaaatatggactctggtctaattaaaattactcagtaagtgccaagtataacctttataatttttctccagtgcttatgttctttgaatctagtatgtgtttgtacatggtttggtttcagaaagacggcatttccggaagatataaatactagctgatgtgttatttcttttatttctcacggctaagtcagatttttcatctgcactgctagaaaatcatccttgacatctatattgaaaagccacagagtcaccctgaaaaacattataaacgtctctgaattgtagcttttgcatctatagaatgggaataatattcttgtaccccatagtgctgtgggggaaagaaatcgtttaacattcatg

SEQ ID NO: 151232 - DNA, 301 bp, Homo sapiens
gacagaaagacttaacaactcaagtgagtcataggctttaataattaagttagccttgaaagcagacatgtacttttgtaagtggcaaatttcctactgattcctttcctgttatgatgtctacctggcgaccgctagtcagtcttcaaatagaccccatatacaaatatttctagaacactgaacatatttgttactacctatataagtccaatataaaagaaaaggttgagaaaaaaaaagtctgtggacttgttttaaaacttgctgcacttgttttaaaaactgaataggatgtatg

SEQ ID NO: 151233 - DNA, 1043 bp, Homo sapiens
tattttttatttatttatttttgagatagggtctcattctgtcactgaggctggagttcagtggcatgatcatggctcactacagccttcccagacttcccaggctccactcatcctcctacctcggcctcccaagtagcttgggccacaggtgcgcatcaccactcctggctaatttttgtatttttggtagagacagggtttcatctctcaaactcctgagctcaagcagtccacccgcctcagcctcccaaagtgctgggattacaggtgtgagcctccgtgcttggccagcccctttttcttttacttactatgattttgagattcaacaatgttgttgcatcagtagttcattcccttttattgctgaataatgtttattatatggatatgccacatttgtttatctatttacctgctgatggacattttggtctgtataaataaagctgctgtgaatattcttgttcaggtctttttggggacatacactttttttttttttgagtaaaaattcctgagtggaatgccttggtcatatgtcagtgtatgtttagcttcctttcctttctttttttttgtggttgtgggacaatccatggaaatgcatttaaggaactgagaaactgccaaaagtggaggtactattattttatgatctcatggtactgtaggatagattctgttctgctacatacttgtcaacatttagtatagtcttttaaagagttggggtatgtgtcccctctaaatctcatgttgaaatgtaatccccagtgttggaggtagggcctcgtggaaggtgattggatcatgggggcagataacttcacaggttggtgctgagttctctcaagatccggttttttaaaagtgtgtggcacctcccccaaccccgttgctcctgctctgccatatgagatgcctgctgcctttcatcttccaccattattataagctccctgagtactccccagaagctgagcagatgccagtgccatgcttcttgtacagcttgtccaataaaacctcttcattat

SEQ ID NO: 151234 - DNA, 480 bp, Homo sapiens
  misc_feature (21)..(21): n is a, c, g, or t
agttcgacggagactctccangtataatatcttatgtctgttaagaactgagggcttcttaaaggcttgccatgtttttcacacttgtggggttttgtacagtataaattttttttgagacggagtctcactctgttgccaaactggagtgcagtggtacaatcttggctcactgcaacttccacctcccaggttcaagtgattatcctgcctaagcctcccgagtagatgggaatacaggcacgtgccaccacacccagataatttttgtatttttagtagatggggtttcgccatgttggctgtgccggtctcgaactcctgacctcaggtgatccacctctgtgtagtgtcccaacctgacccaaacacacatagagatgcacaaacacacacacacacacaccctccatgaagcctctcctgctgcagcctaggtcccctctgtgcaatctgtacatggcagcagtgctcaggcac

SEQ ID NO: 151235 - DNA, 400 bp, Homo sapiens
catttgtactctctcatttaacagttgttaaactgaggcatagagaggctgaatgtcttgctcggagtcacacagctagcaagtagcaagctgcggtctgaaacttgggagccccattctagagtttgggttcataaccactgtagctactgtggtttttcagccacaggtggttgcttcctccttgcacttccctgcccccacttccctttatgtacatctgcatcgtggtgtttcatatgccctgttccaattatgtattaaatgttgttctctcctgctaaacagtgagccccttgagggaaggcctgcctttaattcatgcttatatccctggaatgaagagttggttgttttcagttgtttgcatgacttaaaaaaatatgacacacattatctt

SEQ ID NO: 151236 - DNA, 663 bp, Homo sapiens
tctttgcctcccaaatgtgtcacctgctgacatgtactctcatagtaagacccatcatagcaatgccacttgggcattcagtattctcgacctaacactaccttgacacaggcttttcatagcactgcctctctgctcactgacattttcaacacagtactctacgctcatgcggccccttcccatcggaagacatctggggacttaacaagcccccccctaatcacatagcagactgggccaattaacgccccagccactggctcattctgagcaaacagcctcaggcacagaatgaacaatgtgacctcggctgtaaccaactggccatcagcggcccaccaggcagggtcatcagaacccatattcttacaaaagtcctttcctaagagtactgagaggtgacctgggtgcgtcctttcctaagagttctgggaggtgacctgggtgtgtcccttctttgcaatgtgaaatgatgaaaagagcatgaaataaggaaagacgggtgtcagaagggggtgagccacagacaggaaacgcatgggggtttctgctaaacccgcttcagataagcctggactggagcagggcggaccactcagcagtcccctggaagacagtgcctgtccgggacccccaggccccacttgctccctccctctg

SEQ ID NO: 151237 - DNA, 250 bp, Homo sapiens
aaaaatacaattaacaaacttaaaagcaatagtatgaatgtttacatccctaaatagagaatgtacatttttatagtaatagaacatgaacaaaaatctaccaggtacctattcacacagaaatcataaacttattcaaaatagcgtggctaatgctcttttatcacgattccaaaaatcagaaataaaagtaaaataatgatgaaaagtgttaaaacacttaagaattaagaactcattgatagtatgg

SEQ ID NO: 151238 - DNA, 499 bp, Homo sapiens
ggtttctggtctggagggttggatggataatggcatcattatcatcgttaggaaataatagaggaaagtcaggaatgagaagcaagatgaaaagtcgcattttggacatttgagctgcaggtaccaccaggacctccaaatggagctgagtatagaggttcaggctggggatgagagaacagagagtgaatcaggacaaaattggtatgtgaatgcaaggaggtgggtgtggtcttcagggtaagtcataaagcaaaaaacaaagcctatgacaaatcctcgagaaatggaatattttagctataggccaagaaagactcagccagatgaataagaggaaaatcatataaagccactatacattctctatatggcctatctcaggcattaaatttaaaccaatctggttaaatgtcctaacttcggttacatgaaagttggatgcaatcctgatatagctgggtgccatgaaattctaggaaagagaatatttcaaaaa

SEQ ID NO: 151239 - DNA, 525 bp, Homo sapiens
tagctgtagtctcaggtcccggtgggcaaggggcattatctaatagcctaagtgatggttaagtatgtcttgggacctattagtcctaaccctggggaaaggctgctcagccctgttgattatagaccagctgtgcctgaagtcacaggttcctgccctatgtgagcctgtcagctttgtttttaccacaacctggatctgtggcttttaccccaaccagcctcccctaaccaaacatgactgtggcctccaaggagaccacttaaggagagatgaatggatttgcacagaaccatcactgatctggaaaaccactcaaagccagctgctatgtctgaagactacacagtcgtggtggtggggaagtgtgattgcatggagagggagtggggagtgatagtctcatggtggggtagtttggtctgtgaagcattctgggcctcataaatggcgcctagttcaggaaaattacctgacttacttttaccaaatccattaattttttaaattattattattattgtt

SEQ ID NO: 151240 - DNA, 208 bp, Homo sapiens
cgagctcggtaccagttcgacggagactctcaggtcctctgggcatctgtggctcctaaacactagtttggcccttatgcctcaatgatgccacattcacatctttgcttgtactgtttccctagcccataatggtcacccctcatcctctacaagtcgggttctacatattcttacagacctggctcaaatgctgcccttctctatg

SEQ ID NO: 151241 - DNA, 162 bp, Homo sapiens
ggctgcagcatcttgggcacatgcactctctccagacctcactttccccacctgtgaattgaaggtgttgagtttgctccctgaggtcattcctatggctcctgggcctctgaggatctgtcaggccccagagctgagttggggccaggccacctccttccc

SEQ ID NO: 151242 - DNA, 400 bp, Homo sapiens
catagaatacccaccagagaggatgagctaggaaaagccaggaaggtgaggcccaagcaggttattgctggcctgctagtattccatgaagtgtttggaagaagtagaaacctgatgactacaatttcctgacttaattggaccatccagttataaacagagaagagaataagggtaggagatggaatttggaatgatgcttgactttttttccccaccaagttagaacaattgtattacttaacataataccaatgtatagacattatcttcccaaataagaaacaattcaatcccaaagtttaaaatgtagtttaaaaaaatggatccttattgtaagtctgaaaaaaagtcctgcaaattagcataagcttaattttacccccttttttttgagacg

SEQ ID NO: 151243 - DNA, 418 bp, Homo sapiens
ccgggagaggtatcagtgagccgagatcgcgctattacgctccagcctgggcaacaagaatgaaactccgtctcaaaaacaaacaaacaaacaaacaaactagacattggtttttccagggtacaaagtttattggccctgcagattgagagttaactgtccgaattcccctagatactcgcttctttcccctcccaaccactggggggctgcaaagagctctgttggctgctgatttttttttcaagataaatgtgtaatatttgattacaacagagacatttattatgacactttagttagtatttacaggactgactttccttataacaatgcacttgcattttatgtttccaaatcatatgatctctgaagaatgtttgaaatgataaagctgtatgtttggtgtataatgcac

SEQ ID NO: 151244 - DNA, 444 bp, Homo sapiens
atcagtcacacccattggcccctaaggcacctgccagattccaggttcagatatttggtctggaaaatgtgatcactataacttagaggtaagcaagaagacaatggatttactgagttattactctacaccagaccccaagcattgcttttcatgaggcatctcactccctcctctttgccccactgggaggtggctacaatgacaacctggcttcccatttcagtgaagagacagacaccatcagaaagtgcttctgcaagccccctctaccccttctatgccggctcatcttcccacccatccttcccacctaaagccagccctctgcctatgcaccagacattggcttctgcctactcaaggatgtgtccagcagggcttgcttctctcgcctgcattgttcatttcccctttgcaggatcattcccatcagatgcatgg

SEQ ID NO: 151245 - DNA, 337 bp, Homo sapiens
gcctgcccccctaaaatcaactgtcttatgttcacacacacctttcctctgatttcagtgtaacaagtgtccatctttccattgaaaatgaaataatacctccatttttactttgcctcttattttttctcacttctacaaggactctgttccataaatcaccccatatttctcctttattttcaactctctgattcttaccaacaattctacatggctaaataccgtccattaaataaacaaaacaaaagcaaaaacctcccttcacccgctgttgccttccagatcctatcttttctctcgattccaatccagtaagagagtcatctataaagga

SEQ ID NO: 151246 - DNA, 458 bp, Homo sapiens
ctagaggatcgcttagcgctgatagctccaggcctgtgtgatacagccactaaggctgtctctttaacatctcatttgatcctaatgtacaaagtctctcctgtctgtggcttcgtgacatggagcacccaacaacacaacactgtctcccaagtgagagtctcagccctcagcagaagcataaccagagactcccacagctggctggccttatccaagcagaagagacttggggctcattccctggaatgcttcagcaaataagggtccttcccaaggtttggcaagccccagaggactcaatcccaaaggctgagtacagctaccttgtgtctgttgctccagctgggccttcggggaggtcaccagggggaaagggaaaggaagttgaagctgaggccgaggccccagtgctggggggaggctatcaggcgcgtaaaacgcgcccatagccccca

SEQ ID NO: 151247 - DNA, 263 bp, Homo sapiens
cacaaatcacacaacaaaaaggagaagagatattttgggttcaaaaaaagtaaaaagacaatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaat

SEQ ID NO: 151248 - DNA, 375 bp, Homo sapiens
aggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaactgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatc

SEQ ID NO: 151249 - DNA, 312 bp, Homo sapiens
ctcaacgctttatacttccagatcatctgagcctgggaatatcaaggctgcagtgagccatgatggcaccacaacactccagcctgggtgatagagtgagaccctgtcttaaaaaacaacaaacaaacaaaaccataaaacaaaatcttgaaatgtggctaatctggattgaattatgctgtaaatgtaaaatacacatcagatttctaagacttagaatgtaaaagagaatgtaaaatatctcaccagtaattttttaattgatcacatgttgcagtggtaatatttaggggtatattgggttaaataaag

SEQ ID NO: 151250 - DNA, 137 bp, Homo sapiens
gtgggatttttaaaatgccaactgaattccatttaagagcttgaaataccaccaaaaagtggtagcgaaaccttattcaggtagaagcctgttgctatggagaagttccatgggatgagggtgtatcgtggagaaaa

SEQ ID NO: 151251 - DNA, 335 bp, Homo sapiens
ttatgccgtggtgctttatgtaacatgtgcctatttacagaacattgatataacatgttggtctgcaaccaggttgttatcagcaataggaaaagcattacagagttcatatggaagtagaggagaaacaggtctaatttgggtgtgatgccctgtattagtctgttttcatgctgctaataaagacatacccaagcctaggtaatttataaagaaaaagaggtttaatggactcacagttccacgtggctggggaggcttcacaatcatggtggaaggcaaaaggcatgtcttacatggcagcaggcaagagaaaatgagaggcaatcaaaagg

SEQ ID NO: 151252 - DNA, 634 bp, Homo sapiens
tttgaacacctgaataacatttaactcctgagaccttctcggtgtagaggccactgcttccccctgctggagatggcatttcattgaagggcctctcgtggctttccctgcccccggctgtctggcctgaagaaggagaaagaaccaaactgaactatgaaaagttaccactctgaggagacctctcttaattaacacttggggccatgtttgctgttgttgagaaaggaagttggtcttcaaaactgtgactgtggatgggggatatgtgtctacgaaaaagggggcctgtgacagtataatagtatacatcgtgatgacttcgtatgatgatgataattaacatacctatcattgaggaccgatgactcatttctttatggcaacaagcaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatac

SEQ ID NO: 151253 - DNA, 576 bp, Homo sapiens
  misc_feature (533)..(533): n is a, c, g, or t
ctcaacgctttatacttcatcttaacagcagaactatatgcacacacagggtgcacacacatatatatatacacataaagtttggtgtaaataaaccatgcatggtatgctcaatttagattctgttcccagcagtttctctgcagcatgctgattgctctaaaagatggcttttgtttgctagttttgaggatttgtgaggccttacttctccattcaatttagacatcattttggacatcctacattctcctactattggaatgggcaacattctttgtggttttagcagttcttaaaaacttcccttcagggaagtataaagcgttgagctcaacgctttatacttctagatattttttatatttgggtaggactttgatccttgctaaggcaaagctatcttaaagctaccagactagccaaagtaaaattaaatagataattcactaaataaaatgggttaattttagcttcattattaagaacattagacacggcagagaatgcaaattaacattctgaataaagancttaaatcaggttattaattgctggtaaggcacatgaaattag

SEQ ID NO: 151254 - DNA, 607 bp, Homo sapiens
ctcaacgctttatacttcatcttaacagcagaactatatgcacacacagggtgcacacacatatatatatacacataaagtttggtgtaaataaaccatgcatggtatgctcaatttagattctgttcccagcagtttctctgcagcatgctgattgctctaaaagatggcttttgtttgctagttttgaggatttgtgaggccttacttctccattcaatttagacatcattttggacatcctacattctcctactattggaatgggcaacattctttgtggttttagcagttcttaaaaacttcccttcagggaagtataaagcgttgagctcaacgctttatacttcgcttaagccagtgtctcaaccatagtatggtctctttaagtcttttaaatatcactgatgtgtacacagggtcattatatccattctgtatttaaaatttacaatatatggcctttttgcccttcataggacaaagtaatatatgtgtgggcattctaaaattgtgttgtcattggtaaatctgtcactgacttcagcgaggtatacacgtacgcagtttccatgtccttgtcttagagagctctctagtctaacgg

SEQ ID NO: 151255 - DNA, 218 bp, Homo sapiens
ccaccaccaccaccaccgtcaccatcattatcaccaccatcatcatctttttcacttcttgcagcttgcaggttcccaaacaagtcccggaccagctgatcagatgggatctccccacagggctgcatacctgctgggcctcagacattcagctacttcacagagctgctttattttgctttgctgtttcaattctgcatgtgatcgtgggattctca

SEQ ID NO: 151256 - DNA, 413 bp, Homo sapiens
cttgtatttgatcctgctaagcattcattgattcactctaacatttactgaatacctattaagtgacagactttagagtgtgctggaaataaaagtaaaaagacagtccttgacttcaaggaattcacagtctagagctgggttttccaacttcagcactattgacaccttggacttgatcattctttgttgtgggaggctgctgtgtgcgttttaagatatttaccaatatccctggccactactcactagaagacagcggcagcaccccaactgtgacaaccaaaaatgtctccagatactgccaaatatcccctgggtgattctgtcccaggttgagaaccattggtctaaaagaataacaagcaagtgacaaattgtaattcaaaatgtgatgacagctatgattgagg

SEQ ID NO: 151257 - DNA, 532 bp, Homo sapiens
tgttccagccacagcaaccttttaaaggtgttcctcaaacaggccaagctcatcactgcacctcaagacctttgccttagaatgcagatcattcaggtctcagctccaatgccacctcaggcctcccaaaccaacctaagaaaaatgcccttcctccattcctctctgcacatccagagacaaagtcttgagatggtacaagagacactctgattggctatgagactgaaattttaatttggaataaccagacttttaagaaaagcccaggaaagctataggatctggctgaaatgtcaacatgaggaagaaaaagaacattcaacaaaaaatagtcaaaagcagttttttggggaaaaattattttctgttgtaaataagtgagtaaaatagtggctccaccttccgaacactttttttttttgagacagggtctcactctgtcgtccaggctagagtgcagcagcataaacattgctcactgcagccttgatctgtgctcaagcaatcctcctgcctcagcctcccatgt

SEQ ID NO: 151258 - DNA, 447 bp, Homo sapiens
ttcaagaccagtcagaacaatatggtgagatccccttctctagttctttctttcttatttttttggtgagagggggactgagtctcgctctgtcgcccaggctggagtgcagtggcacaatctcagctcactgcaacctttgcctcctgggttcaagccattttcctgcctcagcctcctgagtagctgggattataggcgcaagccaccacgcccagctaatttttgtatttttagtagagacaggatttcaccatgttggtcaggctggtctcgaactcctgacctcgtgatccgcccgcctcagcctcccaaagtgctgggattacaggcatgaaccactgagcccaacctcatttttggatattaaaaataaagctgatgtgaatatttgtgtataaatctttgtataaatgtatacttttatttctttctttttaagactgg

SEQ ID NO: 151259 - DNA, 906 bp, Homo sapiens
cttgaggtcaggagttcgagactagcctggccaatatggtggaaccctatctctactaaaaatataaaaattagctgggcgtggtggcaggtacctgtaatcccagctactcaggaggctgaggcaggagaattacttgaacccgggaggtggaggttatagtgagctgagatcacgccactgcactttagtctgggcaaccgagcaagactgtctcaaaaaagaaaagaaaaagaaaagaaaacatcttatgatctaaggacatccttgctccttggaagggatgcaggtcccctttgtggagttcagcgtggagcctgggggcaccagggacctcctcttcccacttccaacaaagtagctccatccttacctgacttttatgtcgaggttcccagttaaaagcatgcttttgaaacaatttgcagaactgctgacctgcagcaagcagtgctttgcctagactgaaaatgactgcttatggaacaaagttgattgacggagggatttctagcttgcccctgtctaggctcttaatccgtcctcccatccgcctccttgaatgatcgccttctgccctagggaacccgctggaggtgggagtgccaacaaggctcagcgagccagctgttccatctcaggcacctgacctctcgtgcagggacagacaaggggcagagccccggagagctgacattacaactcggcctctctctccaagtcttttctgaatttgtccttctaattgtgctcacggttatgaactacatgatcaataattgtaacagctaattattgatcttcctttatgataacagattacttattgagccaggcatggggctgagcacattacacagatgagctcatggaatactcagccctataaggtagcttttggcatga

SEQ ID NO: 151260 - DNA, 319 bp, Homo sapiens
attttaagcatgccgttcatgacgcagaaatctatttaaattggctgaatttaggaacagtgccacagaggaagtagtggcctacacttgcatgatggctatcctgcaagcatgatgttaatctcagatacttagagcctttggtgccctgcacaataccgcatatgtagtgggtactgaagaaatatttactaagtgactgaatgaatgcctttgtagtcttgccctgcttttttcagaagagcttgaattattgcccagttcttctctgggggaacctagggtttactggccctgttcccatctcatccattgtaaa

SEQ ID NO: 151261 - DNA, 312 bp, Homo sapiens
aacacagtatttataagaacataggcaatttagtggccattgtttttactagttttaatcatgtgaaattgccatttttctaatatccacaaatgtgtgaatataagcaattacgttttaaactaaatatcagtacagaaaaaatctgcatatacattaactatcaagcttttaaaacactaaattctttaggaaactttaaatatgcacatttgatttacatcaaacatcttttgatagggatgatataaatatccagttgcctttttgatcaaattttgcatagtaaggattttgcatttgaacaaatgc

SEQ ID NO: 151262 - DNA, 874 bp, Homo sapiens
atgtgataaataactagcatcgagccataacagtaaaaacaaacttgagctaaaattaatattacataatcattcattgttatttacatcctcagtgcatttttccagagcttgttgtggcatcaagttatacagcactttctttattgtgaaactagaatatatgaaattatgtcaatgaaatattacagataagtaggggtcaaggtttatatacatatagaggctttgagtcgtgaaaaagccttatattttaaaaattatactcattaccctgacaaaacttcatcttgcttttcaagtttaacctggagaagaaactgagaaattacaattatatggtgaagtttgaaaagtaaaatctttttcacatacatttggatgtatatatacatcaagatatttttattatttttaatgtaattgagatttcttgggactgaagtacattccacaaatgataagagtttaatgttacacttaggatgaatttaaatgtctttaccagatgcttttatttgggaaagaaaaattaattatgaaacgttagcataaaaagataaattattcagaatggaataacacacatttcttagataacgctaagtttatttgaacatcatagaatgtagaataaatttaaaatttcaaacataatcataattggtagagatgatcttcatttttctgggagtcaggtaaactttgtagctctttcatcctgaagcagatttcaaagtcaatttgtaattggcaaagaaattgggtgagtagtttcaactcagaggcttccaggaattacgtcattattcttcaacagttattcattcattagatttgttagtccttactaaatttctgagaattcaataaa

SEQ ID NO: 151263 - DNA, 958 bp, Homo sapiens
  misc_feature (1)..(1): n is a, c, g, or t
  misc_feature (11)..(11): n is a, c, g, or t
  misc_feature (25)..(25): n is a, c, g, or t
nctgccccccngtgcagctaccagnctccaggctggtcctcgggaatgtctgcaaaggatccagtgatacgacctatcttcaagtctcccagcaagattccctgctctccttcttctctccctgtgtactacccattgccagatgtattgaagaaacaaacgtgtggatggaatggtgactttgggaagatgcttgcattctttcagctgtagagaatatgtggaaggcactgactccagcagctctctgcattgccatgggacttatgaaaggacagaacattggatttcctgcctagaagcccagaatgtcagcttatcctgtggggagcagttattgcagatgaaggtggcttatagggaagatgaattggcaatgaataggtgggagtggacagcataaacccttcaggctcaactgaatttggaaagaagagaacatttagaaaatttgttgtaaggcttttctgacaactagatttgtaaaaaaaaagataagctttagtgttcttaatggcacttttggggcaaatgcagaaatcttcatccatgtccctaaactcctgtggctgctgtagggctccttctacttgtaaactctactagctctttcctggatcctccttttcttctggtaccacccatttttccttggcatatttctgctctcattgcttagggccccttcaaaaatgtgtgttgacgttgattatcttttgggaccagtgccttaagtttcctttcttcccttttgtctataaccctcgttcggtgatccctgaggaaggttatggctttaatggttgttttccaaaatttcccttttctactctcacaaatttaaaatgcagttatgttaagaagaactaataatcaacaaaagcaagggataattataaacacagtgtggcacttacactatcaataaaaacatgggcattctgacattctaagctct

SEQ ID NO: 151264 - DNA, 936 bp, Homo sapiens
  misc_feature (46)..(46): n is a, c, g, or t
  misc_feature (59)..(59): n is a, c, g, or t
  misc_feature (62)..(62): n is a, c, g, or t
agcggaaggtgagaaatgatgtcgggggaaggaagggcttagctgnacgactctcttanttnccaccgctacagattccctgctctccttcttctctccctgtgtactacccattgccagatgtattgaagaaacaaacgtgtggatggaatggtgactttgggaagatgcttgcattctttcagctgtagagaatatgtggaaggcactgactccagcagctctctgcattgccatgggacttatgaaaggacagaacattggatttcctgcctagaagcccagaatgtcagcttatcctgtggggagcagttattgcagatgaaggtggcttatagggaagatgaattggcaatgaataggtgggagtggacagcataaacccttcaggctcaactgaatttggaaagaagagaacatttagaaaatttgttgtaaggcttttctgacaactagatttgtaaaaaaaaagataagctttagtgttcttaatggcacttttggggcaaatgcagaaatcttcatccatgtccctaaactcctgtggctgctgtagggctccttctacttgtaaactctactagctctttcctggatcctccttttcttctggtaccacccatttttccttggcatatttctgctctcattgcttagggccccttcaaaaatgtgtgttgacgttgattatcttttgggaccagtgccttaagtttcctttcttcccttttgtctataaccctcgttcggtgatccctgaggaaggttatggctttaatggttgttttccaaaatttcccttttctactctcacaaatttaaaatgcagttatgttaagaagaactaataatcaacaaaagcaagggataattataaacacagtgtggcacttacactatcaataaaaacatgggcattctgacattctaagctct

SEQ ID NO: 151265 - DNA, 942 bp, Homo sapiens
gagcagaaccggttaatagtcaagcgccggaaggagagaaggagttagctgcaacgatctcttatctaccaccgctacagattccctgctctccttcttctctccctgtgtactacccattgccagatgtattgaagaaacaaacgtgtggatggaatggtgactttgggaagatgcttgcattctttcagctgtagagaatatgtggaaggcactgactccagcagctctctgcattgccatgggacttatgaaaggacagaacattggatttcctgcctagaagcccagaatgtcagcttatcctgtggggagcagttattgcagatgaaggtggcttatagggaagatgaattggcaatgaataggtgggagtggacagcataaacccttcaggctcaactgaatttggaaagaagagaacatttagaaaatttgttgtaaggcttttctgacaactagatttgtaaaaaaaaagataagctttagtgttcttaatggcacttttggggcaaatgcagaaatcttcatccatgtccctaaactcctgtggctgctgtagggctccttctacttgtaaactctactagctctttcctggatcctccttttcttctggtaccacccatttttccttggcatatttctgctctcattgcttagggccccttcaaaaatgtgtgttgacgttgattatcttttgggaccagtgccttaagtttcctttcttcccttttgtctataaccctcgttcggtgatccctgaggaaggttatggctttaatggttgttttccaaaatttcccttttctactctcacaaatttaaaatgcagttatgttaagaagaactaataatcaacaaaagcaagggataattataaacacagtgtggcacttacactatcaataaaaacatgggcattctgacattctaagctct

SEQ ID NO: 151266 - DNA, 415 bp, Homo sapiens
cggatacctgacactctgttgactcccttgagcacagtctacactgcccctaaactgcctacacccatttccccaggctggtctcaaactcctaggcttaagtgatcctcccgcctcagtctcccgaagtgctgagattacaggcgtgagccactgcacctggccccttgtccattttctacactgccttaccattgtctacactggctctcctgggccacagacagcactaaccccattgtctacaccacctattttggccaccagctgtggggtgttttcactgtctcccatagtgtctacactggctcctatgaccactgtctatgtaaacaccccactttttctacactggttctcctaggcactctctaaagtgccccctgacactgtctacactgactccctggagaac

SEQ ID NO: 151267 - DNA, 330 bp, Homo sapiens
tcacagggtatcagcttgggaatctcatggaccagatctgtggcgatcaacccttgcaaagaagcacagcgataggacaacttccctaccaccgaacagtttacataaatcaaatatgtctcctacctgtgatggacaaggtcttggagggagcgcaggtggtgggggtaacaatcctgacttggtagctgaaaagaaaaacacatactattaaggatcaccccccaaaaataaacaacaaaaaactcttatgcttgttaacttggaatggcaatggcatttgcatttaacatctttaagtttttacagtccttctgaaggcttaagaaa

SEQ ID NO: 151268 - DNA, 454 bp, Homo sapiens
acgggtgtgctgcaggaatcaatgtccctctggaggtctggcctttggaggttttcaatttccccagaagcggcggctttcagcagggcctttatgctttcatcgattgcctgtgtaccgcaagctttgtttccctgatacgtattatttgataagaaaaccggagaacacagagtctggagtcaaggccaagtccccagcatccttgcaatagagccagaatccaaaggtgtgtatctgacaagaacattagagccagtgggggcttctgagaacgtgcagagcagcattcttgttttacacatgggaaaactgagtctgggatggggatagacttacccaaggacccagccagctagagacagacaccagtattattacctccattttacatgtgcataaatggaggcatggggagagggtgagaacccaggagctctgaatcccagccatg

SEQ ID NO: 151269 - DNA, 214 bp, Homo sapiens
gactgtggctttagagaagaagcacacaccggttccaaaagaacagagactatctcagaccataaactaccgctgtttgttgtgcggcaccacctgaaatatccctgtgttgttttcttcccaaccagctagtacagaatgtatccgggctgctcaacttatttacggctccagatgtttttctgtatttgaagaaactccaccttagcagcca

SEQ ID NO: 151270 - DNA, 426 bp, Homo sapiens
ccctgctcggtattgccaccacgctggggtgacagcttgccaaaacagtgggacacagccccgatcacccatccagtcttggcatcctcaccagcgcaggcatgagctgcagaacacctggcaggaaagtcaggcaggaacccaagtgggcgctgggtcaagcttctgagttctgctggtgatgtggctccaaggagcaggcatgctgaggcagacttggcctgattagggccttttgtcctagtgggaattctgagccttccccaaagtggcagatgctggaactcccagcctcagccgatgttttcaggtgcagagggctagttcaatgaaaaggtgagcaggtctcacctgccagctcctggggacaccacgccagggtccggatgcatgagttagccaggctgtagtcccaatgacgtctcc

SEQ ID NO: 151271 - DNA, 791 bp, Homo sapiens
cttctcaggctcttcactgaaaagaatgccaaatgcctctggaagtaataaagagactgaactaatctaaaattgtttgaaacactcaagtcatttggaaccaatatatgttgtcattatcccattccagtctatcctcattcctgtccatcctcaattaccgttcagagggtaaatgtgcagatttgttatgtaagtaaattgcatgtcacaggggtttgatgtatagagaattatgttacccaggtaatgaacatagtacctgattggtagtttttcaatcctcaccctcctcttaccctgtaccctcaagtaggccccagtgtctgctgttgccatgtttatgtccatgactacccaatgtttagcttccacttataagtgagaacatcctgtatttgcttctctgtttccgtgttagtttgctaaggataatggcctctagctccatccatgttgctgccaaggaaatgatttcattcttttttgtggctgcacagtatttcatggtgtatatgtatcacattttctttattcagtccactgaatattttgaatataacccctgcctatacacagtacttacaaaatctatatgaatgcaattgtaattgtcacatggaagaccatgttaaagcattaataaattcactatagctttttgatagcatgtagttgttcaacaaaagggtacaaaaatggcaagtattaattttcctgtttatatttgtgtttcttataatctaattcttcccatggcagccaaagtaaatatattaaaaataaatcca

SEQ ID NO: 151272 - DNA, 785 bp, Homo sapiens
cttctcaggctcttcactgaaaagaatgccaaatgcctctggaagtaataaagagactgaactaatctaaaattgtttgaaacactcaagtcatttggaaccaatatatgttgtcattatcccattccagtctatcctcattcctgtccatcctcaattaccaaattatttggctgtaaagccagcaaagaaaaggaacagagcctacatcagagcttttacatgaaggaaatactgaaattggatacgacacatcaaaaatatttaaatatgaaactacagagactctggctgagttgcagcctctccagttcacatgctctctaacagaactcagtcttgatgagtgtttgcagaaaattgtcttcattgtcaaccacactccacaaaatgatggctaatttgacttttacagatttaaaaatttggaaagcatttgagattgcctgccaactccacagaactcttttcattaatcagtaaataaagttttatttaattttttcacaaagagaactttgtggtcatgaacgcctgctgtctgctccattaaaaataaagaagtcttctaaagagactctctcaaacatattcaaatacaggacttgggaagatatttcattctaatttaggagtacataattaatgtatttctttgcagctagcgtttaatgtcattgcttttatggcttatgatgtagtttgtttctttttatttaacagaaaggtcaatgtgactaataattagaactatgactgagagaagaagactgtaattagactat

SEQ ID NO: 151273 - DNA, 592 bp, Homo sapiens
cttctcaggctcttcactgaaaagaatgccaaatgcctctggaagtaataaagagactgaactaatctaaaattgtttgaaacactcaagtcatttggaaccaatatatgttgtcattatcccattccagtctatcctcattcctgtccatcctcaattaccaaattatttggctgtaaagccagcaaagaaaaggaacagagcctacatcagagcttttacatgaaggaaatactgaaattggatacgacacatcaaaaatatttaaatatgaaactacagagactctggctgagttgcagcctctccagttcacatgctctctaacagaactcagtcttgatgagtgtttgcagaaaattgtcttcattgtcaaccacactccacaaaatgatggctaatttgacttttacagatttaaaaatttggaaagcatttgagattgcctgccaactccacagaactcttttcattaatcagtaaataaagttttatttaattttttcaaataaaaaacaagtgactgagtgtgactagaatgtactctacatgagtggaaccaaacaaaatcaaatgggcccttttggcccca

SEQ ID NO: 151274 - DNA, 712 bp, Homo sapiens
accttcacatcctgaactggagagcagtgagttaaatactgtgtatggtcgttcgtgaatacattttttctagatgctgcccttattatttcaggacccttagtgctttttgtttaatgagatgttctgtgggtttgaacccttgtagtctttcatttgtgtttccttctccctcccttagtttactgagcaccttaagggatgagtttgtttgttttttttgtagaacttatttgactttacatacctataagatttcattctttcaagaaatatctactacgcatcttttgtattcctgcactgttctaggtgcctgggatacatcagaataaaacagacaatgatccctgcactggagaatctttcacgggaaagaaggactgagataaagtcaacaacactcacaaaataataaatgagctaatgatatactagacggttgtgaggaaaaaagaatgtaaggcaaggtagtggagaatgtgaggctgaggggtgcaatttaaagaggaatttaggaaagtcttcatggtgaaagacactttgagcatagacgatgaaagggagggaattggccataggaatatttccaggaagagggagtagtccatgcaaaaggcattgggcaggaacaggtatcattctatcattctgaaaacttcaggtaagaccatgtggaaaagtagtgaggagttcaggatgtgagaccagg

SEQ ID NO: 151275 - DNA, 333 bp, Homo sapiens
gttcttcccaatttctgtttgaggaaaggccctacattggctgtatctatacatgaactgtttctttgacttaatgcaaaacagcaacaacgacaacaacaaaacccctattaactagttgcaaagtgcgcagtgggaagaagcagactggaaagtttctagaatccaaaaggtcgactcctaaatattttttgaggaggaagcatgtgcatgtttcgtgcctgagaacatgagagccaggcagaggggcgttgggagggctgaggcaccacagggcagattggagaaggcaggccgaggctctcggcagcaagggccagcacgacaaatggc

SEQ ID NO: 151276 - DNA, 358 bp, Homo sapiens
taccacaaagggttacgacagctcatgaggtagacacagaccaccacttggaagctttctcactgctacgaatcagtaccattcgcaatgcttcagcagttcagagaggtctaaggcaaattcccatactaaatggaaagtggcccaatgacagaatttcttcttcacatggtagctccaagaaggtgacaggacactgcagtatcatttatatgaaagagactgaaaaaaaaaaaactgaaaactagacatgagcgatagctctgatacagcagctccactgtatacagaacagaaaatgtagaaaataaattcatttattgacattgcacaccacttggtccccttcccactccct

SEQ ID NO: 151277 - DNA, 520 bp, Homo sapiens
gtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctggga

SEQ ID NO: 151278 - DNA, 305 bp, Homo sapiens
tagacggaccgtgagaatcctcctcattccttcattaagcattgtttgttgagtcaaagctagggccaaacttctctgtccgggacacccccggatgcctgcatagaaataagagctaaatccctgaactcgaatgagctcatccagagagtggctgagacagagaagggcaactccagagggcaggtcccacaaacacacctgcatttggggggccagcagagatgggatggggggattagccacaggagggcaggcggcacagtgcagccttgtgaagcccagagggagagagagtttcgaga

SEQ ID NO: 151279 - DNA, 239 bp, Homo sapiens
cctggctttagggaggagttcatcaattctacagaggagatttcacatctttacacaggtacacaaactacacaaagagggacattcaggaggggaaacactgtggtcgctagaatccctatgtgacaccatggtctctctagagtgtctgtgtgacaccatgttctctctagagtgtctgtgtgacaccgtgttctctctagagtgtctgtgtgacactgtggtctctctggagtgcc

SEQ ID NO: 151280 - DNA, 206 bp, Homo sapiens
ccagagtccaggtggagacaagagattcaaaggaggaggggccggcacagggccagtgagtgggccgggacacagccccatctccagccctttcgtcctctctctcccaccgcagcagttacaggagaatccgacatctgagaactggcaggacagccagtcgttcacacagtcttaacacatcataatgagactgctggctgggc

SEQ ID NO: 151281 - DNA, 387 bp, Homo sapiens
taacagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggtgataacatgctgttgataacagcagagtctaacaaagctgttgcatgctgatgcttaaactaattggttcctctacacagacagtaatgggtgatgatgtattactgacatt

SEQ ID NO: 151282 - DNA, 511 bp, Homo sapiens
aaagttatttgaacctgggaggcagaggttgctgtgagcagagatcacaccactgtactccagcctgggcaacagagtgagactccatcttgaaaaaaaaaaaagtttatttcccttgaaatttctgggtggtaaaaaactcgtaactgttggaaaaatatcaataattgctgagatttatttagtactatcatgttccagacaccatttgcagcaaagtacatgtaacaactcatttaaccctcagaatacctatatgcaacagacagaattataattttcttttgtttgttttgggattttgttgttgttgttttgagacagggttttgcctaccgtcacccaggctggagtgcagtcacatgatcatacttcactgtagcctcaacctccctggctcaagcgatccttctgcctcaaccttccgagtagctgggactacagtcacatgccaccatgcttggctaatttttttttatttttggtagaaacagggtcttgccatgttgcc

SEQ ID NO: 151283 - DNA, 424 bp, Homo sapiens
gtggcttctccattgtcttttcctgccagttcagttctaacaggaataaacagacgctattcaaaagcttttcaagtctgaatgaagatgtacctagggttggtgttgatgaactttccctcactcttccttaaggaaatttgttctttcctgccatttgagagacatgttcttcctcttcttcttcaaagagctaaaatgcacctttatttgcataatgaagatagtgcagtgaagtactttcttgcattgtcaaggaaatgagctccaaaggaacttccttttagcatagagaaagctgctgtttttatttacttgcattttgcatatgaatatattttaatttagtttcaacaggtaactgaattagaaagtgaaattataaagtcatttctccaagaaagaaggtagagcttataaatat

SEQ ID NO: 151284 - DNA, 380 bp, Homo sapiens
agacaatgccttctagataaggacaaaaggccatattcattaaataccaaatagaggcaaagtcacttagggccatgagctgttttagtcttataatgcctgtgtactgtctcttgaaacagagcatggtctccatgaggtcaggaaaccaagccttcctgcagtgctcagccaggcagctggtcggctgggcctccactaggttgaccccagtccagtgctcatcgtcctccatccttcctctctcctgcaagacaagacccccgcctccaggccagcctccctcagctctacagctcaggaccaccttgccccatgacgctcttcttctcccacaggacagtatctcagggattcactcaaacaccaagaattcaaac

SEQ ID NO: 151285 - DNA, 416 bp, Homo sapiens
attgaccatttatatggttctttatagctcacagaggccttctactattctgaacaggccctctgatctgctttttaaatttacttaattgaatttactaaattactaaaatgctaaaactggatctcctctgacaaggtcttctggtcagagatatggatttcccctgatgctcccaggtaaggcaagggtcaggcaggtctcacagctgtggtcacaccagcattagacagtgcagtaagaacaggtatcctctgccacctctggcaggtggcagaagggcatgaaatttggtaggatacttgaactcacagttcccttgtctagtctcttcctcagtaaaaagtcttactatttggctctttgtttttattttcttaaacattatgccttttcctggggatatacgctatgct

SEQ ID NO: 151286 - DNA, 351 bp, Homo sapiens
acttctcagagcagccaggactttggaaactatgaaatgtcactgacatttatcatcaaatacaagcataaaatgtaagaactaaaaaatactcaaaagaaataactgcttagccctagcttctgagctaggaggatttgggctgtggaaacagggagggccagcaacctgtcccagcacaaaagaaaatagactctgaggtagataactgatcatacacagctgaccagacaagtacacagttttggaaggcaacttaatttaccattgcttttaagacatatgcaattgccttaataaaagagctttaataacagtgtattatcttatatgtactaaaatagaaataac

SEQ ID NO: 151287 - DNA, 401 bp, Homo sapiens
gtctgggcatctcagctggcacagctgggcacaaggtgggttgggttcatgaatgtttgtgccactgcagaacaagaggccccattcctgaagaggagaagatggggtggcctgacctggggagtctgcctcggacctggcactcacaacttcctgaagcctcactagtcagagtgacccaggaatggcaggtcagcagcttctgaagatgggaacatgggtgacttgtcaactcatacctcactaggtctgccgtgtgtcagcacaggactacgtgacccaccttctggccaaaccttcctctgaggcagggcgagcccagacaacacactgttggccctgaggtctgtccctggcttccaggatcatcttccatcccttctaaggacagagctgaggtg

SEQ ID NO: 151288 - DNA, 469 bp, Homo sapiens
ctgagtttagttggtaacacaagtgaagaactttttgcctcctgaaaacatctatttggaaatattccatagcaacttcatgctcgacatactcaaaactaaacatgctccctcaatgacctgtcctcgttggctccagatttcagcaagatgctaccttccactcagctgcccaagccacagacctggtggtcaccccatcctccctctcattcattctttcatcaaggtcctggtgaatctatcccatgatccagtttgatcttcaccaacactactggattactgaaaaggcctcctaaaagccctcccggcttccacactcaagtcaagacaactttaaaaatacacagtttggctgcgtgcagtggctcacacctgtgatcccagtgctctgggaggcagaagcaggaggaagaagatcgcttggacccaggatttgagacaagcttgggcaacatagcgagac

SEQ ID NO: 151289 - DNA, 474 bp, Homo sapiens
actggttcttttcctcctcccattgaaaatatttcctgtttagaaaccttttttaaaaatgagtttacagttgtttcatcacagggtcagataggtaaaactgagaaaaagatggtaattcatcttcctcctccctgcaactcttctcaacaaggaaatgactataaaatagtggagagaaaataccaaaatttggattattttcattagcattgtaatttactgtatatcttctgcctgctgtaaagcacatactgtctggaacatactttttggttcttccacattgaaatagctgtatgattgtttcttctttgcccaagtaatccatccaacttgtgaaatgttcctggcctaacctaactaatccatccaacaatgtgaaatgttcctgccctaacctaactaatccatccaacttgtgatatgttccttacctaaactaaataatccatacaccttgtgatatgtact

SEQ ID NO: 151290 - DNA, 495 bp, Homo sapiens
gactatgaggacccgaaaacgacatagaggcaggagaatcacttgaccccgggaggcggaggttacagtgagccgagatcatgccattgcactccagtctgggcgacaaaagcaagactccgtctcaaaaccaaaccaaaccaaacaaatacctagaactgagaaggtcccttttgaacaactggtccaatgcctccatggttaccgccccccaccacaccccgccacacacacacctatgcccattttacaaataaagaaactgaggtccctgaactcctggataaaacgttacatcagaggacacaaaaaacaatgaataacaaatgtttttttcttggtgattgatagtggaggtatttgaaaacattcctttttctaggatagacgagcaaagaactcatgggctgatggccctcagtattcatcctgttatcgatgacaaggcctgtgtcgtccctgcctctatcagcatgctagctcaattgctcagca

SEQ ID NO: 151291 - DNA, 631 bp, Homo sapiens
gcagttcagtggttcttagtccattcacaagttggtacaaccatgaacgctatctaattctagaacattttcatcaatccgaaaagaaacccagtacccattagcaatcacttaccaactcctccttcccctacatcctggcaaccactaatgtactttctgtgtctatggatttacctgttctgggaatttgatatagatggagtcatgcaatatgttcttttgtccagctttttcacttagcataatgttttcaaggtccatccgtatggtagctgtatcagtccttcattctgtgagcaaatagtattccatttgctactgtgaagtttgtatacaagttttggtatgggtataagttttcacttctcttgggtatctagttagtagtagaatttcctggattgtgtggtaagttctgtgtttaactttttgaggaactgccaaaccctgtcctacatctaacttaaaaaaaaaaatagcaaaaacatcaactaaaaccaataactttatggatattattagaaaatggttgattttttttaaaattttgatattgttgggctaggttatctggatcaactcttctgttgaagacatctaaaaactagataaactgtaaaaacagaac

SEQ ID NO: 151292 - DNA, 211 bp, Homo sapiens
tgggcacaaggatcttgcttccctggaaggctcagtccctcagtccctcaccccatccccacagatcttactctgccagtgtctttggctgtgttctcaattttcccttctcctacacttcatccttaatataggtttttgggcctgagtctccttatgtttatctgtccatctgtctccctggcccttcttcctgggctctcctcccctg

SEQ ID NO: 151293 - DNA, 142 bp, Homo sapiens
caagatggcactttcccatggcccacatgctgcctaagaccctgaaggctgactcctggacactgtccccagccatctgcctctctgcaactatctgccacccctccacctgccctgggacaactgcctccagatgaaggag

SEQ ID NO: 151294 - DNA, 374 bp, Homo sapiens
tatttttaagaaatcaagaggagtatatgaccaaagcctttagaattctgaaaggttggattagtaaacatggacttcatctttcccaagagtttttccaacctcaatgtatagctagtataaggaaagggttattaatagcgtaagcatttaacacgtttattttcattgtgcaaaaataattatgacagaatacttaaagttccaaaggcactgtgttcagtcctatgatatccttacaggaaatatatctgtatttttatggagggagattctgaaacataaaattgttaaagcacttgctcaaagtcatttgcccagtactttaaaatggggcttctcaacttctgcattattgacttttggggctggat

SEQ ID NO: 151295 - DNA, 310 bp, Homo sapiens
ccgtgacacatttgcacattctcagtagcatcaaccgactaaggaagtccatactttgttatgcaacattagattaagcattaatgaggctaggaaaattgtttatttaaggttataacctgaaattaaataaaacttcaggctggaagctcatattgaatactagaatcatttttaacctcttaatattaacagaaacctgattactcagtcttaaagccctttctcaatagcatttattctctgctgcaggaatatggtctatgcaaatgacattttgcctgaagaaaaaagtacagttaatggccag

SEQ ID NO: 151296 - DNA, 158 bp, Homo sapiens
tagcaggatcttaggcgcgtctgaactggggtaagcagtgtgaaagttacagttagaggtggttatctgttgtcagcagaggagggggtcacaaggtgcatggtggggagatcataagactcattgtccagaagaagaatgtcatgaggtcgatcaat

SEQ ID NO: 151297 - DNA, 320 bp, Homo sapiens
aatagggagtcattatcaagctatctttagttcactttaacacacacaattcccagaaacaatcactcaaacaattctgaccatacatataccacaactaatcattttagtggaaactatggtcaaataaaaacacaggtcaccactgtttacatgtttcttgataaaggaaacaatatacttcttaaaaatactactattgggtgggcacagtggctcatgcctgtaaacccagcaccttgggaggcccaggcaggagaattgcctgagcccaggagttagagaacagcctgggcaacatagagagaccccatctatac

SEQ ID NO: 151298 - DNA, 366 bp, Homo sapiens
aaaccgagtcaaatgcatggcacacatttttcttttctttcttccgaaagagccttcaggggtttctggagagtgagcacagcctgccttccaggcacctctgagctttcttggttgtgtgcctttcattttcatttgccctgagcggcccttgcacccactaagcccccaagggtgactttggaagacaagctccagcaaccttggtgtagttaagatgagttttaacactgaaggataaagcgaggccagaattgcagatatgctgcccaggtttgcagcccctgataatggtgaaaccttgaagggagcaaactgtgaggctgaggctgaattgatagctccaaatgttgccatggaggcttc

SEQ ID NO: 151299 - DNA, 546 bp, Homo sapiens
gtttcccatcctggctttctggttactcctggcatgactgttggtctgccccaagctgctcgatcacacacagaatagaaagtttactgagatctttctgaattctgcgtctactttgcagtgtcttagccatgtcttcctgatgtgccatctggatatatgttttcaatttgttaatacaatctgctgagaaacacgctaaagaggaagaggctagagtgctcttcgtgttgaaatcaatctattaaaaatggtacttctgcatctttgttaaaatcagttacttacttcccaaattattacatagctgatatttctcaatcttgctcataagaacaccatcaaatgccttgcttaaatctggatctgctaaacccaccacattaacctgaacctgctggtaacgtcattgaaaagacacctatacccacaaaaattaaacagtattaaaaaaaattaaagagaagaaagccaggaagccagcgcacggtgagtatctctgttctggggcagccacgtgtccctaggtcagctgtcaacaaagcg

SEQ ID NO: 151300 - DNA, 336 bp, Homo sapiens
actttgtctttttctttctcttaaactgtttacttatagccctcaacgacatgcaaaggctttcttttctgctagttcattttatttgtattttctgtgttattgtattcccttgccaaagcatcttgcagatcaaaaagtttggggaatattacagacagagatatgtttattcttaaagtcttagagtatgtattaattaggttaaaggatttataaaggtaccaatataaaaaataatcaagtattagtcttatttaaattcattaagtcttgctattccaagcaactttccaaaacaatcttcctactgttcaaacactactgataaacttc

SEQ ID NO: 151301 - DNA, 401 bp, Homo sapiens
  misc_feature (80)..(80): n is a, c, g, or t
tgccgatcccccttcgtggctagctccatcttcaatttgacagcttgttaaagcatcctgagtgttgcgaaggggaagtngcattttactactgaacatgtgagcccgatctcctaactctgggttgggagagggtcagggaatgcttcctggaggtagtggaaattgaaagggagagatgcaagggccacttaaaagagtaaggctggagtagtagactgcctggccacggggatgatgggacagaatggagaggagctctttgcttttaaaggggctccttcagtttcagccgttcagtgtaaagactgcatgtccccttggaagtattctgtggatggttgagaatgtggaactgaactagagggaggccggggccagattcagccctgaggggcagt

SEQ ID NO: 151302 - DNA, 237 bp, Homo sapiens
ctagaacagctctgtgacggcagagacttttgtgcttaggaccctggtgcaagtttcctcactcaatctcctcatctgtaaaatgggcatcagatgatacctccccactctactctgtgttttccaactgtgggttacagaatctgagcaggtgatgacatccaaccagcaggggagaaaaaagcatcaactagaaagtgatggagtgtgagcacacaataaagatgaagattagtc

SEQ ID NO: 151303 - DNA, 595 bp, Homo sapiens
atggtgctagcatctgcttgccttccagtgaggcctcagggagcccttactcatgtcaaaggcaaaacaggagcaggtgtatcacatggtggcagcaggaacaagagaaggggggaggtgccacacactttcagataatcagatctaaacaacagcaccatgccatgcatgagggatccacccccacgacccaaacacctcccatcaggccccacctccaacattgaggattacaattcaccatcagaattggagggtcagcatccaagctatatcaggctgggactgtgagaaatggaaggtcagagatttcaaggtcgtctagtccaatctcttttttacagataagataactgagatctggaaagagagatgacttgtctagggtgatacagctagtcactaaaatggatgtcattattgcatcatatggagatgtgtagattttaaagcactttcaccacctcactttattgcctcacaacaatcctccgagatgtttgtcgaatgtcacgtaagcgtgtgaacagttcccttttgactgtaccattgtagagggaactcatagattacgtaagacaaaccaaatgtcttc

SEQ ID NO: 151304 - DNA, 319 bp, Homo sapiens
atttttcctagtaagaaacccccttcaggaggttgagcttcagtttaaaggggagcatatcccaaaagagagaaaaagtaagatcacgtttgcaaaatctgcagttgcaggcaggtcataaggcttctttatatatggaagtgttctccaaggagctcaaagtactttacagatattcattaaattagtttaccaagtattctagcaaagcaggcactactgccataatttcacaaaaagaggacatcctgactccagtcaaaccacttgcccagaaatgcccaacttgctataaccagagtggaattagtttgctttg

SEQ ID NO: 151305 - DNA, 427 bp, Homo sapiens
agtgaggctcttctccataagtgataatttgcttctatattgagaaaggactttggagaaatatacaagacacattaatatgggcacctgggtggaaggagagggcaaattctgcacaggtgaggcacaaaaacagatgcatttcactatataactttctcaccttttaaaatttatgactatagaaatagttcatcaacataggttcaatttatgttaaattgataagtgaaaccgacgcattgcattaaataattgtttcaaaataatgatatcagaacgtacacatttatcatcctcaaactcagttcttttccttgacattttcccccctgggtaaaatcaataaaagaacattaaatgctaccatggaggaaataagtgtgtgaaacacgcagttcttctttacgaagtcgatttttggaat

SEQ ID NO: 151306 - DNA, 213 bp, Homo sapiens
gaattcatatgcagttcttcctaaaattttacaaacaagtagatagatcaattataatacattatagtgtattaattcatgtttaaaaaattcattgtacatatattcaaccaacacttattgaatacccatgatagaccagtgaacatgacagatatgaacagtcctatgagaatgaagagacaagaatatgagttcttcctgggggaatat

SEQ ID NO: 151307 - DNA, 297 bp, Homo sapiens
acaccaaaaaaggatcaatatatatggttgctgttgttattattaaaagttaatttgcatataccctgaatgttctgtagactgatattcaaagtgccgcctctggacaagcaacatcggcatccatcccctgggagtttgttagaaatgcagacatcagactccacctcagaccctatcaatgtgcatgttaacaaatgattcttatgcacattaaagtttgagaagccagctacagaggattattaagagcaatgaataccaactgtttctttctttgagacagtgtctcactct

SEQ ID NO: 151308 - DNA, 882 bp, Homo sapiens
gccgccaccaacacaaactctcacaccacttagtgcggtaagggacagtgcgattgccccaaagcctcaccatgttttctcgcgccccttggaaatcgcacggcggttatcccagtactttgtggctaataggccaatcccgttcgatgctaaccgagtcaggtttctgccaaccagtttcgaatttaacgccacggcctccttcattccccccgccacacctttgtgctgatgaccatggtcaccttgaaaggtgtgttgaatatggcagagccagaaaatgcaaggagcttcttctctggatcaccacttgaagaagagccacttgctcctcaggaaccctattttggactgacgtttaatacaacatggaagccaccaaggcttacagaatgtgctttccagagctgtgacctgaactgtacctggggccttttgagtgaggctggaactggagtggcctggatgcagagagcagtgtcctaaggctgtgcaggttgcaagaaagctcaagtagcctatggagaggatgcaaggcttccagctgatgccctcagccaggctcagtagcagccagaactagcctaccaacgaacctgctgatcatgtgcataagccaccttgaacgtcgatcctcctgcctggtggagccatcccagctgatgccacatgaagcagacacaagctgtccctactaagctctgctcaagttggatattcatgagtgaaataaatgactgttactaagtaattaatttttgggtggctgttatgtagcagtagataattggaacaaagcttattgacataatacatctatatcacatcctccaatccatttttttaagtaataaagttgatgtttgttttgattttcagtta

SEQ ID NO: 151309 - DNA, 356 bp, Homo sapiens
aatttagccaaatagtgagactgagaatttgaaacaggattctagatatgttgaatgagatagttgtggactgagatagttcaatttctcaattttaaatgtcaacagttatatgcaaatgtgaattaggagcagaaatacattcctagatcttgatcaggcccatgaagatattttatttttagtttctgaaatctgtgatactcagttataaaaatgggataaagttggtggctcatgcctgtaatgctaacactttgggaggcccaggcaggcggatcacgaggtcaggagttcaagaccagcctggacaggatggtgtaaccccatctgtaccaaaattacaaaaattagcc

SEQ ID NO: 151310 - DNA, 1103 bp, Homo sapiens
gtttcagaggaggcagaagtctaagctgacagctgggcagaagtgagccagcaaatggagttgaggatgagcagaggccctgggcagacacgcagcacatgcaaaagactgaagcaagacagtgcaggcacacagaaaaagtagtgggtgcaggagaggaccaaggaactccacgggaggtggggagcatcaggcaagcagggccagaccgccgagaacctaaaagccacacggaggagagcaagtctggtcttcaaggcaacaggggagccaccctgaggggtttaagcagtgaagggacctaattgatattttgttaagattcctctggcctgcatacagagcgggttcacaggggctcagagtccagagagggaggacaagcaggaggccagggcactgcttcgggctgcagaagtgctggtctcagcgggtcgactttcacccgtctgggagacagagtcacgtgcaggggtgtagcaggtgtgtggatatgctggtctgagcccagggtccaggcaggggtccagtgctccagcagccacagcagacaggcagaaactgacacaagaagaggggaactgtcctagggcacaggtgcagggtagaagacgtctagaaaccatccttcagccttgaagggaggaaatagcaagagcctgagaaccagagaccacagagcaaaagtaaccgagtgttcccagaagggagtagcctgcagtgacagggcaagatacagaaagaaaaagtatgtactgcatttatcaacgaggagaatggtttcagccaaagagggtcactggcttccttggcaagaacagtgcctatggaggaggcatgggaacgggtcctgatgtcctggggagtgagtgggaggcagactaagagcttcagctcttggggaggaggaaaggtggcaacccagggaaattcctgcagggcagacagggagtgctttttgtttttcttctaatagaagagaggggtgtttgccttggaaaattggagggataccttttccactgaaaggaagagaaagagggaaaggagaactatggatcatgatgaggacgaaggtctggcagcaggaaggagaaggtgcc

SEQ ID NO: 151311 - DNA, 304 bp, Homo sapiens
aactgcacccttcaaaaagattcagatgataaactttatgttatatgtatttaactacaatgaaaatgttatttaagacccccccacagccatacagtgtacaatacaaagaatgaactctaatgtagaatatggaccttagtcaataataatatattcatattgattcatcagttataaaaaatataccacactaaagcaagatgttaaaaatagtaggaactgactagggaagagggtatatggaaatctctactttctgctcaacttttcataaacctaaaactaaaaaagtctattaatt

SEQ ID NO: 151312 - DNA, 264 bp, Homo sapiens
attccacgtgctagaaaagtccctagcatgtggtaaactaggagtacaactccaggaagtagtctgtggagtaaaactgtctctaaattagattatctgattttttttttttttttttttttggaaacgggttatcactctgtcccccaggggggagtgcgggggggggactcggggctcattacagccttgacctccaaaaactcaggtgaccctcccactgtggcctcaggggaagcggtgacggcgggggtgcacacccac

SEQ ID NO: 151313 - DNA, 345 bp, Homo sapiens
agagtgaaaggtgaacacattgtaagcactcataccgtgggatattatgcagccattgaaaagatgtaccacacccactcaaatggctaacatttaaaaggctcacaatacgaaacactggtaaggatacggaacaaccaggccaggcacagcggatcatgcctgtaatcctagcactttggaaggctgaggtaggaggatcacttcaactgagaagttcaagaccatcctgggaaacatagcaagaccctgtttctacaaaaaaattaagaaattagctgggcccttgaggctgcagtctgccacaattgtgccactgcactccatcctgggtgacagaatgag

SEQ ID NO: 151314 - DNA, 370 bp, Homo sapiens
gtcaccattaacaattttgttttccccttcaaataaaacaaaatataacaaaaaaaagaccaaacaccaaagtgttgtcaattcatcggtaagtgtgttagaattgatttcagccatgaatgccttcaatggcatctacctggagctaaaacaaagtattcttgtagcccaaactcatgaaatgaaaacaaagcatctttcataacatggtgtaaagtaagtatccagcaaacgtgagaggtgaacccacataaatcggaaggaatttgttaacaaagacagagaacaaattttttaaaaatctgttttcacattgtacataaaaatgatataaaaacaagtgtctattttttccttatccagagtgctt

SEQ ID NO: 151315 - DNA, 479 bp, Homo sapiens
atttcttttctgaacattttgagaataaattgcaattcatggtaccctttacctctaaataactctgtgtattttaaaaacaagcgcattttatttaactatagtacaatgatcaaaatcaagaaactaacttggatacagtactgttgtctgtagatcatattcagatttcactaatcataccaataatgtccttactagagtaaattctacatcacaccttacattcacttgtcttagtctcccttaatgtgaatcaattggttactcctcttctcttgtatgacctttgagatgatatttgattaaaataggccagtatttttagaattgctttaatattgatttgctgctgcttcatgattaggtttgggttctatatttttggcagaaacactccaggagtaatattgtattcctctcagcacaccatatcaggaatcatgttgtccacatattccattaatagggatgtagag

SEQ ID NO: 151316 - DNA, 207 bp, Homo sapiens
actaactaaaagtgtaaacagctattttcactaagatagctattcatcttttaatatcatcgggcaaacctggaaaatgtgctaacatttctccagaggcgaacccataccactcgctaatacatatgaaagattttgtccctaatatttttactatctgaaaatgtgaatgggttatcactaaggtcatcctctttggtagttgtg

SEQ ID NO: 151317 - DNA, 470 bp, Homo sapiens
ctgtggtagtgtggagagggaccagcggtgggcagggccttagaactcccaagattatatgccctttgtcttccactaccagggttggtagggaaggaccattgggtgggggcagggctaggtatgtctgagctcagactctccttgggcaggtcttgctgcagctgctgtgggggatgggggtgagattcccaggtcactggagttgtgtacctaggaggattatggctgcctttgctgagtcatgcaggttaccagggaagttggggaaatacagcagtcacaggcctcacccagctcccatgcaaactgaagggccagtctcacttccaccgtgccctccccaacagctccaagtctgtttccaggaggagagtgagagggacttgagaactcgaccgaggctatttgcctcccagagtatttggggtgtctcctgggtcctgcagaagcaacccgcttccttcaga

SEQ ID NO: 151318 - DNA, 778 bp, Homo sapiens
gaaccttggaagcgggggttgcagtgagccaagaacacaccactgcactccagcctaggcaacaagagcgaaactctgtcacaaaacaaaacacaacaatattctgcttctcgtgaagtataagaacattttggtaatatactccatctttcctttcccatctttgtgctattgttgtcatgcgttgttgtattatttttttctttaaattcattttaaaagttttgttttagatagtttaaagcttttaagaaatcatttctgtttacctacttgtttactgttttcactgcttttcattcctttttatgtattcagatttccatttggtatttttccttacttttgttttgttttgttttttgatgctcaggggttgtttattttactttgttgttgattttagtttttgttttttttttggtttgaaatgtctttattttgctttttttaaaaaactcaactttttatttgtggtaactagattcacatgcacttgtaagaaataatatagagaaatcccatgtacccttactgaacctcccccagtgataacactgtaatggaatatcacaagcacagtagtgacattgatatagtcaagatacagagcatttccatcacctacagaacccagcatgtttccctttccaagcccacttgtgtccctgccttccccttaacctctggtgaccactgattctccatttctatgattttgtcatttcaacagtgttacgtgaattatatagtatgtaaccttttggaattggctttt

SEQ ID NO: 151319 - DNA, 485 bp, Homo sapiens
ttcgattcctcaaaatcctttagaaaacatttagatttagattttaaaatgtttagaacatatttttccctaagcaattgttttatctagttttttttccccccgaattatattatgtgtcatcagcgtgtgtgaggatggggaggacagctttaagaagctgctgcatttagtaccaattccttgtacaattgggaggagacttttgaaataaaatattctgtttccccagctcaagctggacatgaaaatcagaaacatggaaggagaaggggcatagccgtgacaggaaggggaaggaatttgatttgaggagcgcctggagaagcctagtctcacccaggacatcacctcccatggtagcacctttgctatcacttagtacattttctgtcttgagacggtgaaagctctttaagagcaggcaccgtgtctccttgctgtatttcagtgcctagcacgtatagaaggttaatgagtatttg

SEQ ID NO: 151320 - DNA, 957 bp, Homo sapiens
ccaggtccctctcaagacatgtggagattatgggaactacaattcaagatgagacttggttggggacacagccaaactatataaacatctaacaggaatccttggttagagcttctgcatctgcttgcagatgggagaagagagtgagaaagaaaagtggccaaattcaaatacctgtggcacgttcaagtgggaaaataaagaagaaaaagcccataccacttcagtcttttttgattatattaaatatccaggtttgtgtgacgcaatcccaagtaatattggtatcactgtactatgagctataagagaaatgttttaagcttcctattttaaggaatagttttttattatatcatggcttatagtttggttaattagcttgttttcaacacaagggttctattcagtggttgccaggtgtattccatgtaatttagaagagttcgcctctctaaataaatgggtgctactgacaaagactactcaacttgtgaaagtccaactcgcaagcatccttaatatcatttcaggaaaaaagtcacctagctaaatttttacatatataacaatataacaataataacacttattgaaactgcactatatgacacaccatgtcatgaatgaagcatatggattattttacttaagccttacaactgccatgtgaaatactgttttagtctttactacgacagttggaaatgtacttttttttcaatgttgggaacaaacagaacttcaactctgtattctacttgagcctttttcctttctccacttaactcttcattccactgtagcttatagatacttctttggagagttactatttggagacaagttgtaaaaaaagaatgtcactatttttcctgctgagaacatgcttttggttttgcaagtaaaaattcaaagttaattcccacaaagaaataaagattaaaataaaagtta

SEQ ID NO: 151321 - DNA, 667 bp, Homo sapiens
ccaggtccctctcaagacatgtggagattatgggaactacaattcaagatgagacttggttggggacacagccaaactatataaacatctaacaggaatccttggttagagcttctgcatctgcttgcagatgggagaagagagtgagaaagaaaagtggccaaattcaaatacctgtggcacgttcaagtgggaaaataaagaagaaaaagcccataccacttcagtcttttttgattatattaaatatccagagttgatgagctggagaatgcgactggcagcacaggcctagggcaccagagggcagactgtacagagacctgtgagaatggtcagaactccatggatcatgatggaatgatcagggacactataatagcgttcattttatgtattaagccagatttgcacaacaattccattgtaatacaaatgtaatctttagaagtaattttaaagcagcaaatgtagaaatgccaactctcaagtaaaagaaaacaattttcctaagccaaatgtcttttgtaagagatttcaatggtcatttgattttagtttaaagatcatctgaccttatgattcacccgattcttaaatgcacatctcaaatataattgtcttcatttggagttaatgtataaaaaataaaaacagtgaaataacc

SEQ ID NO: 151322 - DNA, 198 bp, Homo sapiens
ttattgttaacttctgttaaaaaaaaaaactcaggaatgcaaataaattttttttttttatttaaagaaaaaaacacagacttgaaacctactcagagctcaaaattggtttcatgggaacaatattttcccatgcttacatacctagaatctgttaaacagacctaagacaaacttcttggcaagcttaaatattgt

SEQ ID NO: 151323 - DNA, 249 bp, Homo sapiens
gagcttacatcccagaccctcacaggaattaagaattatgtgagtcgagcaagatgctgaaaacacgaaacaattcagaaataatctaaaaacgtttcagataaattataacataatttggtgtttctttgaagatgaaagtcgttaaaggtttttactgcaatgcattgtgctttttaaagtagtctgaaaagacaaatcaaggatcctagttttctgtctgattattagacccctcctaaaagccct

SEQ ID NO: 151324 - DNA, 359 bp, Homo sapiens
gtctcttcgatatactgatttcctttccttagcataaatgtatagtaatgggattgctggatatggtagttctatttgtggttttttgaggatgctccatactgttttccatagtggctgtattaataactggggaatctgggtgagggaaaatataaatctttttatccttctggcaaatttctctatatttgagattatttcaaaatgaattattaaaaaataattttaggtcagacatcatagctcatgcctttaatcccagcactttgagacgcagaggtgagaggactgcttcaggctaggagttcaagaccagccaggacaatatagtgagactctgtctttatcaaaacaaa

SEQ ID NO: 151325 - DNA, 578 bp, Homo sapiens
cagtatactccccagaaaaggatataatgtgcagtttgaccaaattaatttaatgttgttttttaggagcttgctggctagtgttctgaaaaacacagaaaataccggtccagtgaaaatgatacataaaacactcccctgtttttattttgccattgtctcagtttaaaagaaaaacaaaatgggatgtctataatggagaaataaagcagggctcataagtagggtcgataacaaaatttcaaaatcatataaacacaaccttgggtcctgctcaccacttacattgtgtgacttgacttaaaaattgcttccactttctcagcctcagtttccatatcagtcaaatgggaataatattaactgcctcttagggtaagtaggtgtatttattgagaaattcaagccaaatcatccagcagagtacttagcacagagcacactttgatggtcaggaactgctgcgtgagacactgatgggtgacagagggaggctcgttagggttagtccacggcagctgtgccttctgatactaaaacaaaaatatattcaacttcaatgtgcttgaaaaactaga

SEQ ID NO: 151326 - DNA, 640 bp, Homo sapiens
aaaaatcctccagtacgtaggtcagaagagctacgcagagctcaggtcagctctgtttccagggcgagattgctcaacccttctccctccgcccacaggccttatctctggcatcaacccagctccccattcctccaagggacggactcctccctccccccacagggacaaactcctctgagtctgcagaaccagaatgagaacacagaaggctggacttactgctaaccaagtgcaaccctgaccactctgacttctgacttcttcacttcgaacccaatccaaacgtaggggcgtggggtgggggagagtgaaagggagaggccaacatcaaacaccttttggccacacctgcgcacagacagtccgggccgcagaaatcaatcagtcactccaaaggggtggaagccctgggccactgccaacccaaggcccttctggaaaagctctggacttgttaagaagggttggccagggctgggtgcagtggtttacgcctgtaatcccggctcttggggaggccgaggtgggtggattgcctgagttcaggagttcgcgaccggcctgggcaacacagtgaaaccctgtttctactaaaatacaaaaaaaaattagccgggcgtggtggcatgcacctata

SEQ ID NO: 151327 - DNA, 582 bp, Homo sapiens
accaagaagacacagaactgggggcccagacagaagcaaatggttaggaatgctacaaaaccgactgacggtgaggaccccctcaaactcaatgctgtgggattttcctgggggttattacctaccctggtccccctgctgactcctagctccatctcccctcccacctgcatctctgcttcccacaggccctggggcaggagcagaggctgagcccacaccaggtgctgtttctctgacctccaccccaggagctaaatgtgaggagggcccaagaggccaatccgcccctggagagagggctgcattcgcctgcaggacattagacatcagcctttctccggaaccaaccaagcggagcccaggggaagggcttaactgaggcttaacacacatcctccatcccactagcaattaggcttcccttcacatccgtaactggctaacatggtgaaaccctgtctctactaaaacatacaaaaaattagccgggcgtggtggcgggtgcctgcagtcccagctacttgggaggctgaggcaggagaatggcgtgaacccgggaggcggaggtcacaatgagcc

SEQ ID NO: 151328 - DNA, 100 bp, Homo sapiens
ccatgggtatatccatgggtagagatggaccaaaattcaaagtccagggctaagaagagtcaggtagggcctccagtagcacaggcttctatcactgctc

SEQ ID NO: 151329 - DNA, 131 bp, Homo sapiens
cacatgaaatatgaatttctctgataaatgcttcagctcctcactcaagtagcccttttatgtagtatatagtatgtacatccgctgatgtatttcaagataatttagatgcctaattttcagttgtcttt

SEQ ID NO: 151330 - DNA, 257 bp, Homo sapiens
tccaggagccatctgggccccacagggggcggcatttcctctttttgttgaaacattccagccaagtgctggcttgggcttcatctctctgtcccactctccttcctctccccaacataagcctccttctacatcctagagctctttccattccccctcctgcagctctgggctcgctaatctcatgcttccctaagggagcttgacggctgcttctgctaacatttaataaagttctgcgtgccagaccctgtgtt

SEQ ID NO: 151331 - DNA, 213 bp, Homo sapiens
ccagaaagaagcaggaacttggtcgaaggtgccagaaccggatccaaacccacgcgtcctgtgtgccagaaggacctcctttcacctctcccatcataagtggaggggacagtcttggggccagtctctctcaacctcgggtacctttatagggacacctgtcagaactaatctgctccaagaagctacatgctcaaaggttaacccagaaga

SEQ ID NO: 151332 - DNA, 301 bp, Homo sapiens
acaatgccttgtgccagggagatatctttggcaaatacttgggaaaaaagctgtaaaaaattctatttataggctgcagggaaaaatacactcaatatgatttgaaaactattagctactcaattacaagccttgccatgttaaagaatgtcaggattctcacctgaggtgaggagttcgagactagcctggccaacatgatgaaaccccatctctactaaaaatacaaaaatgagctgggtgtggtggtgcatgcctgtagtcccagctactaaggtagctgaggcaggaggatcgcttg

SEQ ID NO: 151333 - DNA, 499 bp, Homo sapiens
aaagtcaccattaagtgataaccctgcaagccccaaataaatgaccctagaaacttagcaaagcaatacagggctatggttttataattcccctagtgcactctagcaatatttaacaagccctgtgtgtagtggtgtgggagggaaactaacccaggttaaaatcagctcagtggaaatgagcatattaacgacaaaaaggattcttcctccctcaaacagacattctccagtacgtctaaagtctgagacttttccattcttctaaataacttgtcgtaaccaatggcaaaggtattcgttagctgcagcgattatttgaatgtaggtcccctccaaaactcactgaaatttaactgccattgtaacagtactaagaagtaggacattctggccaggggcagtggttcacacctgtaatctcagcactttgggaaacctaagtgggcgggtcagttgagctcaggagctcgagaccagcctgggcaacatgttgaaa

SEQ ID NO: 151334 - DNA, 358 bp, Homo sapiens
tccagggctggagccaagcagagaattcgcatccccattcggatggctgcgctgatggtgcagccctggagggaggaggcggtagctgccattcccaagggaaggtgggggtcaagggcaggagagggagggctgcagggctcaggcctggtgactgcaggctcctgagagcagccagcgggagggtgagcttccttcagctcagggctgcacacctgccgcctctgttcccccacttctgctctgccaggctttctctgaaaaacctggcgcctcacgccccagccgtcctgggatttctggtgccccccagtctgggcctcctcccttcctctgcttgcagcaaaacacccgaatg

SEQ ID NO: 151335 - DNA, 288 bp, Homo sapiens
atctactaacaatttggacaatacagcaaatgctattgtccaagttttctaaagaagaatcaagagacctatcaagacctgtatccaggaaaagggctggactcttggtctgtcgtccaggatagagggcacggatgccatcactatcctgggctcaagcaatcctcccacctcagcctcctgagtagctgggactacaggcatgccccaccacattcggctaatttttaaaattttttttatgttgtccaggctgctcttgaaatcctgggctaaagtgatcctcct

SEQ ID NO: 151336 - DNA, 323 bp, Homo sapiens
atctactaacaatttggacaatacagcaaatgctattgtccaagttttctaaagaagaatctgaagtgaaatgacatcaagagacctatcaagacctgtatccaggaaaagggctggactcttggtctgtcgtccaggatagagggcacggatgccatcactactcactataacctcaaactcctgggctcaagcaatcctcccacctcagcctcctgagtagctgggactacaggcatgccccaccacattcggctaatttttaaaattttttttatgttgtccaggctgctcttgaaatcctgggctaaagtgatcctcct

SEQ ID NO: 151337 - DNA, 722 bp, Homo sapiens
catctccataatatcacaactgtctgaagctacttagctgccagaaaccttggcagacttcaggttgaataagtgcccatagtacattcaattattgttgcaaagatcattggatgcgaaaggtcagaactgtttgggatgcatctcagagttgatgtagttcatctctaactgctgcttgataatctttatgcatatatatgcatattatacatgtattaatctgctgattaatgtgaataatctcttcttctctccatatatatgtgcagagattaattagcagactctgctagaggtctgcctttccttccacatgtaccttccttcaggtgctgggttctgttggaagtttcttaagcctgagcctagaaggtctagttatgtgtagggaagtgttcttccctcagaagagaagagggatgataatattagctcctatttatcaagcctttttcctgtgccagcaacacagttgaatgcttttgcacaacttctcttactaaatcttcccaagtttctgcagtaagtgggattatcacttccactcaacaaaggaaggaatggagactgggagtcacccatcactcatcccaggtcactcagcgaggaagtggcagagtttagattccaaccagccagctcgactcctagttccttgtgctaaacctcctccttatcccatgccccccggcccatgcagtgtggcaatggctgtggcc

SEQ ID NO: 151338 - DNA, 192 bp, Homo sapiens
gcaccactgcacttcagcctgggcgacagagcaagactcacgtctccaacttgagttctagtggattagagaggcatagatacgtttttgtttttagtggaggtaacactgggaatgggatattctaacagtagttggttcttgctttttcctatttgtgaatttattgtcaaatttttttgactagagtgg

SEQ ID NO: 151339 - DNA, 351 bp, Homo sapiens
ttacggttttggtccgtgctaccgtatttaccccatgtgtggtggttggaaatgtcagggtttcttgattgaaaaaggaaataagagattatgccactcacagcacagaagtgggatgagccccactatggtgtatacgtgtgcgtctgtgtgtttatgtctgtgtcatctccatgtgtttctgtgccagtgtctgtgtgtctgtgcatatgtagtgtgtctgcgtgtctgtacctgtgtgtatgtctgtgtacatgtgtctgcgtgtatgtgtgtgtctctgtgtatgtgtctgtgcatgtgttgtatgtgtgtctatgttgtgtctgtatctgtgtgtgtgttgtgtgg

SEQ ID NO: 151340 - DNA, 377 bp, Homo sapiens
actctagatggatcccctgtggtcacgcaccgtgttgggccaacgcaccgtatttaccccatgtgtggtggttggaaatgtcagggtttcttgattgaaaaaggaaataagagattatgccactcacagcacagaagtgggatgagccccactatggtgtatacgtgtgcgtctgtgtgtttatgtctgtgtcatctccatgtgtttctgtgccagtgtctgtgtgtctgtgcatatgtagtgtgtctgcgtgtctgtacctgtgtgtatgtctgtgtacatgtgtctgcgtgtatgtgtgtgtctctgtgtatgtgtctgtgcatgtgttgtatgtgtgtctatgttgtgtctgtatctgtgtgtgtgttgtgtgg

SEQ ID NO: 151341 - DNA, 254 bp, Homo sapiens
taattcacaagcaaatgtcatacgatgttcacagtatttaagattcagcatatttcctgttcgcgtttttcctttaaagtctccaatgttgattagaggttttaatttaaaaaatagttgaggttagtaacctagcattgtgaaagtcagggcttgggaaattcaaacatgtaatcttttttccttttcttaaatgaaaagtctataataaggccttgtttctaaatctaacagccttggaaattaaaatgtaa

SEQ ID NO: 151342 - DNA, 291 bp, Homo sapiens
gtgactatctttccttcctctgaacagctagccattccctatggcattggcattgttttaaattacatgttcaaaagttatgagatataatagaaaagtgattaaaaaaaaaacagatgtgtgcaatttaaggactgattatggctgggtgcagtggctcacacctgtaatctcagcactttgggaggccaaggcagaaggatcacttgaggccaggagtttgaaaccagcctgggcaacacagcaagactctctctacaaaaaaatataaaaattggccaggtatggtgg

SEQ ID NO: 151343 - DNA, 451 bp, Homo sapiens
ttcttaagaaaggtttgagattatccagtccatgtgcaatgaatccttggagcattagctgtgtggccttcctactgataatctgcagttatcacagtaaagagatctctgttcctaggtcaggccttagcaattacaaatacaggaaataaaggggtactcaatgctgaagacttaattttgggtacctacaaagtcctgggaagggaaaaagaagaccttggcatttgtatttgcataaccagagatggaatgtttgaggcttttaggcataaagattaattagattttatcatataaagattagggcaaattatttttttttccagttcattcttaacatgttaagggacaaattttaatgaataaaaatttaaaggccttaaaactttcttttggattcacatttccactctggtataatccactctggtgtagtctgccctttatg

SEQ ID NO: 151344 - DNA, 412 bp, Homo sapiens
tggagatcacagaagtgggcagataatggctgatgcttctgttgcgaaccagaagtggagcagtgggcaaggagacatgagtcagaatcaagggctcaacacatgtggggactgtgggaagccaccttcagctctgggctgggcctgcaaaggaatgcacctggaaacaggtataggaaaggcaaaataaatgcaaagaagtagaggaaaaaatagtttagggaagagtaggaatcaatgagataggcaaaagcaaaaagtcaacaaggtcagcaatgctagatattggttcattgaaaagatgaataaaattggtcatttttgggtgagaatgttagagaaaaaagacacaactatccaaattgaacaaaaaggtaacaagttttgtttctagtgatggtggactaagtaa

SEQ ID NO: 151345 - DNA, 347 bp, Homo sapiens
agaataaatatcatagtctgggtagtttataaaaaacagaaatgtatttctcacagttccggaggctgggaagtccaagatcaaggtactggcagtttggtagggcctaatctctctgcttccaagatggtgccttaaatgctacatcctccaaggaggaggaacactttattctgacatgacagaaaggaaaaaaggaacaaactccctctgtcaagccctcttataatggcattaatccattcacgaaagcagagcccttgtgacctaagtacctccaaaatgccccacctcccaacagtgttgcgttgggattaagtttccaatacaaaaaattggggggacac

SEQ ID NO: 151346 - DNA, 427 bp, Homo sapiens
agtgtcaggttttagcttatagtcaggtccaggcaattagaatgtgtgagttcaggattccaagccagcagctttttggggcagcagttaaatctagatggggccagttatgggggcatgtgcctatacagtcccagtacttggaaggcagaggctggaggattgcttgagcccaggagtttgaagccacagtgagctctgtttacactactgcatgccagcctgggtaacagaaagagaccctatctcttaaaaacaaaaacaaaccttagatggtgtaggacctgacaatagtgttttaagtccaggcttgaaaacaaggcttttctaagctctgtttgcttgtcaatcttggagtccagattgacccactcagaaatatgtacttaggctagaaagtcatcagcctgtaagtgttagacatatg

SEQ ID NO: 151347 - DNA, 345 bp, Homo sapiens
tgggctttttctgcagaatacacggtctgtagattataccagtggcaaagcactgtgagtacattattacttatatctgctatatactgtgtgtgtgtgaactacttttatttgggggcttgtcacgcatacatgtgaaggacatgattatatataaggatttaattaaatctgtttataccaagaattatgtactgagcacttactgtgttctaatatgatgtttgggaaagggatatgaaagctagcagatttccaggcagtacaaggggcttattgcatttttattgaatctccaaactgagattccaggccactgattccaataattcaaaggtagattcc

SEQ ID NO: 151348 - DNA, 458 bp, Homo sapiens
caagcctttcacctgccctggacggctcggccaccatcccatttgatcacgtcaatgatcactatcgctgactgcgagagatcgctctttacgagccagagcgcggctgcctgtcctactggcagcttccactgcaccaacactggctataagcccctgtatatcccctccaaccgggtcaacgatcgctgtttgtgagctgctgcgatggcacagacgagctctacagcggcgtcatctgtgagaacacctgccccgagtctggccgtgtggagagagagtccctgccgcagaagtgcgcctgcggtgcgcacccaggcacacctcttgggaggtgccactcctgtccctaagctgtggcccctgctaatggagactcttcctctgggctctccctttagcgcctggctttggcccagtccctgggcagatctctgccctctgcagatggtccagag

SEQ ID NO: 151349 - DNA, 157 bp, Homo sapiens
aaacctctctaagccctttaacttctctaaactgaggatggtgattacaccaactttagaggtgtacttatgtgaaaaggcatcacaaatgtcagttactatagaaaggttagctagcctgcttccaccttttattagtaagaaatgacaagaaagg

SEQ ID NO: 151350 - DNA, 439 bp, Homo sapiens
agattcaaattaattccattaaaatccaattgggataaattgaaaactgtaacataagaactggaaggaaaaatttttaaattctacctatgttggaaatacaattttatgtaaaacccactttataaacatttttaaataaattctgagtatccatagaactgacaggtcttactgactaaaaaaaaagacaaatgaccaatacacatttattatacaactgatttttaaaataacttcaataataaaaacttatttttaaaattatttttcataaattttaaagattttaattaattcataaaaatattttcattcaccagctgacccaaactttaatgttcctagtactctacctcatcagggtaggctaatccagctaatgtttggattttcttccttcattttgacagtgtttttaaaagaaaaacatctgttc

SEQ ID NO: 151351 - DNA, 139 bp, Homo sapiens
ccagacatgatcctgtatagcctctgaaaatctgtaaaggtttttctcctttttaaaaaaattgctttggttcatatttggtgcttctgctctttaataggctttgtttctagtaaggtcatgcttatttaacttatag

SEQ ID NO: 151352 - DNA, 390 bp, Homo sapiens
tattcatcggcacctcgtctattcatcggcacctactatgtaacagacactgtgctgggctttctacatcccttgtctcagcacagaaccatggagtgatggctaagagctgagacctggactcagaccgcctgaaggaagtcgttcagtgccactgcttctggccatgtaactgcgggcaggtagcttgcttaattaacctctctgtccctccctgtctgtatctgccaacaggatgatctttgtacctgccttgctttggcgagaattaagttaaatgatctatttgagctgctgttgtcatcatcatcatccttacatcttcactgcaaccctgtgaggtatttttatccccattttacaggtaacaccaccgaggctcagatcctc

SEQ ID NO: 151353 - DNA, 278 bp, Homo sapiens
gggctggctgccagcaccttggagtcccaggctgccaggaaaagttcacccacacccgggctttgctggcgaagggtgagtcatatgatggccgggctcgggccctcagcagacaccaagtgtgttcccagagcagccgctcagcgcctgtaacctggaacaggccagcctttcggggcctcagttttctcatctgcctaatgggaatagcaattcccaccttccctgtgttggttgggttctcactagatgcacaggagacagcagcttgagaggga

SEQ ID NO: 151354 - DNA, 771 bp, Homo sapiens
catggtgttcagacagtgttatgaggactctgcctctgcatctttcatttctgcctcaacatcagctgctgcttcagtaggctcagaacgtgccacactgagacagcaacattactctatccattcagaatcaaaagggagtaaactttgtccaaaatttttagcaaagttcatgtgtgtatctcaagagcattccacaacaaagattctgcctgcaatcctccacttcaagccatgtgaagggctgcttcccctttgccttctgccatgattgtaaatttcctgaggcctccccaaaagctgagcagacgtcagcatcatacttccttaacagccgatggaactgcaaactgaagcagcattaatttcttaaaacagaaatttacacttcaataactaatgatgtttcaaacattccaagacttccagcagtatagatgctatgccacaaaatcctgacattgggccgggcatggtggctcacacctgtaatcccagcactttgggaggccaaggcaggaggatcaccttgggtcaggagcttgagaccagcctggcaaatatagtgaaaccttgtctctgctaaaaaatacaaaaattagctgggcatgatggcaggtgccattatgtagtcccagcttcttgggaggctaagacaggagaatcgcttgaatccaggagacggaggttgcagtgagccgagattgtgccactgcaccccagcccaggtgacacagcaagacttcatctcaaaaaaaaaaaaaaaaaaag

SEQ ID NO: 151355 - DNA, 230 bp, Homo sapiens
cgtcgcagagatgattattataataatccgatacgtacactacgtgacgcgtcgagtgtttattactaggtatggatggggatgagaaatgagaagattcaaacttctttttcagcattataacatttcttgtaatggtattacagaataaatctagaccatggtgctaaagtaccatcactgttcagtttcagccctgtgtgtttagagaacagctagtgaagatggcc

SEQ ID NO: 151356 - DNA, 558 bp, Homo sapiens
gtgatatcaactcaccgtaactccgcctcccgagttcaagcgattttcctgcctcagcctcccaagtagctgggattacaggtgcccgcaccatgccaggctaattttcctattttagtagaggcggggtttgccatgtcggccaggctggtctcgaactcctgacctcaggcgatccacccgcctcggattcccaaactgctgggattacaggtgtgagccaccatgcctgaccacgtcatacttacgatttgccggttacaaagcccactcacgttaccacgtcatctccccaagtagctggccttattggaggggactgaggctcagagagattaagcagctttctcaaggtcacacagtagtgtggtagagatttgaacctaagtctttaccattttattatacttcggaacccagggcaggctctaccactagcctagggcttgtcgtgtgtccctgaagtgcgttgaagccacgccctctttcccaccaaccctctggtctcatccacacagggtggctctttgctgtcccctcctggctaccagcggctat

SEQ ID NO: 151357 - DNA, 210 bp, Homo sapiens
tgcacttaggaccgctgagtggacagcggatgcctgtgtgactgtgctcactgtggcattgggaggtttggaagaattatgaagctgtgacctcaccaggtggctggtcaggggtgatgtgggcagaggcctggagactcagggcactgggaggtgatggggtgtgacttagaaggcagcaagtccctctgggacgatagcgctctagga

SEQ ID NO: 151358 - DNA, 479 bp, Homo sapiens
agccacataacaattattttagatactatatgtaatatattaattttcatttttagaggtattgaaatctgatatttcttactttgtcctgttttgatcatatatatgccagaggtgctatgtgtaatacattaattttcatttttagagattatatctgaaatctgatctctgtatcttactttgtcctgttttgatcatataagtcaccgggacagtctctaaaagaatgaagagtaataacacattgatacagagtatttaaaataaaaactttgtaaatacttttcatataccttttaaaatagctatacaaatgaggagagaaactagtatgtataagtggtttgtcagaggttacagactgagagccagacaagtatgtcagtctcctcacaggtctggattcagagacttccagtaatacattaaaaaaaaaaatttatgaaagatgaaaccataggctgggcatgatggct

SEQ ID NO: 151359 - DNA, 641 bp, Homo sapiens
tctattagaccagcactggtttagtcaattaaggaacccaaacaaaacaaaacaaaacaaaaaatctcagaacttttaaaaagaagtaaatctatatgctctgacttaaaaggatgcccattttacagggttaagagcttccagataggccgggcacagtagctcacacctgtaatcccagcactttgggatgccgaagtgggtggaaaaccttaggtcaggagtttgagaccagccaagacaacatggtgaaacccccaggcctggtggcgcatgccagtaatctcaactattcaggaggctgaggcaagagaattgcttgaacccaggaggcagaggttgcagtgaactgagaccgcgccattgcactccacctctgggtgacagagcgagactccatctcaacagaaacaaacaaaaaaagggccaggccgggcacggtcgctcatgcctgtaaccccagtactttgggaggccgaggcgggtggatcacgaggtcaggagatcgagaccatcccggctaacacggtgaaaccccatctctactaaaaatacaaaaaattagccgggagtggtggtgggtgcctgtagtcccagctactcaggaggctgaggcaggagaatggcgtgaacccgggagg

SEQ ID NO: 151360 - DNA, 591 bp, Homo sapiens
ggggaaatatcatttacaaaaacaatgccactcattatttagagggaaggaacaatggcttgtagcaactgcacagtgaaatagtccacagtccttatccccggcactgcatggaaagcagattcttctaagagctcattacatctttcttgatgggataaatcacatgctctccacagactagctggcctctttattcacagcaacactgacttaataaggaagaccaaagaggtggcaagatgatttaagtattcacaccgattgaaatactcttcctcaggataaaatattaaccacatgttaactctcaaatgaaaatacagcctctagcaagaaactttccacacaaagtatgagcaaaatgttccctaaaacagttggaaaaggtagtcagccacaaaatactggacacaaaggtgagtatttcaaataactttgaaaaaagccacaactcccttaccctctccatctcacttccaaatgaaaacatgaaatattttaagaaattcagaagcctatgggaccctcggcctcttcaggccctcaagcaactgagtatcatcatcatctgtacactctgcccactaa

SEQ ID NO: 151361 - DNA, 356 bp, Homo sapiens
agccttctgagacactcatctcctgtgactctggatatagacgccttcttctctggcaccaggaaaaggcacagacggggatgtcatccaggccttctcaagggaagaaaactgactgtcctctctctcatggctcataggtgtttctcatttgatgtgtgttgaatgcatctggctggtttcatcgaagctattccctgttctcaggtgccctatgtctctttagagttgaataaccttgagtttcatctttgactcactcaggagattaaatctttaatggccacttaaacacatttttaatgtaggtcagttggttatagggaaagccagcaagtcagccgataaaacactct

SEQ ID NO: 151362 - DNA, 137 bp, Homo sapiens
atctcactaacaggacagcctttgcccttctcgtccacgccctgactgtgtcatctgcctccatgggcccagattcccgggttcctacttctcagccccacctccagccatgtcccatctacttggccatcccccag

SEQ ID NO: 151363 - DNA, 469 bp, Homo sapiens
aggtgcctctgcacggcccccgcccccacagggtgcccaggtctggcccaagctgcgtgtggtaacgctgttggaacacccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccctgcgcaagtgctgctacggctactgcattgacctgctggagcggctggcggaggacacgcccttcgacttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatc

SEQ ID NO: 151364 - DNA, 313 bp, Homo sapiens
aatgggtagtatctgtacagatagataacaataggaataattttaaaatgttgtatattatgagattcccttttgtgaaacacagccaagagaaaatgccctctaatggtagataaatatgcaatttgacctagtggcctgtggaccaataatgggaaattcagaagtttaaatccatcaagagaaatgacagctagtagaccatggagtgataaccactctaaagctgatttatacgcacctgaatgtaactaagtagatatgactggaagagtggcaattttgctgctgagtccatatctagacatgccaa

SEQ ID NO: 151365 - DNA, 347 bp, Homo sapiens
tcggtcggtacctgtgagtacagctggagaatgacactgagacaagaggcagggaaagctctaagagccaaggtgtgccgtcgtcccagagacatgtggcttgatgccaaagtcccctaacccattcacttcctcctggactccagccaccccgcaatgagtcctctcctactaggccgacctgcaaaccctcaattccaatcctaaccctccctcttgcagaagcccccgggaacagggagctggaccagcccttactgccctctgaaggctcacggcccctagggctccaagcactgccagttccgacctcttgtagctctctgggccccgatgctaccactgcc

SEQ ID NO: 151366 - DNA, 446 bp, Homo sapiens
catggtgtgtgatgggatcccaccgcccctgacacaaacaagcagatggtgatccctgctgccctcaaggctgagcatctgaagcccacaagaaagtttgcttgcctggggcacctgtctcataaggttgactggaagtaccaggcagtgatagccaccctggaggaaaagaggagggaaaaggccaagatccactaccaaaagaaacagcagcagaaacaggcccaaaagaacggggagaagaaaattgcaagttcacaggggtcctcaagacccatgggcttctggtctgagcccataaagactgtttattcctcaaaaacaaacaaacagaataaagaagctgaatgcaagacaggaggccagcccttcagagaggcccccggctgccctgggaagaggctgtcctcagcaggtctctccatctcactgggcccagcaccaca

SEQ ID NO: 151367 - DNA, 411 bp, Homo sapiens
caacactagcacggatcacatgtaaccaggtacaatcatgacagtataaaactccatgccgtgcagcagggtcagacagaatgagcacggaagtacagaaaagagtcatcttcagaagcagaataaccaaaggccccatggaggtagatagatttgctataagcactgaacagcggaggatgtagccaagtgaagaaaaaagaggtcctgaaacccaggggaagagcataagcaggtataagcatggctagttcatagccacagtgctctgtcaggcctgacaacggcaaaacagacaagttgcaaagcagtggtggaaaagatcagatggtgcccttaaaaaccagattgaggagtttagacaacaaggaaggaaacagatctactcaaggttttcaatcattcaagcag

SEQ ID NO: 151368 - DNA, 367 bp, Homo sapiens
cattagacagtggggtagtatgagctgcactggtcctttcttccttcatcacattataggacatagatccttgtttctcggtccagttgtgtcatggtggttaaagggaaacttggaaagccagaaaactatttatacaacctcttgtttgtccccccattgaacttagatgcacaggcaggaaattaacctcatttttagatagtaaagaaagcccatagcttgtgtatgtgtgcctgtgagtgcatgcgtctatattagaaagctggacagaacctcaaagcctcccctataaatagttctaaaactgaacctgaggagataagctttactaactctgaaaggcaaacgatgccaccagcctgat

SEQ ID NO: 151369 - DNA, 702 bp, Homo sapiens
tgctgtaaggaagctcatagggagagtagttctgtctggtgggcaggagagcagaaatagatcaggaaacttcatgaaggaggtcatttttgtaataggccttgaaggatgggtacgatgagaatgtacagggaataaacatttactcagtgtagctagagtatgtgaatgggaataatggaaaatggatgtggcactttgggaggttgaggcgggtggatcacctgaggtcaggagttcgagaccagcctggccaatgtggtgaaaccctgtctctacaaaaaacacaaaaattagccgggcatggtggtggacgcctgtaatcccagctactcgggaggctgaggcaggagaattgcttgaacccgggaggcagaggttgcagtgagccgagattacatcactgcactccatcctgggcaagactccctctcaaaagaaaaaacctatgtgatgttctagttcaaaagcctgtgattctggactgagttatctggtcttagtggagaaaaaaacaccaaagatctgcagtttataccggtgaggatggaaaaattcaggctaaaattagggtgctactgagataaaaggtagaaagtatttcctgaagggcttactgttgattatattgaaatagaagcagagttcagagtaccttagtaactgcataaatggcaggtatgtcattgggaaatgggattg

SEQ ID NO: 151370 - DNA, 289 bp, Homo sapiens
tgtgtttttagtagagacggggtttcaccatgttggccaggctgctctcaaactgctgacctcaagtgatctgcccgcctcggcctcccaaagtgctgggattacaggtgtgagccattgtgcccagccacctctctttaggagaacaataaaccactcgttggcagctcgattacatcgaactctttccaacatgtaagagacaactgatcatcttaactggaacttatgagatgacacatgttcttttttaaatttttttttgagatgacacatattctaaatatgg

SEQ ID NO: 151371 - DNA, 116 bp, Homo sapiens
tctcgtttgacctgctagaaaatttcagtggacaaattcgattatttttatgttcctttcacctaacagaattttgtggggttaattccacatcagtatttacagatctgcgctgt

SEQ ID NO: 151372 - DNA, 781 bp, Homo sapiens
ttctatttcccatttcttgactctgaatttggaatacaagcaagactgctttcagaaataaggaatgaggccaggtgcgtgtctgtcatctgtaatcccagcacttgggaggctgaggtggatggatctcttgagcccaggagttcgagactagcgtgagtgacatggcaaaaccccatctctacaaaaatacaaaagttagctaggacaagagaaggaaataaagggtattcaattaggaaaagaggaagtcaaattgtccctgtttgcagatgacatgattgtgtatctaggaaaccccactgtctcagcccaaaatctccttaagctcataggcaacttcagcaaagtctcaggatacaaaatcaatgtgcaaaaatcacaagcattcttaaacaccaataacagacaaaaagagagccaaatcatgagtgaactcccattcacaattgcttcaaagagaataaaatacccaggaatccaacttacaaggcatgtgaagaacctcttcaaggagaactacaaaccactgctcgatgaaataaaagaggatacaaacaaatggaagaacattccatgctcattggtaggaagaatcaatatcgtgaaaatggccatactgcccaaggtaatttatagattcaatgccatctccatcaagctaccaatgactttcttcacaaaattggaaaaaactactttaaagttcatatggaaccaaaaaagagcccggattgccaagtcaatcctaagccaaaagaacaaaggtggaggcatcacg

SEQ ID NO: 151373 - DNA, 426 bp, Homo sapiens
gcatcaaccctgaaacatatcagtcattaaatatttaatttggaagtgtgaaatggcaggttcactttttagattacacattagagccctgccaatcagcactgaaggaaagttgcctacatctaaggtttggtcagactttgggaatagaagtttatacaacatctacagtaactacggcaaacacattcgtgtttgatcaatgagctgtcattccctgaaatcttttgccaagtctttagtttatccgactgccatgccgagacggtggttcacttgaaatgataaatgaaatccacaggtggttttggtatggacattttttgtttatgtcttgtgagatggaattataggactaggatttaaagcaaattgagcatcctgaataaagtctttcagtgtcttcctgttgcaattaaaataaca

SEQ ID NO: 151374 - DNA, 384 bp, Homo sapiens
aattaccaagcatatctttaaataaacgtgtaccacagcaactctaattcaaacaacaatctttaatgtaataattacactggctgtgacacgagctcagccgagagtgtatttttattttaacaaggctgagtaagtacatgagtgtgggctgagctttttgctcgatagtcaatacttgaaagctggctccaacctttaatttaagcattcgcttgtagcaccaacagggctacagggtttctagtatcaaagacacaatcctccgtcctttcatggccctacttctgtaagcagcatgattgaaccgcggcaccacagaaacttgttttccctccttctggcagcgttaagccaaaacactactgccccattcatcttagc

SEQ ID NO: 151375 - DNA, 622 bp, Homo sapiens
agccatacgttctgcattcttacccatggagcaaaggagggaaatgtcaatggaaggcttgaggtgctgaggttcatggtcaccttatcccttggatttcagggtagtgagattcatggataggcttccaagcctgtgcactgaaggagggaagggtcactaattgagaaaacaagtaatttagacagaaggagcagcactaaaggtccagaggccggagacagcacaatacacaggagaaactgtaagatcatcaatatggttggagagtggagacctggtcacagggcctctcataagctaaggcatttgaactttatcctaaatgccaaacgaggagcttcaaagcacatgcataattaagacatctgtctttttagaaaatcactttggccacagcatgagagtggatcagaggagagtaagaccagctaccaggtaggagaccagttagaagactattgcaggagcacaagcaaaggatgacctttctagtgtagtgacctacactagaaaacatagacaagggagcaggttatggaggaaatgtatgaggcgggactgagagaacttggaggactggatgtgataggtgaggaagaaataatgggtgaggcagtaa

SEQ ID NO: 151376 - DNA, 211 bp, Homo sapiens
cattatgaaaatgcttttcagctattctgttaaatcactgaggtttaaaaaagtgtttccataaatcctcaactctttaacaccactaattgcaaaacacacattttaaattcaaaacaactttctcagggggaggagggagaacacactacatttattgataaccttgaaaaaaaacagtggatcacaaatgtggaactgaaaatgaaat

SEQ ID NO: 151377 - DNA, 84 bp, Homo sapiens
ggggcctcctctctggggctggccgaggccagagccggctccctctgctcacagggaggtgtgaagggagaggtgcaggcggga

SEQ ID NO: 151378 - DNA, 316 bp, Homo sapiens
ccaggccgaggtcaaggtcccaggagccttccaggaaaagggcagatgcaggcgtgtgccatcctggaacaggcaaggcctggagtgggagctgtggctacagattctttttctgggtcagaaatggggactgatgagagagtcacagcactgttagtggagctcagagccatcatggaggctgacagacatccagggtcacctgacagctgatcaagggagaggacaacagatggcttgggttgaaacacggtttggggcttacttgggacatgtctgaggttgcaagtgggtagcaacacttagtggtggtaag

SEQ ID NO: 151379 - DNA, 425 bp, Homo sapiens
caacagctaggccatatcttgagccccagttagactgatctctaggcaaacgtcacttactagcctgaatcaggtcattcctggtatctaaattctccattttgctaaactgcttctttagcctgttcatctctctctattcttaccatctctgtcctccactacttacactgctttaattcttcttacctcatgtttacagtgcctcaactgttctatcccaaaccaccaaatttgtttcccttcatcatatcccatttctcctttccagcttctcaaaaatctaagccaaataatctgctccacccaacacttcgccttttgtttaaagcattcctcatcctcttaccaataagaacctttatcattgataaccgacctcacatgacaacacaaattgtttttaaattattttaaagtgtttt

SEQ ID NO: 151380 - DNA, 499 bp, Homo sapiens
cctctttctgcctctgcaggacagttttgtgtgtgctctgcattttcagcttcaattgctaattgtcctctcttgtcctcacttctttcactcccatctcagggtttctgcatgctggttctcctgcctggaacagccttctacccaccctttgtgacttagttcacttcccagatttcagagggcagctcagctttcccttcctcatggaaacctcccctgacctccctgagtagcccaaactctcctattgtaggcactctcagagcgcttctcatagatgcaattttacgtttgttcgtaattctgttttgttttttcacaacaataaattttgagagggcagctctatgcctagtctccaccctgtgtccccgatgcccagcacagtgcctgaagcacagtaggtattcagttgccttggtgaatgaatgaataaagccaagccaagcacagtactcagatctcaagctcatagtcactgcatagcttgtgctaa

SEQ ID NO: 151381 - DNA, 434 bp, Homo sapiens
gcaaaatctatatgcctggggatatgcatgccttaggaaatttatattaaaccaaagcaaaataaagcaaagtagaaatgagtgaaaacaaaaagccccaaagtcagtaagtgagttccctgaaaacactgttccctaatagcactgcacgcatcttagcgcgttatcagtatgaagtgctggtttatgttgattcactgcctgttttaatcagaagatcaggattctggctgcctcatgcatccaaaatatagctgccaagaatctgaacacacatgacaaaataaaggaagagagatgcacaagacccaggcccttggatctagggcatcattgtggggtcaaactcagagctttccccaagggctgcctgatttttgtttgtttgtttgtttgagatggagtcttgctctgttgcccaggctggagtgcag

SEQ ID NO: 151382 - DNA, 315 bp, Homo sapiens
aaggcctcccctttgcctaccccttatgctttccaaatggcatggcctgggggctccatggcatgcccccaggacccctacagacaccacccagcctggggacgttcactccctccttcactgttgctcctcccttggtcctcttggtaaagacagaagcgcacacactgcataaactctagttgaaggcctgataattaaggcatcgtattcaaagcaaaatacccctcccatttataccttagttgggggccacacagcatagcagttaaaagcacagacttgggagccacacacccaggctggaatcccagc

SEQ ID NO: 151383 - DNA, 584 bp, Homo sapiens
gggatgcctttgctcccttgacttgtattaccatctttgtgttttaataacccaaaatgaaattaccgttttgtgttctaagtcagtacctccaggttctagatgtcccacagagacctccagacatgttcacaactaacttcagcttccccctctccctaaccctaggtgctcttcctgggctgggctggcctgcccaggcagtgataccaccacccaatacccagataccagggtgtcctctaggctccctgctcctacctgaccagccaccaactccttccattccaactccagttctcatcctcttctctgccagtatcttagtccagactctcctcaatctcacccctacaatttgtcctttatgtggccgaccaagtgcacgttctaaaatataaagcctgatggctcatcccctggacatgttgccattgccctgtggataaagtccagatcctctaacgtgtctcagatactctgcagtctgcccgcttcttctctctttccctgtcaccctcctacccagcctctgatccagctgtgctgaagcacgtgtggctctcagtggctgtgctccccag

SEQ ID NO: 151384 - DNA, 328 bp, Homo sapiens
atgagatagttggtcagttacagcctttgtctctgaaggtatttacaagaaacttgaaataacgtcttttatttttaaggccaaaccatacttcaaaccaatttgtcctttatgtggccgaccaagtgcacgttctaaaatataaagcctgatggctcatcccctggacatgttgccattgccctgtggataaagtccagatcctctaacgtgtctcagatactctgcagtctgcccgcttcttctctctttccctgtcaccctcctacccagcctctgatccagctgtgctgaagcacgtgtggctctcagtggctgtgctccccag

SEQ ID NO: 151385 - DNA, 326 bp, Homo sapiens
  misc_feature (38)..(38): n is a, c, g, or t
gggctatatactccatggcagaagcaacactgaggctnttatatgaggtgggggactacctcatgaaaacatgagtcaggaatggcttctgaccatggtgtatgaaaagcccttgtctaaaggttactgccctgagaaaataatccaggaagaagaggatagacatgaagacactttaaagcctcctgaatagaatgcatccagaagcgaattccaggagattctgtcatcatgcttgcctttcaagcaaacaaaattagctgctagaactgagaaagagtgtaaacaccaactaaatgcctcaaagagccatggagtaaatggca

SEQ ID NO: 151386 - DNA, 783 bp, Homo sapiens
  misc_feature (742)..(742): n is a, c, g, or t
  misc_feature (745)..(745): n is a, c, g, or t
  misc_feature (747)..(747): n is a, c, g, or t
  misc_feature (750)..(750): n is a, c, g, or t
  misc_feature (783)..(783): n is a, c, g, or t
aggtcacctgacccagctcaggagcttgaagaaagggccaatggaccaggcctgtgaagtgactacttcctaagaaatggtaccatattttcatttctttcactagacactagtataagaatagagaggccatgactggaaaatgacaagatctgcatactccgagatcaacaacgaaaaggaaaagacgcgccagaaaacacataattggaaggaatctaaatgagccttgttttactttttggatgggtttctgtattatttcctcatggctgtggttcccaagcagtgggaacagagtactcactgggacactgaagggtatcttgaattttaaagaggagcgcagtgacactggacatctgttgggcatttcaacaactgctagcttgagatagttcccagtttcaacgttaggctgtgtcacacttctttcaatgatgtcataacaaatagaactgctaggtatctcttgacctacaggtcttgtgaaaaagctattgaggcactagagcactatgaatgtgcaagttggaaacctccacgttagggtatatctggtgtttaagtaattaatttcaagcatcttggatgcttgaccatctgtctcactctgggcattctaaggacaacttataatctggactccataattcgatatctatatctttgctggaatttcttcctgacgtcaccgagtcaacccattcactctctacctacatgaaaaataaagactggngcngnccngttcctttagggaagggtaattcatgatcctcn

SEQ ID NO: 151387 - DNA, 307 bp, Homo sapiens
agaaacaaatgcctggcctataaagtattcaagcctgaagaaaaagacgtctccaaacccatttgcaaggctagcataaagctaatctcgaaatagaacaggaaggtcattttttaaaaagagggaggggattggcccagggagagagataaaactcctaagtaaatacataatatactgtaaaactaagcaaggtttatatcagaaagtaaggtgtgtccaacattaggaaacctattactgtaactcagtacaatcatacaataaaatcttttgattttctccatagatgtcaacgagacatcac

SEQ ID NO: 151388 - DNA, 106 bp, Homo sapiens
caaattcaccaacaccagcagcaacaatcaggacagcacagtcagcctgagatgtccctgtaatcatgtttttgatgaagtctctgtgtcctggggcatcaatgat

SEQ ID NO: 151389 - DNA, 380 bp, Homo sapiens
ggtatgctttcagaaaaggagggcatttctccagacacagcaacatgcaccaatgcccacaggcctactgtaattagctcagtgtggtatgtgtgcagcaaaagtgaaatgaggctggggaagttggcaagggaaaaataatgaaaaggcatattaaggaatttatattttaccttgcaagcaatgaaaggccattgaaaagtttctaaaagaaaaataagacaaatctatatgacttttaggaaaattactctgttggtggtatagagaataggctgaagaaagtctgtagggaggtagttagaagcctatcgcaatggtccaggcatagttgaatgaggatgcgagcaaacactgtagtggaagggtaaaggagaaag

SEQ ID NO: 151390 - DNA, 438 bp, Homo sapiens
gtggtgaagacttcccttgtgctaaagctggagggcctttctgggattcagtgacttcagagaacccttctgtgttgcttaattcaggagatgcctacaggagctggagtcaaagctggtgagcaatccagacttatgaagatgcaggattgccttgttatttcctgtataaggactatggacaaatgagcggccagaggtattgaagacacaaaccctgagatgattcttggcctctgtctcatatccagtacatataagcctctcccatcacactccatcttgttcaacttccttgataaaaacagtggcaaggtttgagagaattgactttcattttaaaagaagttctactgtgtataaaatgctatcaaatagcattccatgctacattaaaatctttcataaaaggatgagtcaatcaacgtggcaaacttt

SEQ ID NO: 151391 - DNA, 578 bp, Homo sapiens
tccctttttgggagtgtgtgagagagagagagagtgtgtgtgtgtgtgtgtgtgtgtgcacgcgcgcacatgcgcgtgcatccttaggttccgtctaaatccgttcaagctgctgtaataaaatatcatagaccgggtggcttataaacaacagaagtacattgctcacagttctggaggctggaagttgaagatgaaggtgccagcagactcagtgtctggtgagggcccactttctggttcacaaataggatagcaccttctccctgtgtccccacatggtggaaagggttgggccctctgggatctcttttataaggccatgaatcccattcatgaggactccaacctcataaccttccagaggccccgcctccaaatgtcatcacactgggagttgggatttcaataaatgaattttggggagacagaagtattcaaactatagcaggtcctggccacactttggagtcaggacttgggtggggggctttttctgtcactgccactgtgtctgttgcaagaacctcagcgtcctccaggacctgagtgcccatcacgtgctggcctgcgaggca

SEQ ID NO: 151392 - DNA, 537 bp, Homo sapiens
atatcaaaagtctgaagagccaataacatttctaaggtcacacctcacagaattggagaaactagacaggtccaaatccaaacccagcagaagaaaagaaataccaaaatcagaacaaaactaaatgaaattgaaacaaaaaaatacaacagataaatgaaaaagctggttctttgaaaagataaataaaattgataagcattagcaagattaatcaagaaaagaagagagaagatccaaataagctctattagaaatgaaatgggagatattaccactgataccacagaaatacaaaagattattcaagactactatgaacatcttcacatccataaactagaaaacctacaggagatcgataaattcctggaaatatacaaccctcctggattaaattaggaagatatagagactctgaacagaccaatcagaagcagcaagattgaaaatggtaatttaaaaattgccaacaacaaaaaagtccaggaccagatgaattcacacctgaattctatcagacattcaattgttatt

SEQ ID NO: 151393 - DNA, 477 bp, Homo sapiens
tgaccgaagcatcaaggagggacagctccacggtgtcacctttactaggactcctattgcttctaaatggtgggtacatttgaaaagaacgggtgcatttgccaaataatacatttggtcctctatattgagaggttggagcgaggctgtggcatactatttctcaagcatcacttctcctagaaggcctctcttgttcttactcccacaattggcctcaagctgtttctctgagctaccgcatcatccatgtacatcattgtcattagcgtcagcatgcaacattcattcacttttccattaatacaagcatccatttaacaaatctttgtcgagtgctagcacaggcccaaatttaagagatttagttggtaatacagatataaacaactgaaaaagtaaccaatggtaacagttcatagtgttatagctgatgcaatattagagctttagatattgacaaagatcctggtagtg

SEQ ID NO: 151394 - DNA, 257 bp, Homo sapiens
aatatttctgagttctgagtctactaactgactccaacagtgggaaatgcagcataaagccctttcttggttctttctgatattctgcctttaaatactcaattaaccctagaaatcattttaatgggaatgactaaaacgaacaaactctccacactgaggtccatacttcagaactatgagtgctgtcgcgctttttgctcagtgatttttgtcagtagtaggctttggaaatataaacttgttaaaaggaggaa

SEQ ID NO: 151395 - DNA, 177 bp, Homo sapiens
ttgagagacatgtggataacttcagtggtctgaatttgattatgttctacatatgggaaacaatcagagtaatgtatagggatttcatagtgtaactaactacattaaaagaaatgagaactctgcacacctaagcacatgttcacaatttaaaaattcaggcaggcagttccactt

SEQ ID NO: 151396 - DNA, 543 bp, Homo sapiens
tcattgcagaggtacctgggaggaccagtgaggctataaagtgaggaatgtcttcaaggggagcaaggctgggagagaaagaccaggtaggagggaagccagtacagaaaatcagggcagagagacgggacccagataaagcagaagatggataggtggacaggagaggcatggtagcaagatggcggagggaagacgtgggaattggatggaaggcacccatggagggaaaggagagacacgcaggacatccttgtctaaggcatctgggtggaaatggaattaccctgctggaatggtctgaatatcttgtgtcctcccaaatccctatgttggatcctcacccccaaggtgatggtgttaggtgttgtgtcctttgggaggtcatgagggtgaagtctcatgaatgggacgagtgcccttataaaagggaccccagagagatccctcaccccttccaccatgtgaggacacagtgaaaaggcgccatctatgaaccaggaagcgggtcctcgccagacactgaatccaccgtgtcttgat

SEQ ID NO: 151397 - DNA, 426 bp, Homo sapiens
cgggaatgctcatcaccttgagggcgaagaaatgcttggctgtcttctccttcaccaggtgcaccctagtggatagcgacgtgggaattggatggaaggcacccatggagggaaaggagagacacgcaggacatccttgtctaaggcatctgggtggaaatggaattaccctgctggaatggtctgaatatcttgtgtcctcccaaatccctatgttggatcctcacccccaaggtgatggtgttaggtgttgtgtcctttgggaggtcatgagggtgaagtctcatgaatgggacgagtgcccttataaaagggaccccagagagatccctcaccccttccaccatgtgaggacacagtgaaaaggcgccatctatgaaccaggaagcgggtcctcgccagacactgaatccaccgtgtcttgat

SEQ ID NO: 151398 - DNA, 376 bp, Homo sapiens
aaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtca

SEQ ID NO: 151399 - DNA, 233 bp, Homo sapiens
tcctacattcattgtgtcaattaatggctcttctgttcacctactcttctactctcaattgacctgactcttaacctctccaacatatcccacaccaaaatgctcatggaatccaggacattctctctcagcaaggtttctttacttagccctccacattatttctagcccctatggtactttaagttctatttcagtcttactggacaaagatagtagcctggattccatga

SEQ ID NO: 151400 - DNA, 298 bp, Homo sapiens
gcttatataattgggaagatataccttgatcatggatcagaagacaatattgttatttgaacagacacttcaacaaagaagatatacagatgacaaataggacataaaaagatgttcaacatcattagttattaggaaaatacaaattaaaagcacggataccactattaacctatttggcaaaatttaaaagacggagcataccaagtgctggagaggatgtagaggaacagaagttttcatacactgcaggtggaagtgtaaagtggcatcactttgtaaaatagtttgactgatt

SEQ ID NO: 151401 - DNA, 465 bp, Homo sapiens
gtaacaatttcagaaaaaagtacctcaataaaagggacaaaactcaaaattcattacatatatatcttgtcacaagaaatcttctactatctattttcagtatctgagctgtgttgaagtcagcaatttgtacattctgtggcttcattttttttttctttttaaatcagctaccagacttctgagaaccgaatgtttgccaggactgagtcaaattttcctaccttttgaataagtttgtttcttgatttctgtgtatttctcacaacaaggccaatctgtatcacaattcagagtcagaaatgaatagaaaaatactgtcagatattcttggcgtcgttatcaccaggactcatacactgctctggacattccctgatctgacccaatcttaagcacctctcctctctttacacataacttccactgggccctctgaatcttctactcttgatcacaaaactt

SEQ ID NO: 151402 - DNA, 224 bp, Homo sapiens
taatccagtttggtggaggcagcagagtgggatggaaagagtaatcatctgtgatccaggaagtctgctttataattaccaagctgaccttgaacaaatcactctcttgtccctagtttcttttgttgttgttttgtttttgtttttgagatggagttttgctcttgttgcccaagctggagtgcaattgcatgatctcagctcaccgcaacctccacctccca

SEQ ID NO: 151403 - DNA, 186 bp, Homo sapiens
ctaagctgacagtcttgttgtacattggtctctcttcctagtgtctgagtatcactgagtctgaccatttcaaggtggcctcagagtgtccagacaggctgagaaccacctacctaaatcacagagactcaacccagatgctgtcttctcaaagaagttttagcagcaacaaggaagctctcctat

SEQ ID NO: 151404 - DNA, 152 bp, Homo sapiens
cttgcaaaactcccaaggaagggatttatgacaactggaagttatgacaattgagttctttgggggaggatctagttttaggcagacaagggagttcaggaggaaaaaaaagctattctcaaatcgctgtgtattccgcgctggttattccg

SEQ ID NO: 151405 - DNA, 212 bp, Homo sapiens
aggtgtgaagtttatctagttctgtgtgtgtgcgtgtgcaggtacatgttgctttacatcctggtcaatatttagtgattacagatttgtaagtttttcttttattctgcaaagtaatatgctatttcgtggctttttaatttgcatttttgattactagttaggcttagcatcttcttttttaaaactgaagactagtgaaagttgaatcc

SEQ ID NO: 151406 - DNA, 287 bp, Homo sapiens
aaaggagatttaaaagatacaataattggttaatgggtaggaggtaccgcttgccagggaagacttctgtaaagagaagtagaaaacatttaagttgaccctggagataaggtccttccaggccaaaaagaacggtatgtgcataggcccagagacaggaaggaatatggctagtctgcccatactacaggaatatgactggtctgcccatagtacatgaaacagaactgagattaagcagtgcctgatcacatcagcatatccctgcagcacttcaaggagctaca

SEQ ID NO: 151407 - DNA, 397 bp, Homo sapiens
agccctttgcaggaagagcttggcaattcctgtaatagaggatgaagacaatgaagggggtaggctggggctgagtggaagatgagactggaaaggccacgtaaggatttggacttaatcctgtggatcggcttctcaaagtgtgtgtgctgtgtgaagcccctgcatcggatcccttgatgtatagattcctgagcctccccctgggcttaccagctaaaccccttgccccacgcccttattcttaattccacctggacttctttcttcagtctctcaattcttgccactttggaagcccatgcttaggtcttagctcttcaccaaacccttgcctgattgctttaccctcctccatttctttcttttctaaacatcgctctgaatcttcttcccc

SEQ ID NO: 151408 - DNA, 463 bp, Homo sapiens
accagatcatacctccaggcttgcacccctccaagacagcccctttgcttcaggacagccactgtacccccagactcagctttcaggccctctccatcacaagactagcacctttagaccccagtttaaggccaatacccacagacccagtatccagaccaactcagctccaggctggccttcacactcccaggctttgggtctgtcccagtgccacgttgacacccatggacctcagctccaggctggcccccatggccacaggtaccaggtcagcatccaaacattcagcctccaatacagccctcatgggtacagactccaggccatccctggtggccccagatttcaggctggcccattcaagctcaggcttcaggcccagaccaggctccaaccgagtccaaaaaaggctgacccacagagccccaggcttcaggcccgacccagaactaagctggct

SEQ ID NO: 151409 - DNA, 405 bp, Homo sapiens
gagacggggtgtacgtagttaacagcaagtggaagctcagaatccgaagccctgggcctggttccgtggcttcctagctgctgactctgggtgagctgtaatacgtgactgcctgagatttccgagcctccgctgcacaacggaggtcagcactgctgaaggctgtggggcagcttcggcagatgattcccaggagggcgcttcataaaacgtcaaatgctgtgtaactcagttatcctaagggcacaggggacggtaacgtgctatctcgccgcatgttatgaagacaaaattctcacctataacgatgaattcaaaagtccttcagaaaagttagaactgctataacattccaagaattggcctctatctactacagaggtggatctatctgaaatctatgtg

SEQ ID NO: 151410 - DNA, 330 bp, Homo sapiens
atctctcacatttgtcatctcacgcgtggcttctcacattcagcgcagcatatttgactgcactcacttggcagaaaacaaaattaaaaagaggcagagagaatgtaaatggcacattctgcctgtacatggatttaaatagtgcatttcacactcgtctgcacacctcacggttcagggttctatatacaaccatccgtgcactgtacttcatgggcagtgggagcaatttttgagggtaattttgacttcttgcttttcacactctggcttcagaactcaacctccaccacgaacgtaggccccactgtaattacaagaaatcagcag

SEQ ID NO: 151411 - DNA, 216 bp, Homo sapiens
ttttaagtggaattatggtggcagaagccttggtgaagtgggctacaatgtgaatggtagaaaaggagccagaaaaaggaaaattcttctgtaatatgatttttttaaaaagaggatgacatttagtaagtagaacacacatgcttcaatttaacgtgaagaatgagatacatggcttggaccactgcatcaacaggaaaattaacaaaaaagaag

SEQ ID NO: 151412 - DNA, 527 bp, Homo sapiens
gctctgtctcccaggctgttgtgcagtggcatgatctcggcccactgcaaccttcacctcccaggctcaagtgatcctcccacctcagcctcctgagtagctggactacaggcgtgtgccatcatgcctggctaagttttaaatatttttttggtagaggtggggttttgccatattgcccaggctggtctcaaactcctgggctcaagcaacctatctgccttggccttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtgtgagagaaagagagagaggatggagttgggcaagtaccaggatcttcagagggaatcagcaagctggagatgcaggccagcctatggttttgttccagtctgagtccaaag

SEQ ID NO: 151413 - DNA, 628 bp, Homo sapiens
tttcttttgaaacatgaatggatgttctttcctaagaccaacgaatgaacttttttccctttgcctacaactggcacagacagtgctactacctagttcaagcttcagtaatcagggtagaggtttagccgttggaataaatattttaaaggttagtaaacctgcatttccctagtctcctcggtagctcctatctgtcatctactcccaattctaagtcatttccgcaaatgagtgataaaaggggaaaagatatgctagtccttccaagtatgtaaaaaacaagattaggagtggggatttttcttttactcaattagtagctgaaggcttgtgagaaccaaacaagaaatgaagtgtggcgcttggtgttgtgttaactttctatttacaatgttgacgtttgcattttggggaaaacataactttttggtttaactttttggtttactattccctttgtagattaatgctttgcatataattttataattactgtcatcattctctttatcactaaacttaatttgtacatgagaatttcacataacaacaagtctatctgattatgttgccctaaaatctaaaattagaagttactaaaaagggcaatcactaagaaaaaaaa

SEQ ID NO: 151414 - DNA, 339 bp, Homo sapiens
caaatacccagacttcaaggaggaggattttccatatgtaagactgtgttatctgtgaacagagatattttcatttcttcctttccaatctggataccttctattgctttttcttgactatttccctggctagaacctccagtacaatgttgaacagaagtggtgagaccagacatcttcgtcgtgttactgatcctaggaagaaaacatctgccttttaccatttagcatgattgctgtgggtttctcataaaggctctttgtcaggttgaggaagttctcttctgttcctagtttgttgagtgtttttatcatgaaagagtgtttgattttgtcaaa

SEQ ID NO: 151415 - DNA, 468 bp, Homo sapiens
ttccctttccaaccacctaccaccagtgctcacaggatcaagcccaaactcttcctctctgggaattagagactcctcgtgatctgatctcctcttcctcccccccacagaccatagggctctctgctacaatcaaacagctctcagctcaccagatcgtggcatagggacctggtgaggagctggccacgaagcaactatagagaccagaccagtgatggggcccaaaacccattagcaaacaaaatcaaagggcacagtgagcaaagggcagactgggtagcagggccaaacatgatgcaagcagcaccaagatcatttttgggagttacaagagagacaatcaaagtctagccaaatgaagatccatggaattaggagacaagaatagagtagctgtggtgacggcaaagcattgacaacgtggatatgtgtcaatggcagcaaggcctctaccaccttcttatc

SEQ ID NO: 151416 - DNA, 345 bp, Homo sapiens
cagggtggtgtccaggggaatggaaagggacagatgagaagtactttgaaagaaaactggaagcatgaattaattaagtgaaaattggagctcccatggaccaaaatgggaactctgtggagggagccattctggaggctcacatgacaggagatctaaaacatggaatggacaagtgaagtcaggattggcaagaaaaaaaaaaaaggtttccctgaaaatctttcagaaagagagttcaatccaattgtggggatagaagccatattgtagggaggaagaaggtatagagaggaaatgaagtagtggttaggaataaaaacttgtaagaagtttgtttgacag

SEQ ID NO: 151417 - DNA, 332 bp, Homo sapiens
caggaatccaggaaccttatcgcctcctcctccttccatacctcccagcagccggcaagccctggccgtccttcccatggaatctctctctaaagtgtccgctccacccagccccacaccactgccttgggtcggggcccccaccctcactcacctggacaagagcaatgggattggctcctcctgtcacagacataaccccagtctcctgccagccccagcccacatttaaaaccctggacagagccgggcacggtggctcacgcctgtaatccaagcgctttgggaggccaaggcaggcagatcacttgaggtcaggagttcgagaccag

SEQ ID NO: 151418 - DNA, 240 bp, Homo sapiens
gagtcaaaaaggtaaaaaatgtattaggctatacatataactgttactgttattagcttataacaacaggaggacatatgaaagtgtgagccaccgcgcccggcctatgtttttctttagagacagcctttgagttggtgataagcttatgcactgaagatgccttgaccagcaaaacctgtgtcatgagaggcagagtcccacttttctgtatattatgcacattggaattctattttc

SEQ ID NO: 151419 - DNA, 137 bp, Homo sapiens
ctattcccaagtccaaagccagtttccaccaaatgccgcatatccatttcttataaactcagtactctccaattttcattgtttccccttcttctgtttcaccctgttttcttctgtaatgagacttgcccttgtga

SEQ ID NO: 151420 - DNA, 315 bp, Homo sapiens
aatgggatcctggatactccctccctctttgtaaaacccctggagcattttgtggctgaaatttacttcttagagccatgaaatgccctccaaaaagtgaagcaccacatccaaattgcattccatgcccaaagtggttaacatccctcagagatgcaaactcagaagcatttttggttttgagagccacagtgctttacccataggatgggcaggccattccttctgctgactgcgtcagcagtccgggctccaggagaaccagcattcgcagtgggggtgtctgcactctctaccaagctgtccaggttcagg

SEQ ID NO: 151421 - DNA, 532 bp, Homo sapiens
atcttcaggcgtgattgataaagacatacccaagaactggggaagaaaaagaggtttaattggacttacagttccacatgactggggaggcctcagaatcatggcaggaggtgaaaggcacttcttacatggtggcggcaagagaaaaatgaagaggaaacaaaagcggaaccccttgataaacccatcagatctcttgagacttattcccacaacacgtgggaattctgggaaatacaattcaaattgagatttgggtgggaacacagccaaaccatatcaccaaatacatacctatttaataatccagaaaatacaatcttatgtacttaagagaagtgaaaatattatctacagaaagacatatatatctgatttgttcataggaggtttattcatgacagcctcaaatcagaaacaactacatatccatcaatagggaaatatattaaaaacaaaacaaacaaatgctcccaaacctgtggtatattcataaaataaagtattacaaaataaaatgatcaataaaaac

SEQ ID NO: 151422 - DNA, 553 bp, Homo sapiens
taaaatatagtccgtattcattcataaaaaaaaaaaagttagctgtagtaaagactctcacactggaaaaagaggtttaattggacttacagttccacatgactggggaggcctcagaatcatggcaggaggtgaaaggcacttcttacatggtggcggcaagagaaaaatgaagaggaaacaaaagcggaaccccttgataaacccatcagatctcttgagacttattcccacaacacgtgggaattctgggaaatacaattcaaattgagatttgggtgggaacacagccaaaccatatcaccaaatacatacctatttaataatccagaaaatacaatcttatgtacttaagagaagtgaaaatattatctacagaaagacatatatatctgatttgttcataggaggtttattcatgacagcctcaaatcagaaacaactacatatccatcaatagggaaatatattaaaaacaaaacaaacaaatgctcccaaacctgtggtatattcataaaataaagtattacaaaataaaatgatcaataaaaac

SEQ ID NO: 151423 - DNA, 235 bp, Homo sapiens
aatctattgaagatacttttggtagcctaaagggagacacaagctgatgcgttcaaacctgcaagtaatttaggatgttctcttctgattggtagcaacagtgattcctaagctagccactctgccattagctgtgagctcccctctcttaataatcaacttacacaggcttagaaactataaactatatgtaatagaatattaaaatgaaacccctactgttccctgcaggtga

SEQ ID NO: 151424 - DNA, 490 bp, Homo sapiens
ttcaaacaggtaagtatttactcctgagaagcttaaacccactagggcaataagacatgtataagaatgaatctcgtatcagagagaatgtggcttcttcgtaagagatgcagagtagtatagaattcaagtgggaatccagttgtccttttgcttgaaggatcatagggactgcttaaaggaagtagatttctttttttttgtttttgttttttggaaaaggccaagctctgttgcccaagctggagtgcagtggtgtgtttatagttcactgcagcctcaaactcctcggttcaagcaatcttcctatttcagcctcccaattaggtgggactacaggtacacaccaccacatccagctaatttattgtatttttttgtagagacagggtctcactatgctgcccagtctggtctccaactcccagcctcaagcgatcctcctgtcttggcctcccaaagtgctggagttataagtgtgggccagatt

SEQ ID NO: 151425 - DNA, 292 bp, Homo sapiens
cattgggggaggacgagagagtgaaccagacacacacgtcaggatagcgggtatgtagggtattaggtgtgaagtgctctggagagggagcaagcagacagggtgacaagtgtgaaggagggcgcaattttaaaggtgggtaaagtgggtgtaagaagatggcccaggcacagagactcactgaaagtaggggagcaaaccacagggacaaagggggcgagcctgtctacagacagagggtctcggggacagacaatgtgttcccctccatttctgtaccaacaatgcctgg

SEQ ID NO: 151426 - DNA, 476 bp, Homo sapiens
caccctcgcgacgtgttatcctgcaaaacagaatatgagagataaaagcgagaaaggaaagatttggtcttttagaaaacattccttcgttttcaacgaatgcatcaattgtttcaggcttctctgactttaatgtacttagggatcacctaaggattttatgaaatgaggattctaattctgaattctaatccagtggtctggggcaggacttaagagtctgcattactaacaagctcccaaatgattccagtgctgctgatacaacaatctcgttttaaggatcaggaaaagagagaacaaagcatatgaccccaactaattaaaccagacaagactcacgtggcccctgctcagcacctgtgatcggagtgggtcctagattggctcttccatgtaatctgtctctgttttatatattttcattgcaattgcatgtctgcggttttagaaggttttttttttggttttttttt

SEQ ID NO: 151427 - DNA, 343 bp, Homo sapiens
ggcctgcagactgcagtttgccaacccctgctctaaagctttaaaaccaaaactcaaatgcacaggctgattttgttgactgtttaattataacttcaagtggtaccaggcaagcttaacgaacaggaacctagtggttatcaaactggtttgtctgcaggaaccttggaaagtccctaaaaccgtaacataaagacattccactataatcctatgtgatctacaccagaggtatgaaaactacaaccggaggcaaatctgacccactgtgttttagtaaataaagttttaattgaacagaaaagctcatttatgtactatttatggctgctttagcactaca

SEQ ID NO: 151428 - DNA, 478 bp, Homo sapiens
ttggcttttgaaggcctctcctggtccagtgtggattctgtaaagcttttttgaaggtcttttagcaatgaagaaagtatgtactaggagatgaaggcatgggaattggctctaaccccatttctacaagtagcgcgactgtgaattgtggtggggctcaagttcttaatgtgtaaaatgggaacgatgatacctcccagagtcatcagaagatcaaatacaaccatgaacgtgtttgtgctctacgagctgtaattcctaaaagataggtaggttaagatgaagaaaaggcattgttgagtttctcatgaacttctgatgcaaggcgtgttctagtgtatcatgcgtaaggaatcttttccaagcccgagaaaaactatccggtgccaagtgcatcaccactgggcataagtagtcccacccaagacaggaggggtgcagggctcctgccactctgcgtcatgaagaggaattgaaa

SEQ ID NO: 151429 - DNA, 331 bp, Homo sapiens
gcacactttctcacgaggaagcattcatgactatataaatgtccacaaataagggtgcaaatacagaatgatttgtccgcccagcactttggaaggccgcggcgggtggatcacgaggtcaggagatcgagaccatcctggctaacacggtgaaaccccgtctctactaaaaatacaaaaaattagccgggcgtgttggcgggcgcctgtggtcccagctactggggaggctgaggcaggagaatgctgtgaacccgggaggcggagcttgcagtgagccgagatcgcgccactgcactccatcctgggtgacagagcgagactccgtctc

SEQ ID NO: 151430 - DNA, 376 bp, Homo sapiens
tttcttccatcatctcataattcagaacttccattatagtttggcaatagcttaaatatcttgttcagccaccaatgccaattcgctcctcaacatactcccttctctgaaagcactgtacattcttctttgcctattccatcccaatctcatccatttgcccaggtttgtctgaagctttacctcctttttgaaatttctccattctccaaaccatatatatcatttaatttcctaatcctcatgtgcacataaactaaacaaaatcactgttcctctacactattctgtcttgaactctaatttattaagattgtacatccctctttctcatgtctccaatcttaccccactggctccaaatgtacaccttcta

SEQ ID NO: 151431 - DNA, 121 bp, Homo sapiens
taatattttacaattagataaaatgtgcaaataaaatatagaagaaagagttatatatatacactcacaaaatagcaacaaaaacattaacaaacacggtataagcaacaaataaatagaa

SEQ ID NO: 151432 - DNA, 395 bp, Homo sapiens
taaatgcacataagtgacttctttccagtcacttggattaatagctcctttttaaatgtccctctccccacactgacaacccctttagtctttgataaatgtttttttaaagccacaaaatcaattcaaaggcaaagagaataccttatccattgacattaacataaagcccccaaggatccacatgatcaattggtcaaaggtctaagtagagctggttctttgtttcctctcaaactttttactggagagactaagggacagatgttaataaccttagggcacaagcggaacaaactcagctctctgcataaggttaaattagcagatgtaaggatgaaaggagctaggaagccatttcattcatatatttagggtaaactttaagtaaatac

SEQ ID NO: 151433 - DNA, 112 bp, Homo sapiens
tgctcttttagtaataacagtgttgtacatttccttttgtctctgtgagatcacccagtagccactacctgtagcattgccaagattagctcccttgttgatactaaccagc

SEQ ID NO: 151434 - DNA, 434 bp, Homo sapiens
cttcctgctggtgcgtacatgtgcgtatgtgttcttatggacaggaacatgtcaaggaggacttctcgcctttctaggaaatttctccttccctgccacccctcctgtatccatggatatacccagaattctacctctggctcttctggtcctttccctgcattccagtctcctgggcacgtgtggcttttcccacctcctccccgcagatgccactcaagtccctgcttgtaggttcatatttccacctgcccggggggaggaaatacataacctggatgtctacagaggtcgtatccaaaacaagcaagtgaccttcaacctcctcctcctccaccagcctcttctcttacacgatgaagggagtcacaccactgaactgccgcccaagctccaagtcggccctgaagcccctcttttcctctggcccttcc

SEQ ID NO: 151435 - DNA, 252 bp, Homo sapiens
ttcacacagttttcccaatgcaccatgagctcagaattcccgtgaactcctggtgcgtgggagttcagcaagacttcaagcgagtgcaaggtaagtgtgttaccaatacaactgagtaagcaggcaggtgggtgctgactgcccaaagaggcaatgacttccatttgaaccagaacttgattgcatacagaaatgtctttctaagaaacacaaatgaccaaggaggcttagcgttttatctctttctcatgt

SEQ ID NO: 151436 - DNA, 102 bp, Homo sapiens
ccacgtcggcctcccaaagtgctgggattacagacgtgatccaacatgcctgggcaagaatacctttcgttgagcaaattgttgagaggtagaatgaggaaa

SEQ ID NO: 151437 - DNA, 569 bp, Homo sapiens
ccaggaattacaccaaccacaggtcaaaaatattaaaagttgtgtctgtactgaacacgtacagacttttttccttgtcattattccctaaacattatagtataacaactatttacttggcatttacattgtgtgaggtataagtaacgtagaatgacttaaagtatacaggaggctgtgtataggttctatgcaaatactacaccaccttatatcaggaacctgagtatccctgcattctggtatttgcagattgtggaaccaattcctcacagatatggagggacaactgtattttccacattccaaggttattttgaaaaaagatgcagaatatccctccctatgaatttgtcctcaaagccatcattactgccactgaataactggatttacaacactgaaatatacttttcagaaagaactcagccaggtgggcagatcacgaggtcaggagatcgagaccatcctggctaacatggtgaaaccccgtctctactaaaaatacaaaaaattagctgggcatggtggtgggcgcctgtagtgacagctacttgggaggctgaggc

SEQ ID NO: 151438 - DNA, 164 bp, Homo sapiens
catagaaatgctaacaggatagtattgtgctagatcacattcatctggcaacaagaatagaagatgtgacattgtacatttagtaacaaaagaaaatgcggccctattaagactagaaagtactgaagaagaattatcctcctattttttccaattgcatagcc

SEQ ID NO: 151439 - DNA, 636 bp, Homo sapiens
taacacttagggattaaggacttaaaatagtcacttcatcaactgtctaagccatgtctgtgcccttgttaactaatctgctaatcggttaaacacaacttctgtgtgacacagcattctatgtctttaaatgcttctacatgcagctctccagcaccactgaattcagacttggggccatgtaattaggtttcttgaaaggcaagattttgctgaaaatgcagtgtgtctcgcagaacttataagcaatatcaccctctacattatgagtcacaaagccctaaatcacgaggcttgatacttcctttaagccagaagctactctggctaccagccctgagccaaactaagaagtcagcacagcatctttcccctttctatgtacatttcctctccagccacatttagacatccaattccttgtgtttctccccctcttcttttgtccaaaggttagtaccttcagaaaattacctgaaactcatttaaaccaagataatgaataaaggataaggctgaattaccccttccagaggatttcttctcactgtaacaaggatcaaaatcttaagcttaaaaaaaatctcttttctattatgtagggatgccaagttattttctaggacagtagggttt

SEQ ID NO: 151440 - DNA, 312 bp, Homo sapiens
aagaatggggaaaacgtgttttcaattcaaattaaacaaggagtaacaggcaccgctcctcagtccagaggcctggccctgccaagaaggcgctctccggaatcaacacctgggggcttggaaggatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaaca

SEQ ID NO: 151441 - DNA, 318 bp, Homo sapiens
ccccgactagcccgacagtgggggggataacacgttcgcgagacccgactagcccgacagggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcaggtaagactcttcctctttc

SEQ ID NO: 151442 - DNA, 335 bp, Homo sapiens
tcttaatcctgatcctctttatagcaaaacttgttaaagcatccatttggactgcatccacttatcttgttgtactgtctccttaatcaatgccaaggaggctcctactctatcccttttccactgaaactgctcaagaaaattactaacgaccctatcctgccaaatccaacggtcactttcctgtacagattttatttcatttttaacttttcttttttttttttttttttttttgagaaaggagttccggccctttggcagggcggaagggcgggggggcactttggccctatggaaccccccgggccccggccccaattccgaacccgggg

SEQ ID NO: 151443 - DNA, 276 bp, Homo sapiens
aaaaatatttgatttactggtggtagggaacatgagaggagtcactgtgaaaagcatatgtcctgtgaaaatgtcttgtctttggcagctgtcttcttttagtgatcatgaagagttaaaccttagatccagagtcacacctatggagactagaagttgtgcatgtttgagatattgctggccctttataatacccagtcatcaagaacagatagtatggagtagtcttttggctgttgccattaataagagtgctctgtgagactgcatagccat

SEQ ID NO: 151444 - DNA, 551 bp, Homo sapiens
  misc_feature (534)..(534): n is a, c, g, or t
tgggtgggggtggaggggacagggtctcactctgtcacttaggctaaagtgcagctgcacaatctcggctcactgcagcctcaaccaccgggctcaagcaatcttcccacttccaaagtagctgggactataggctaataaaaattagcctaattttgtaattttattacaaaaaatatttttttgtagagacaggtttttgccgtgttacccaggctggtctaaaattcatgaattcaagcaatctgcctacttaggccagccaccacggcaagtctttttttttttttttttttttttttttttttttttttttttttttttttttttttttttttttcttttttttttttttttttttttttttttttttattttttttttttttatttttgtttttttttttttttgttttttaattttttaatattttatttttttttttttatggtttttttaataaataaatttattgggttttgttgtgagttctttttttttatttttttttttttgttttttttttttgttttnttttttttttttttttt

SEQ ID NO: 151445 - DNA, 234 bp, Homo sapiens
tgggtgggggtggaggggacagggtctcactctgtcacttaggctaaagtgcagctgcacaatctcggctcactgcagcctcaaccaccgggctcaagcaatcttcccacttccaaagtagctgggactataggctaataaaaattagcctaattttgtaattttattacaaaaaatatttttttgtagagacaggtttttgctatccctttccttaaatataagaataaggag

SEQ ID NO: 151446 - DNA, 545 bp, Homo sapiens
tagaggatcccgcatttcgtcccatcagtttcttgagttctcattacatctgtccaggctcttctatcagcatcaatcctttcctgatgggagcacgattccatctgtcgtcccatcagcccatctccaaatctgcttctctaagtgcagtggtgcaatcttggctcactgcaatctctgcctcccaggttcaagcaattctcctgcctcagcctccctggttgctgggattaaaggtgtgagccccgcacccagcaaatgctgctatgaatattcacatacaagtttttgtgtagatgtgtgtttttatttctcttggatattcacctagaagtggaattgctgtgtcatattgtaagtctgtttaaccctttgaggtgcctccaggctgttttctaaagtcgctgcaccattttacagttctaccagcagtgtatgaaaattctatttctctgtgttcttgccaatacttgttactgtctgtcttttaaattatcctagtgggtgtgaagtgatatctctttgaggttttgatttgcattttc

SEQ ID NO: 151447 - DNA, 832 bp, Homo sapiens
cttgatctcctaacttcgtgatctgcctgcctcggctcccaaagtgctgggattacaggcgtgagccaccgcacccggccaaattttttatatattctgaatgtaagttccttatcaaatatatgaatcgcaagtattttttcccattatgtgaagtgaagtcttcttatagatatagtattgtgattaataacaaatagttaatttaggagagtagagtacaagctgtagcagtgggagtttgtcagcacacgcttttagaaggtttcttccactgtatgaccgtgtattgatgaaaggaatgtgcctgaaactgtaaccaaaggagacatgcttccagaaaaatctcaaggaaaagtattgtaagcaacagtagatgttggatcagcactttgggaggccgaggcaggtggattatgaagacgggggtaaggcagaagtactggggatatgttgggaatcgttgactgactaaatgcataagtaagtgaaacgtaaagatagaatgcccagacaatcaaaactaggagacaagtgagatagggacaataaataggaacacaagcaccctcatagacaaatcgatggcaccacgcgcacatggcgccgcggacacgcaggaacggcgaacacagcaagcagagagagcgacaaccaacacacacccagacccacgcgaacacaaggggggcggaatcaccgaaacaacccgaccacagcggtccagagagcactgaccagcggagagcaagacacgcggcccacaagctccctctgcgctcaccacaacacagccagacaccacagagccaggacacacagcaggaagcac

SEQ ID NO: 151448 - DNA, 723 bp, Homo sapiens
cttgatctcctaacttcgtgatctgcctgcctcggctcccaaagtgctgggattacaggcgtgagccaccgcacccggccaaattttttatatattctgaatgtaagttccttatcaaatatatgaatcgcaagtattttttcccattatgtgaagtgaagtcttcttatagatatagtattgtgattaataacaaatagttaatttaggagagtagagtacaagctgtagcagtgggagtttgtcagcacacgcttttagaaggtttcttccactgtatgaccgtgtattgatgaaaggaatgtgcctgaaactgtaaccaaaggagacatgcttccagaaaaatctcaaggaaaagtattgtaagcaacagtagatgttggatcagactctaaagtaaagggtggagagttaaccagttaacatgtaagttggagatagagttctcccagaatatgtaggcaccaaagtagttctagacaacaaggattacttctcatttaaagatggtgacattcttgcaaactatatagactgaaataaatcatattgaaatggcatcaacatgaagctgcccattctgtaattctgaaatcttctatcatgtaaaataattttcatgtctttcttttgtaataaactaatgatatctaaactaatgatgcccagtgtttctaaaatttagttttgctgtattgatataaacatttcctaataaaaata

SEQ ID NO: 151449 - DNA, 232 bp, Homo sapiens
ctgagcctcctcttttctttctcctgctggagacctctctcaccagacactcaggtgtaccagtacagcagctttggacctaagtggactccagcagctccattaacccagagcttgcaccaacccagaatttccaccaagccagagtttccaccaagccagggcttccaccaatctagaacttgcaacaatccagagcttccgccaacccagagcttccgtcaatccagag

SEQ ID NO: 151450 - DNA, 361 bp, Homo sapiens
ctcagactatcctctgggctactccacaaacagcaagggttacagtcgcatgccaccacacctggttaattttttatttttgttttttagagataggggactcactatgttgcccaggctcgcctgaaattcctagcctcaagcattcctcccagctcagcctcccaaagtgttgagattacaggcgtgagccaccatgcctggcaagcttcatcatttctaaaatgtaactgtatattttagagtagcataggagtggtgtaagggttaaggattaatgatactgcaaatcaagtgcttaacacaaagtttaatgcataggaagaacataattgttattatcaatgtgagtagactgttt

SEQ ID NO: 151451 - DNA, 430 bp, Homo sapiens
agacatccatggaatataggttaagaacacttaatttgaaagaatagaaatattaatattttagacttgcatatcaatatgtagttttcaaaaccctctcacatcttattatctcagcatacattttaaataggcaaagtagatatgattatccctattttagaaatgatgacagaccttaggaagtagagacacagatacatcctttgtagtattactttatgtacttgaaaaggaattaattggtttctcttggccttgatcctctttaggataaatagatcttctgtcctccccatgagtcctgtttttcttaatatattacctgtctcttcttaagagccttaagttacggaaagcagaattagacccagttttctttagaccctgttttgggtgtaaagaaagatcacctcagctgggcgtggtg

SEQ ID NO: 151452 - DNA, 411 bp, Homo sapiens
tatatatagaaagataactattgagtatttgaatggccagggttctagacttgagtcatctgtagacaatgaatagttgaaatcataagaatagtaaacagccatttactaaatcatactaaaggagacatgacgagaaaccagtgaaggaaacacagtgggataccgtcagccaagaatacagtgagcttcagtctacccaatctacttcatagtcatccaaaaagaaacagattatagagaattaaaaaatatatgcttatatgcttaaggaggttcctggtatcagtctgaaaggaaccattatatttaagtagctcaggggttagtggccttgcctggatgtcattatttgcttccttgcagttcccagggtcttccagcatctatctctggagttccagtttcaac

SEQ ID NO: 151453 - DNA, 342 bp, Homo sapiens
tgttgactaaaaataatgttcccttcttgccattagcatcttccaatcctagtcctcagaagcaactgctgccaacactttagaataagaccttcagactcctgtcctatttatcaacaaatatttttgcacatacatgcatgtatatggatatgcaaatgcactggtgtatacatacgaatacacagaagtctaacttttgttattaatcacggggaaaaaagtataaaaaagagaaaagatagattgaagcagaagttaaagacatattgggtctcctgatacccagaaaataacattgaattgaaaagaattgaagaaaaaatgttcaaatgaacatat

SEQ ID NO: 151454 - DNA, 299 bp, Homo sapiens
aagaactcttgactttccctctgaaacctgatacgcacgccagtcattcttgggaaatggtaacaccattcactcagctactaataaaaatcagccgggtgcggtagctcagcctgtaatcccagcactttgggaggccaaggcgggtggatcaggaggtcaggagttcaagtgatcctccctccttggtctccaaaagtgctttgattacacgtcgtgatccctcgtgcccgtacgttatttagttttaatttcgaagatgcgggtctcactatgttgctcaggctggtcttgaactc

SEQ ID NO: 151455 - DNA, 694 bp, Homo sapiens
gaacctactatgtgccaggttgtggtctaggctctgaggacatagcagtgaaaaaaacagaaaggattcctatcttcaagtcttcatggagcttactttctagtggggaaagacagacaataaacaaaataaataagtaaattaaataatacattagttagattggctgggcgccatggctcatgcctataatcacagcactttgggtggctgaggtgggcagatcacttgggttcaggattcgagaccagcctggacaacacggcaagaccctgccactaaaaaaaattataaaaattagccaggcttggtggcgtgcacctgtagtcccagctactcaggaggctgaggtgggaggacgacttgagcccaaaaggtggaggttgcagtgagccaaaatcacgccactacactccagcctgggcaacagagtgataccctgtctccaaaaaaataaagaaagaaagaatacgttggttaaatagtatatagatggggcacatgtgtttttttaaaaaggtgacccagaaacagaggatagagagggctggaactgtcaggaaagacctaacatttccaaggggactttttgggttttttttgatcagggtctcactccattgcccaggctggagtgcagcagcacagtctcagcttgctgcagcctcaacttaccgggctcaagtgatcctcc

SEQ ID NO: 151456 - DNA, 433 bp, Homo sapiens
caacatagtgaaactccatctctactgaaaatacaaaaatttgctgggggcagtagtgcacctatagtcctagctacttgggaggctgaggtgcgagaattgcttgagcctgggaggtcaagatttcagtgagctgagatcatgccactgtactccatcctgggcaacagagtgagaccctgtctcaaaaacaacaacaaataatccagccattacctaaatgccaagaaataaaagactgatgtataaaaacaggggcctttggtgtgatggatgcattagcatttacaactgagtttcctgctctagcctaacctgccctgcagacccctgtaagtcctccccaagtatttctggacttcctctaagttctcccacaggaactcataagtcagactattagatataatcacatgtggaatttgccttattc

SEQ ID NO: 151457 - DNA, 226 bp, Homo sapiens
caaatatgtcacatatctgattgaatttccagaggcttctttcttgtacgaccgggtacaaaaaggaatgctgcatttctaagatgatttgcttaacttttaaaattcctttctataatcactgctgcattctggcattagttccccatttgagattttccttccagttaaactgtagtactacagttttatcctgttcaacatttctattacaaactgaaatact

SEQ ID NO: 151458 - DNA, 545 bp, Homo sapiens
attcaaaaacacctgtcttaggcattcgtgtttcttatgagtttgcgagagtccgagtgaaggggaaggacaggctgtgttacacgtagcactcaaatcttcgcttctaattactctcctgagattgcttgtacttcctggcccttctgggattgaggacttgctcattgtttgaatcttggacctttattccttcggaattagaaccataggtccccatgggctgatctcccatgtccattcccttctgctgtttgcgcaggtctaagacaatcacctcttccctcctcccacctcggtcttatctgtgacctcctactacctgaaatttgtaaactattatatacttttgttacaggaactgggtcctgctcaagaccccaagagagggttcttggatctcggacaagaaagaattcagggggagtccataaagtgaagtgaaagcaagtttattaagaaagtaaaggaataagagaatggttactccatagacggagcagccctgagggctgctggttgccgtttttatggttatgtcatga

SEQ ID NO: 151459 - DNA, 307 bp, Homo sapiens
cagtggaactcattgtgtgtgtgggtgggaagcgggggctagtgcacatgtcgcggctacttccaaggacatgagtacaaggacccatgtgagcattgcccccagtacctgccacttgatttggcaagcgctaaccaggcctttggagctgttggctgggttggccaggagatggatgggaggtttgacaggtgactccgcaggtcgctttctgttccaggttggtgctggggaggtcaggccaggtgttccttctgaaagggagcccggctgtggtacagaaatagtgtcctcccagcccataatc

SEQ ID NO: 151460 - DNA, 416 bp, Homo sapiens
tcatcgctcggtccgacacttgatgttcccatccggaagaacgtggctgtgggttgacacaggactgggcacatggcctcgagcccaacactctagaggtatggcagggattctcagaattcctgaggggcctgtgggcagttttcaaagcccccgaggtctgtgcctcccacctaacccccattgggagtgctgcgtggatttcatccgaacacagcagaggctgcgtcctgggttgtcggtgtccccaggtccatcatcctctggctgttttcctggaccctaccgggctcacccagccaaggcttgcacttttctaggccaaacaccaactggtgaccgtgcgtcacaggaagcccaccccagggagcaaggaggtggtgtctcccacatcattttctgcctgagtcagtcgg

SEQ ID NO: 151461 - DNA, 119 bp, Homo sapiens
taaatctgggatgtgcagagctagggagtgtttggggatgccagtagagaggtggtcacgtttataaaagcagaaagtaagggcgcttcctgattggtccatcagagtctgctggtgac

SEQ ID NO: 151462 - DNA, 469 bp, Homo sapiens
ggatttgccttcacatccatccaatatgggcccaagtgtcagctttgctagtttctcacttatgtgatcccggacaaattatttgacctcttgttgcctcagtttcttcgtctataaaatgggccagtaataactagctgacaaagttatgtggatattcacaattctgtgtatagaatgccgagcacagtgctcatgtgacatggtgggaggcaagtaacatttactggctgtctatgatactgttgggccctgcatgagatgcacaggatgtcacttacaaaaaactcaaaatggtggccgtgatcactcccatttcacagattagaaaaccaaggctcggagaaggtaagtaacaactctgttagtaagtgctgcataaggattcaaatccatctctatctgcttccaaagactttgggcttatccagaatggtgtagatagtgtgggggtaggagcatgctgggg

SEQ ID NO: 151463 - DNA, 301 bp, Homo sapiens
gtaacactggttatggctgtgatttatttacttgtgtgatttcatttctgggttcccctctgtactgggaaatccagaaggccagcatctgatacacctttctggttaagtcccacagtgcagtctgcaaagggagcaaccatcctggatttagggggtaaaaaaaaggtacaggccttacctgttctttgtctgtagcaacatcacctatgactaagacctggtatgttgggaatcaggaggctgtagagtagatctcatacttagtaactgctatttctactggccaccaagccatcaa

SEQ ID NO: 151464 - DNA, 306 bp, Homo sapiens
catacactcagggtgggaatagggggcctgatggtggactgcagtatgtcctggggatccagagagctcctccaatgtcacatccagtgaccccacctggaagaggcttacttggttggggacctattaaaaatgcgtggaaggagatcgaaaagtggcataagagacctatcagccaattgcaatatatggacctgacttggatcttaaattgaacaaaagaattaaaatgggaaaaaaagcaggaagacaatggggaaattgaattgctcttgaggagtactgttttaagtgtttccgttgtga

SEQ ID NO: 151465 - DNA, 475 bp, Homo sapiens
gggaagggccactgaggatactcacaactgtggtttggtttcagcaaaacacacattcttctattgtggggtataatcactcttacacactcataacctgtatgttagtttcttaggcaaagaaacactcttcgcacagggattgctcacaactctttccatgccaagaagcatgtgaggaggaggggatggtgtgcactcctgttgtggacggtaacagaacctggaaatcaatgctttgaggggattttattttgacagctttcactaactttgtttttatactttcctaagtctagaatgagaagagcctttaagttctcactgatcctcaagggaagaaaagaagtcccctgtgaggggaacacagcatcttctgagaataccttttccaactgcagccatcttgcctctctcaccttccataccacagtgctgatccaggtacctgtagagtgctccatcacgctggact

SEQ ID NO: 151466 - DNA, 394 bp, Homo sapiens
atttgttgaaaagattattctttccttactggcaggtcgtgacacccttgtttagtgtattgtatctcttatgcagagcatacagtggaatcttcacttttttatcctgcatgacagtctctacctttggctgggttaatttatgtacatttaatgttattgttgatatagttgcatctatgtacaccagtttactttttctttttctaaatgtttcagggttttttttctcaagtctttcctcatttcttttactttaaagcagtattttctttggcaatatttagttcttctaatgtcattttcacaattttttttttctttttggaaacagcatcttgctctgttgcacaggctagagtgcagtggcagaatgttggctcatggcaaactc

SEQ ID NO: 151467 - DNA, 111 bp, Homo sapiens
gagtttctccactgctcgccatgtccaagccataaatacttgatctcctcctgtcatgccagcttaaattaacataccaggagcttaactgatgacaagacaaacacgaat

SEQ ID NO: 151468 - DNA, 462 bp, Homo sapiens
gtgctgggggcggggcagggggtgagaattttaacagaatattggagagacaaaatttttctaccgttcatatatatatatctagttgaattatttcaagatttcaaggtcagtattgtccccattttataggtgaagaaataggcctagaggtactaaactttacaacttcaggtgagcaggagataaacaggtaggattcaaggcttaccagtctgattcctgttagaagaaaaacttcagctgaactaaatttaaaggagttaaactgagcagtgaatgactgggcagcccccagaatcacagcagattcagagagactccagggatgcctcgtggtcagaacaaatttttagacaaaaagagggaagtgacgtacagaaatcagcagtgagatacagaaacagctgcattggttacaggggggcgtttgccttatttgaacacagtttgaacaatcag

SEQ ID NO: 151469 - DNA, 181 bp, Homo sapiens
tggccggcctggctggggtggcattcactttcttggctctctggctcctgcgcccccaggaagggtagccctgggcttccatggtttctctgagaccccgaggcccagcccaggagggccctctttgaacgactttgtaactagacatccaccccagccgtgaccccgtgacccagagaca

SEQ ID NO: 151470 - DNA, 318 bp, Homo sapiens
cgtggtcagacccctcatcaggttcacgctggccccttgccagtctttcactaaaagcacgttctttgttgtctgcacacctgagaagcatcacctcccccagccccatagctcaggcaaccagcagggctggtagggtgatggtcaggaacagttttcaggggctgagaacttgataatggatttctttctgaagcttgagaagttgtttctagatgggacctgcagtattctctggatctcactatttagacttcacctaaggatgccaggaaacttggaaagatttgacattggtcactccagcagcttcattaa

SEQ ID NO: 151471 - DNA, 396 bp, Homo sapiens
ccttctgttccctggcacagggcatccccttagaagtagtgcatgaaattcacacagctgggacctggcagagaatacaggtggcttgactgaggcagggaggcctccatctgcaggtggcctgagagcctgcagagcctcacagtggcactaggtggcactcccacccaagggagtcctaacagagtgggaggcgtggaaataaaggactccatggcctgaaggaaataaatacaaggtaggaaagtaaatttccagacaattttttttccctaatggaaattcacttgtaagtgattgttcaaaatccagaggcatttccccactgaaaatatgtgtggtggaggtctggttggaaggtggggtagtgctaatctcggccaacttgtgggctgg

SEQ ID NO: 151472 - DNA, 451 bp, Homo sapiens
ctgccctgttctcaggacagctggagccccaatagtctaaagtgaattacgacagaacagcactgggctgtgaatatccccaagcaggaaaccaccagggagcccaaggctttccccgtgttccatggcttctgttgatcatcagttggaacacagcactcccatagcagcaacttccacttgctatttatttacattgtgatataatgacacaccataaaagtcaccctttaaaagcgtacaattcagttttttagtatattcacaaagtagcgccaccatcaccactgtctaattacagaagttacctccatttgcaattctcaccaataggcccattccagagcctgcctcggagcagaagcttgagctcgtacttcccaaagggctacccctgcctcgcagcctcgcggaagccttaatgctgagtgccactagcatcttcctcttt

SEQ ID NO: 151473 - DNA, 524 bp, Homo sapiens
gagatgaacccgtcgtgcccagctggagtgcagtggttgatctcggctcactgcatcctccgcctccgtggttcaagagattctcaaggttttcatgttttaaaaaattcccagaaccccatataagagttcttaaatttactcaagctgcagaccattcttagaatcacagacccctcaaaataactatggcaccagaaatttatggtttatgtcttgaatagcttagtacttttgacaactatactaggaaatgaaaagctgctactgtcccatttaaaaataactgagatttttaaaaattggatgtgtattttcaactctggtttaagtgtgtatttgatgccctgatgaaaacaaattgtcatccttaactttgagatatttaggttaaaggagaataatattattaaatatttaataaatatttttggactcaaggttataggaataaggttaagttatttcaacacagcagagatagtcggaatgaatccagactttgaggagtacttttacttgaa

SEQ ID NO: 151474 - DNA, 326 bp, Homo sapiens
agaacacagatgaggaaggacatttaatgatgaaaatacagcatgaacaaaggaattatttggtttttccttttcttagcactgttatagtatttcctgttaatacaactcactttgtctcctaactataacttgtattgatagtattattatatgtgtattacatgtgtagatgtcatgtttctctgtataaactatatgtttacaaagtatacagatgtctaatataagtcacttattttaccaggtgctggagatttaccatatatgggtgattaacccattaacagtgtatgaaaaagctgcaccagagcatgtacaaagta

SEQ ID NO: 151475 - DNA, 249 bp, Homo sapiens
cctccaacatgaaggcatctttgttactgaaacaaaaataccacagcaggtggtagactcgaacacaggagggaggaggaggttcagttgttgcccatttttctaatcctttcagaatacccattgtctgaaccccaaagttaacatgttcctgctcagtctcatggagacaatttcagcgtgaaagggctgtgcccatcactggttttcgacaacagtttaatctttgggtatggaatgtgtaaccac

SEQ ID NO: 151476 - DNA, 527 bp, Homo sapiens
  misc_feature (99)..(99): n is a, c, g, or t
  misc_feature (454)..(454): n is a, c, g, or t
taggctgaataaaggcctccaaagatgtccccattctaagccctggaacctgtgaatgttactttacatagcaaaagggactatgcagatgtgactaangaatcttgagacagggagattttcctggggattatccaggtgggccctaaatgcaatttcaagtctctttataagagggattgagaaggaaacttcatcaaagaacaggaaaaaatcagtgtgaccatagaagcagagattgaagcgatgtggtcacaaggcaaggaatgctggcagccaccagacaccggaagtcaggaacagattctcccccggaacctccagaggggagacagccctgctgtcaccttgattttaagccagtgatgttgatttcagactctggcctctggaacttcctttcagaaattctctagagcctgaaaaagtcaccctgccgaggatcaacttcttncaccccagaacaaggcagagcagaaggatggatctgagtgcaaacaggtccaggaccagcacaccatatggta

SEQ ID NO: 151477 - DNA, 200 bp, Homo sapiens
acaggggcaaactggcgggtaccaccttgccaagatacccctccccagtaaagcaccgggcttgcctttgagtaagtgtctgctcccttagcaaaaccctctgcaacccaactccgctcgctgctcaaggcgccgggcagcggccagtggccagcacacctgcctccacttgggattccgaaggaaatgacaatcgggtg

SEQ ID NO: 151478 - DNA, 512 bp, Homo sapiens
gatggcgttctagaggatcccgaaaactgaatgaggcaggcgcaaagaggacagaaggtgttggttcaattcatttgccaggtactgagcacctattgggtttgaggcacagggccagtgccacctccaggagaataacaatctggtttgggagacaggacactctcttcttagaaatcatctaaaactctgagacagcaggagagatggttcagaaatgaggccgtgagcactcaggagccagtcaatctcaacagaacgaagcccaggcagacttcctggggaggcagtttcaaggaggtctcagtgtggtttggctgagaggaggttggtgggtattctgaaggaccaaacagcagaaatgcccagggagaaagggaagcggtgagagaggaaggaaggtagctgtgagatgcttgcctctgtgcctccaacatcccctaatgcgggaaattataatttccattttacagacaggttcggacctttgtcagggtcacacacagccagga

SEQ ID NO: 151479 - DNA, 417 bp, Homo sapiens
gggaggggcttgagcaaaacagaactagccctgccagctcgaagaactctgggcacccaggacacatcggagtggcagaaagggtcctgttagaactttgttagcgggcttggcactgtgctagctttgcccaagctggctctgaacacatgatgcccactaagacataactctcaagttggcatctgtccagcgtgttggagcgaggtcaggaaggcagggcaatcccccttttccctcccaagggcttggcggtggccccccctcagcatgaccttgtcctgggttctaagggttgggaagttctccctcactctgccactctgcgtgtctgggaccttccttgggctctgacaggcccaccaaaagagctccgggagatgagagatcggctcccccgcagctcccacagccctt

SEQ ID NO: 151480 - DNA, 377 bp, Homo sapiens
tggcgtctagagcgatcccgtaacgtctacttgctctactaaagtaacctattgttctttagaactgaagaccagaggctgtgggacttcactcttatctgggatgtggtgctgacatgatattcccaaaactctttctgtctgtctccctaactctcagatttactttcctctgtgggtgttaatctcaagcagatagcaaaggtagtttctgctctaagctcatgaagttttacacttcctaacgagagaggaagacagaggcatgctctctcccagggtctacatgtgaaatctcattcagggtttctggttgatccagcactggtcacatggcccagccacttggagtcagttgtgttgtcagggcctgcacc

SEQ ID NO: 151481 - DNA, 596 bp, Homo sapiens
atctagaggatcttcagctgatagcctcccagaccatcacattcgttccctcctctctgccaggaagggcaccaggcacccacggggagtgtaggggccattagagtctaatctgctcagccccctgtgcactgcagcctagacgccagcttgagctacagagggagaccctgtcgcatgaaaacaaacaataacaacaaaaaaacaagatacttagtctctacaaggcacagtgtaaaatattgttgtcttcatctagaaggaaggaaactaataggtcagagtacatttaaaacttccaacaaatagatgaaacataacgcataagagtgtgacttcacagaatacctcccacttcagcctcccaaagtgctgggattacagggcatgagccaacaaacccaggccaaactgaaacattcttgaaagagaaagagggtgttcaaatgattacataatttggttgaaatatttgttcatctgttgaataatttgtacatatttacttatttaaaaactattttcaggctgtgcacattggctcccagcactgttaacccagcattttgggaggctatcaaggcgttggataccga

SEQ ID NO: 151482 - DNA, 927 bp, Homo sapiens
atctagaggatcttcagctgatagcctcccagaccatcacattcgttccctcctctctgccaggaagggcaccaggcacccacggggagtgtaggggccattagagtctaatctgctcagccccctgtgcactgcagcctagacgccagcttgagctacagagggagaccctgtcgcatgaaaacaaacaataacaacaaaaaaacaagatacttagtctctacaaggcacagtgtaaaatattgttgtcttcatctagaaggaaggaaactaataggtcagagtacatttaaaacttccaacaaatagatgaaacataacgcataagagtgtgacttcacagaatacctcccgggggacacaggacctgagtgctgcatgcaggaggtggtggacaggtggggacagacagatgtgtggaagagtatgtggggcagatgaactaggctgaagagagaactgggcagagccttcttcacacagccttttaaacatttttttgcagctgggcacagtggctcacgcctgtaatcccagcaccttgggaggccaaggcaggtggatcacgaggtcaggagattgagaccatcctgactaacatggtgaaaccccgtctctactaaaaatacaaaaaattagctgggcatggtggcgggcgcctgtagtcccagctacatgggcggctgaggcaggagaatggcgtgaacctgggaggtggagcttgcagtgagctgagaccgcaccactgcactccagcctgggtgacagagtaagactctgtctcaaaaataaataaataaataaataaataaataaataaataaaataaaaaatttgcatagataatctttttatggttaaaaaaaaatctaaaacatatacagtgaaagcctttcccattcctgttctccctctaccctgttcttt

SEQ ID NO: 151483 - DNA, 344 bp, Homo sapiens
ttataagtttacctccttttctctttgtccctaatggctaggcccacagactttctcatggacccaaacatcttgtaaccacaaggcccttagaccctcatcaataacctatctcccccaccaattcctttgtccatatatccatatccacaaaccctgtttaaggacaaaggcaagaggcaaagatctgacatatctccatccctttctgtgaatatctttcacttctattcctcccccaataccaactgtgcctgaaaatgtgttcacttagtgccagatctttttctcatgatgcgcccatctgtctttacaaatacgtctaggtactgtattttcttctt

SEQ ID NO: 151484 - DNA, 802 bp, Homo sapiens
ctgccaattataaatatatttgcatccaacattggagtttctattatataagcaaatattaacagatgggaagagagagatagatagcaatacatactaatagaggaatttgataccccactctctatgatagatagaacatccagacagaaaatgaataaggaaacagtagacttgaataacactgcagaccaaaggaccttgcagacatatatagaacatttcatcaaacagcagcagaatacacatttttcctccaaatacacatggaacattctctaggacagatcaagtgttaggtcacaaaataggtcttaacaagtttaagaagactgaaatcatatcaagtatgttttctcaccacaatgatacgaaactagaaatcaaaataggaagaaaattagaaaatgcactaatatatgaaaattaaacaacacattcctgaacaataaatgagtcaaagaagaaataaaaagagaaataaaagagtagcttgacaatacaaaaatggagaaagactgtatcaaaatttatgggaggtagcaacagcagttttaagagtgaagtttatagcaataaatgcctacattaagaaaagagaggccaggcacgggtggctcacgcctgtaatcccagcactttgggaggcctaggtgggtggatcatgaggtcaggagtttgagaccggcctggccaatatggtgaaaccctgtctctaataaaatacaaaaattatccgggggtaatggcatgcacctgtagtcccagctacttgggaggctgaggcagaagaattgcttga

SEQ ID NO: 151485 - DNA, 715 bp, Homo sapiens
  misc_feature (352)..(352): n is a, c, g, or t
  misc_feature (393)..(393): n is a, c, g, or t
  misc_feature (395)..(395): n is a, c, g, or t
  misc_feature (413)..(413): n is a, c, g, or t
  misc_feature (415)..(415): n is a, c, g, or t
  misc_feature (436)..(436): n is a, c, g, or t
  misc_feature (439)..(439): n is a, c, g, or t
tttaatatttagtttcctcatctgtaaaaaaagatattgtaatatctacttcataggacagttataaaaattaaatgaggtaatccaatgagatactcatcagcacagggtctggcacatattaattatctattatatggtagctatgacttaatcagttctacgaggcttgttatgaaaaacagtatacacatccattttcctctccccagaggcagattggctgcttttgaaaaataaaccagcattactttgtcagggataggtttagcatgaaagcagtttgggcgtaagcctgttcaaattaaaaaatgataaagctttaaaagtgattacaggcatgggccaccangcctagcctctttgttgaacttaatattattcttctttatntncgctttctcagtgaagcntncttcctcatcgtttccaagtngtngtgtttcggtaatctgattatctgtcatttcagagtccctgtcctcccactgagccacatgcgcacacacatctctgtcaggcacccctgtcatgtaaggcacgttgggtctgccagagcggcaccccttgttccaactttcaggtttaatgcttgagaacatttgaaggctgttgtctggaaaagataagtgtttttatatttctttgaattttaggagttgtctaccacaacaaataaactagatcacacttttttttctaataaattggggcc

SEQ ID NO: 151486 - DNA, 248 bp, Homo sapiens
aaaaaaatgaacatttgtgatctcgcacggtttttgcaggtcaggaattcacgagcttagctaggtggttctgactcacactccctcatgagcttggagagaagatgttggtgggagctgctgtcatttaggggttatctggggtggggggatcttcctccaagctgcctcactcacagagcaggtaagttaatgctggctgtgggtaggaggtctcgggtgctcaccatgcagacttttccatgggg

SEQ ID NO: 151487 - DNA, 436 bp, Homo sapiens
gcggcacgtatgtggcatagctgattctagaggatccctgcttgcatcgactgagctcccgcattgccttctgccatgagtaaaagctccctgaggttcccccggcagccaagtgatgtcagcactaagcttcctgtacagcctgcagaaacacgagccaatgaaacctcttttctttataaattacccagtcttgggtatttctttacagcaatgcaagaacagcctaatacactgtctttaaacatatctataatgttatttggaaacattattataatgtaatattagtacttggccatgaatcatgttaaatatcatcttccttttacataaaccttaagatgaattttcttggaaccttcttttttttttttttaagtaagacggagtctcactctgtcgcccaggctggagtggagtggcacaatctcag

SEQ ID NO: 151488 - DNA, 274 bp, Homo sapiens
caaaggtttgcattgggtagacttttcataaacatttgttgaactgtacaattcaattactttttacaaatggttgtgttcatttaatacataaagattaaatgactgtatttttcttgttcagcaaataaatccaagattctctgtaattataatgaagcaattggttgcttggtcaatttggtgggaagaagagcaaaactggtggcctggtttcattagctggtgaaagccactaacacatttatcaattagttccaaatagtcacagcct

SEQ ID NO: 151489 - DNA, 264 bp, Homo sapiens
gttcagtcctttcatcttacaaggatctaagtcctcgggaagtctccactttcacagtgctacacagttgctgtgtatctaaacagggctgagcctggtggcatcttgcgtgcccacccaactagaggggctgctggagctggaaaggaaggagaaccaccaaggtggggatggacagggagggcctcatgtttgctcaggcacattctgccttggcgtcaacccagcttttgtcttaataaaataaatcctacccacagagca

SEQ ID NO: 151490 - DNA, 418 bp, Homo sapiens
tgacttactgcaatctccgcctcccaggttcaagtaattctcctgcctcggccacctgagtagctgggactacaggtgcgcaccaccatgcccagctaatttttcttcttttagtagagacagggtttcaccatgttgcccaggctggtctcaaactctcaactcaagtgatctgcctgcctcggcttcccaaagtgatgggattacaggtgtcagccatcgcgcctggcctctgcagagaattttttaaaagttctatgatatagaatgactcagtggctgctctagattgcatggttagggaaggtctatcaaatatcactaaataaggtggcatttaagctgagattttcttgacaagaaggaacaaccacatgaaggtccaggctggtgcgtgtaaagacccaggggtccaggg

SEQ ID NO: 151491 - DNA, 1288 bp, Homo sapiens
caggaacattgagacacataattttatagtgaagcatctcagcacaatttttaccaataatacttagcagcctaaaagaaacagggaaattggagactgtaggaagtcagggcatggggagaaaacgtagctatgaattcgtagttgaaatggtagacactatgtattctcaactgcaaggagaaaatagaagccaaaaagactaaatatataactaatccagaggcttttaaaattctgcttctttcttagtatgtattgtcatgtatttgtttatcttccctttctgtatgatactatgtcttacttgtgtttcacaaatgtgagattcctgaccttttataagaaggtaacaaggcatttttcaaaaagcctttttttggagaggttaagtgggatggtagagtggattaagtggaacaaaattccagttttttggcgagaaaatattttttagtctaaaatccctctgagactcactacaaactaatttctttctgtcattcttcttccttcttttggtttctctataactaaatttagtttaaaattaagttatctataaaggcagcctttccatgatcgttggagcacattctgctcatgttagaagttcattgttctttgtttttagttattaagcacatacagtagtccccccttatccacaggggatacattctaagacccccagtggatgcctgaaattgatgatagtactgaaccctatatatactgtttttcctgtgtgtacatacctatgataacatttcatttataagttaaagacacagtaagagattaacaacaataagaataaattagaacaactataataatatactgtaataaaagttgtatgaatgtggtctctctttctctcaaaataatcttattgtatcatagtcacccttcttgtgatctgtcgatctgataattgaggtgactactaagcgactaatgggtggatcatgtcaacagcatggatacactggacaaaagcatgagtcatgtcccgagcaggatggagcaagatggtgtgagatttcatcactatactcaaaatggcccacaatttaaaatttacaaattatttatttatggaattttccatttaatattttcagaccacagttgactgcagctaactgaaactgggaaaagagaaactggataagggggactactgtagtatgaaggcaagaaaatttcaggggaaaacaagtggttattttctggccaaatgtgatacattttctctcttaactggatacagttaaaaatagga

SEQ ID NO: 151492 - DNA, 720 bp, Homo sapiens
ggcagctgaatttgcaagaaactccttggatggggttaatggcagctgtatttttctgggagctctgctttaattggacaaagtaagttgtggtaagatttcttcttttatcttcagtatctcaaatgttttcatttaaataatctttataacaacttttgatgtctgagtggattcccatacagtcatctattgtaagactttctgattccgtttttttcctttggtcattatgaatagggcttatgtaaataattgcatggtagcttttgattggaagtaacatcaaagtagttgtcaaaatacttaggaatgttatttttggattgtaaggtgagacttgtttagctttggaaaaaaatgcccaacttgtaataggggaggaaaaataattttctgtttttggaattcttagatgggatgctctgtaaaaactgacagattaaaatgagaaaaacagaaaagttgaaaaacacgtataccttatggttacatgggagatattcagggaaaaatgagtaaatctccaacaggtggctttcaattcaagcataaatactgtcttcaacttaaagaaagaagatttgaggtgcagtattggggagttaaccagcaaaagcacattagacaagggtaaggttcattatacagacttaagtccatgcattctccattgataagactctttagtgatttagttatccttctcttcttggtgtc

SEQ ID NO: 151493 - DNA, 339 bp, Homo sapiens
gctctctgcttccagtatgctccagagctttctccatgctgacaggggacccatctactgccaccccggtttccaccggagcccatccaagcagcagagctgccaccagaggtgccttctgccatgattgtaagtttcctgaggcctcctcagcaacatggaactgtaagaaaattgaggcccaacaggactagttaccctatatgcctgaacataaaacaacccagaatacaatgtgatccttcgatatccatatgggaagacatatacaataaaaatgacgacaagagcctgacttgaaaatatatactaataaaaaaataaattttaaaagttaaa

SEQ ID NO: 151494 - DNA, 283 bp, Homo sapiens
gctctctgcttccagtatgctccagagctttctccatgctgacaggggacccatctactgccaccccggtttccaccggagcccatccaagcagcagagctgccaccaggtaagaaaattgaggcccaacaggactagttaccctatatgcctgaacataaaacaacccagaatacaatgtgatccttcgatatccatatgggaagacatatacaataaaaatgacgacaagagcctgacttgaaaatatatactaataaaaaaataaattttaaaagttaaa

SEQ ID NO: 151495 - DNA, 235 bp, Homo sapiens
gaatgagaatatatggtccaatgaagaagaagtaagaacaagaccaccaggagacacctaccatgagtagcacttacctcttatgaggtttataaatgttcatatatgtaaaatattgagcatagcagatgctcaatcaatattagatgcataagacaatgcaattaaacagactcagttcaccttcaatatcaactaaatattcatatttaaatctttaagacatctaacatac

SEQ ID NO: 151496 - DNA, 252 bp, Homo sapiens
ttttaatgattagctttaaattctaacagccgatccagatggaactcaagcctattcttccttccctctccacagaagagaaagttctagccaggcacagtggcttatgcctgtaatccaagcattttgggaggccgaggtgagcagatcatttgaagtcaggagtttgagaccatcctgaccaacatggtgaaaccctgtctgtactaaaaatacaaaaaattagctgggcgtggtggcacacacgcctgt

SEQ ID NO: 151497 - DNA, 620 bp, Homo sapiens
cagtcgacggatactctcttcgacatatcgaacctgtttctacatcaggctccttgtgttatttatttttgggtcaggaagactgccctgctcattgggaggctggggtggcagagactgctatgtgttcaccaaagcccatttcctccttcacttcttctgctgcaggtggtatggctttgagtcctggtcagtggactgtgggaagaggcgacataagcctcttctaggcctggtccttaaaaccctcctgcaggttcctctgcactctccaaagccccacgcccactggctggacacagaatgttgagcagtggagctttggagagtctccgtcgaacttgatcatatagaaaagctctccaaggcaccagtgagaagaacttgaaatcaaaaacacaattatcactgctgccttggagagtctccgtcgaactagttcgacggagactctcaattatttgtgaaattttaaatgaatagttactataatcacaaataatggagagtcaacttctttttcccaaaacatacatggaaggtctgtgtgtgtaagctctgattttcaggaaccctatttctggaagcagagtaactggaaatactaagtcaagatctga

SEQ ID NO: 151498 - DNA, 243 bp, Homo sapiens
ggatataggggaaggtttgggctgcagggacctaagtcgttggttaggggttggccatggactaatgctccttctccagggcccggtagatgaggatcacccctgtgggttcctgtatcccagcaggcatacaggagaccaggagacaaatggggaatagatgatggggcctgaggccacatagtttatcttcattttcagataaggaacctgaggtaaagagacagagagaggaaggggagg

SEQ ID NO: 151499 - DNA, 386 bp, Homo sapiens
gggactgtagccttttctcaggtgagacgtggaactttttacattcgagttaatgctgaaatgacttaagacttttggcaacttttgaaaaggcatgattgtattttactctgtgagaaggatatgatatttgggggatcagggtcagaataatatggtttagctgtgtgtccctacctaaactcacatgtaattgtaatcccgaatgttgcaggtggggactggtgagaggtgatttattcatggatgggagaggggtggggttggaagtaaaaacaggtgggtaaggtggggaggagtaggctggctgtagggtggtgtgtagcaggaagggagtagcctgccacagaggcagaggctcatggaaaacctctactaaggcagtg

SEQ ID NO: 151500 - DNA, 261 bp, Homo sapiens
cattatagttaagaacaagggaaggagaaaatttgtgtatgttcatacatatccgtatgcatgtggaactttgtatatgtgcatggtcatcagtgtatggatatgcatccgtgtatttgtgtgtgcatattcagcgtgcgcatgagtgtctaatctgcattgtgtgatgtgtgtgtgcaagcatatctgtatgtgcacatgcacatgtatgtttgtgtacatgggaatctgtgtgtgtataactgtgcatacgagcacctg

SEQ ID NO: 151501 - DNA, 375 bp, Homo sapiens
ttgttccttcacatggagatgtatttattcccccaaatctagatgctcacttctaactcaagagtgtcaacagcaaatgcacacccatatcgaacaacaaaggtacctatagcaactacaccaaaaacaccttttctgtttcctctcctttctgtatgggtgcggctgcatgtttgggctttgatcttgtgttctaaagactttccaatagcttattactatgactccttttccttccccttctctttcctcctgtcttctcctctgctgttaaaggattaatttaatgagatttagttctcaggggaaatgctttaatgaaattagtagaggaaaataaacaaccacaaaatagcctgatgcaccatacccctc

SEQ ID NO: 151502 - DNA, 393 bp, Homo sapiens
ggaaatgcctccataatgaataagcaaatgaactctagaatcaccactcgctggaaaaatgaaaagcctactttggcttttcacagcctgctgaataaaaaacatggcaggaccccataggcctcaccatgcagctggactctgacacctaccacactgtgtcattactgtcagttgtttccattactcttgcaagtcccttcacactagggccttttcttgcctatctttagaattctaacatgtagtccagcaccttatatggggtggggatggcaacatgaaaatccttccatcacaaaacatctagaaatgctgggtgaaatctaatgaatattcttttaaatgcaaagagctgagctcacagtaagaaagggaaaccccctgggaccc

SEQ ID NO: 151503 - DNA, 254 bp, Homo sapiens
atatcaagcactctttcagactacaatggaataaaactggaaattaactgcaaaaggaaccttcaaaaccatgcaaatatatgatccctgggtgaaaaatgaaatcaagatggaaattaaaaaattctttgaactgaacaacaatagtgacatgacctatgacaacctctgggacacagcaaagggggtgctaaggggaaagtgcatagccctaaacacctacatcaaaaggtctgaaagagcccaaatggaca

SEQ ID NO: 151504 - DNA, 619 bp, Homo sapiens
ggagaatggcgtgaacccaggaggcgaagcttgcagtgagccgagatggtgccattgcactccagcctgggcaacggagcgagagactctgtctcaaaaaaaaaaaaaaaagaaaatggagaagtagccccagggtgccaggacccccaaccccttcgagggctcagcaggcggtggctgaggcagtggactgcagggttgggtggggttttcctgagctgtcaggagtctttctggagaatcaaaagaatgactgagaaacaatctcaaagttggtttgtggatgtaattgtgtacagtcgttaaactgagcaaaaaaagtctagcattccttaacctgggctctccaaggaggaagtatctcttagtgtgttctgtttattcttatctctaatcatgattggtataatttcatgttgtagcattaagtcttaatgtaattgaaaacttggaaacacggctacaacaatttctttaagatacagcattttggagccaaattcagtaataacttgtagctttgtgttaaggaaagaaatatttctgaataagggaaccaaggaagaaagtttgagtgagttttttttttgggaggcataggggaaaattggggtatggt

SEQ ID NO: 151505 - DNA, 297 bp, Homo sapiens
atgctgggagatggtcatgcagctcaggtcaactcagggtaccctcaacctaaaatgtgagaggagagctgcagaagcaatggacgagaagggagcaggggttttaatatcccccacacatcttccagcttctactctgctcactaatttcattttggacaaaagcttgttgattcttcttactcaggctagttacctgcattatactgaacagaattcctccagggaacagcctcttggctaaatcaacatacacctgccattcacagatgcagggtttctagcaagattctagag

SEQ ID NO: 151506 - DNA, 198 bp, Homo sapiens
ctggacaagggacctagagagtgtgtttaggcgggaagtggtctggaaattcttgtgactataagtggacattcttagaatggcgtcctgtttgttgtatttgtgctttaactggttgcaggctggcaggagtgataacacactatggtgataatgatgcattctctctgctgtcctgtccactagtgtgtgcttttc

SEQ ID NO: 151507 - DNA, 203 bp, Homo sapiens
gccacagattaaagggctcaaacaacagaaatttattttgcacagtgctagaagttcagggctaaggttctagaagggttcattttctgatgagggctctctttctggcttgcagatggctaccttcttgctaagtcctcacataacttttccttggtgtgtgcaaggaaagagtgtaagctctgtggtgcctattctttttt

SEQ ID NO: 151508 - DNA, 292 bp, Homo sapiens
caggcaaggacaaattcactggacaatttcttttagtttcaaaatgcaagaggtggcaaaacgctgccaataatctgttccaaatgtaggaataacgtgctgcattatccccattacaaaactgatgctgtcagaaatgggcgtaagcccctctgtgagatcagggagctggatgttctgatgtaggcagcaggagctcctaggagcactgacgggggtgagtgtagatcagagagccagatgttctgatgtaggcagcaggcgctcccaggagcactgacgggggtgagtg

SEQ ID NO: 151509 - DNA, 485 bp, Homo sapiens
ctcaacgctttatacttcggaatagggtttctggactttagtactactgacacactgttatgacaaccacaagtatctccagacactttccaatgtcccctttgggggcaaaatcatgccagttgagaaccactgcccaagaacaatgtctgcactttggcctatctttaaagtctttattttttcatgtttataattctagaatatccaactttcatttaacatcagtttaaatactttacatgttactacacaatgactgttttaatgcccacctatggagatgcattacagtattataaaaccacaattttcccatggctactagaaatctatattatttacaatatagctgttagaaaacatttgaaattacttccttaagacacatctatcaaattaaaaactcatgcactgggtcactgactattttaatgattcaatcataattctaatacagagtgtcttaaggaagtataaagcaa

SEQ ID NO: 151510 - DNA, 528 bp, Homo sapiens
ggtaatgatggagtgttggaagacaaggtgctggagctagaagggtaattaacatttccacagatggcgctgctatggtgttggattaaaggcttgatttcattcctctaattgagtgacttagttcatctttgtggattgatgcccaatatcattgttgcccagctctgccctgaaaaatactttttaaagtctccttttttggttcaacatgaacgtctcttgaaaagcaaagtaggataagacgctgatgagaagcttagtctaaataacccactggaaacgggtgtatttggcgacctgctctttcccaccatgacttaaagcgtttataaacctccataggaattggcaggatgtactgttcaccgcccaaacctcttgtggaaaactgggttgttcaggtagaaatgagtaactgtacatagagaagctaggaagaattataggtcagtgcatcccaacttcaatgtgttaggtcagtggggtcttgataaaatgcagattctgtttcaggggctttggagt

SEQ ID NO: 151511 - DNA, 171 bp, Homo sapiens
ggattacaggcgtgaaccatcgtacccgacccagagatttttaactcgaccactcactccccacctcatctagggactggattcttgccggaagggtggagtgtgggacagggcagccagggctctgaaccgactttcttctcccagactcccttggccccactgcatcag

SEQ ID NO: 151512 - DNA, 167 bp, Homo sapiens
atctgggaatcaatccatttggttggactggctggatgacctcttgggtgggtctttgtcacttctctttcctgtgagtccccaccccgttggctgagagcttgcattttcttagctggtcctggtgcaactggtgcatgctttttttttttttttttttttttttt

SEQ ID NO: 151513 - DNA, 309 bp, Homo sapiens
gagcggcgccctttttttcccaactcattaaagattaagaaattaaccaaaatcccataatgcttttcaaatttatgttaaaaatatgttactaaaagcttactgccctaacaaaaatgcaattattgcttctctagaacatttacttttgtactgatttctaaaaaagatgtgggattactaacagcacacatttacagtttttttttccactttaaagttaattctaaatagaaatggcttaagaatctagaaatgggtggcgcagtggctcacagctgtaattccaacacttcagaaggctgaagt

SEQ ID NO: 151514 - DNA, 594 bp, Homo sapiens
ctctgattgatggatgcgaattgaggaggaaaagaaaaaacaaaaaacaaaggaaaaatatctcctgtgcatacgtgtggttcattcagagaataaagcaaacacactaggaaaataagagctgtaattcccagggcggcaggcaaagggatctgaaaaaaaggcagagcgaatgggtctcgttgataatcattgatccaaagccaagtcaccccttcacaagtcacacatcagtgactagaccccatcagtaaactggtcgtgctgctgctggggattgcatacatagcttctgatgcctggtaatggcagatcgagaagagattacactatgcactagaatctggcctccaaaataaatccaggccattcttttccctgagacagtaaatagggtgaagttaaactccagtttttccatgggtaccactaagttaggttaacccaaggcactgggattcattcagtctgattattgcactgaaaaatacttcctagcccgtgtgaaaaatagggcatctgaacaggacagagattatgatcacagttttacaactgtgtacagcgctttgcttctgaaacataaaatactgc

SEQ ID NO: 151515 - DNA, 149 bp, Homo sapiens
ctcaacttggtggtacagccactgggggtggcagggaagggcagcagggagagctttctggatagattggctgttgggaggaggactggggcagaaagaagagtggattttccctataggggcagaagtcacccagtcattgaagctgg

SEQ ID NO: 151516 - DNA, 169 bp, Homo sapiens
ttcgacccacgtgtggaagccctgggctactcaaccttcgagaaggtcgttcaaggtccgacaacgctctgggggtctgggggggacgaagtcagacccaactacccctagatgttgggggggggaatgggtcactcgtcccccagatctcagacctgggtgctcccca

SEQ ID NO: 151517 - DNA, 528 bp, Homo sapiens
taaacgcccagcttcaaggtcacccagatgatgagtgcaaacttgggatgaaccttggagtaaatcctaagtcccctcactcaaggaccatggctgctacacagttggctttaaaaaaaaaaaacagcttgctgttctctggagtgcttgagtgaatactgacagaatctggaaacttcactatcctaatttggctatttatttatttagagacggaatcttactctgtcaccctggctggagcgcagtggcatgatcctggcttaccgcaacctctgcctcccgggttcaagcgattcgcctgcctcagcctcccgagtagctgggattataggcatgtgcccccctgccctgctaatctaacctctttaatacctactttgcacaaggtgcttttgcctgttttgtcccatttaattctcaaaacagccctgtcaagttggttttatccccacatcttataaatggaagactgaggttaagcagtgggcccagggccatagaacagctgagctgtggagctggaca

SEQ ID NO: 151518 - DNA, 371 bp, Homo sapiens
gtgtgtataaatgtatgtgttacggcttaccctgaattccaggcaatgtcaatgtcagccacacaccagataatgtctattgtgtgtcctggaagtcagcagtgctatgtgtagctttttaatatcaacatcaatcccttcttaaatattcaaaatttttaaaaacatttacattttaagataaatgatctttcccactcgttgtacaattttgtgtatcatgttaatataaggtatctaactagatatagctaattctaaattttcactgtaacatagttacttcccaatataaaggcctaccttactatacagaataatttgacttggggtttaaaaatataagagaagtctatttggagctagtgaat

SEQ ID NO: 151519 - DNA, 398 bp, Homo sapiens
atactgacctggaaataatgttaagagaaaagatagagtacagagttgtatatacactgattaaaattatgtaagaattatgcatttggctaaaactaataaagatgtggaaaattcgaagtagttatattatacaggattgtctttttattccaactttaaaaaataataaaagggatataattgaggatttcaaggaacaaaaaaaagaaaaagaaaatagttgtgttaagatgatgaatttcaaatcttaaaatatttaagattagcttaattttagcaaattagtattttaaaacaaagtgactagaaactagagaaaatgtcctgaacagtcctagggttttctagaaagaatttttattggttgtggtcttatcgttgttttgttttatttt

SEQ ID NO: 151520 - DNA, 436 bp, Homo sapiens
agtggtagtaggatatagttcttcaccttctgtgcagaggatgcgttgataaacagggcagtaaggagagccttagattcagtatctccattaggtggaaggaaccatccattactcttttcaagggtgtcttggagagagaaagcactttcctagatgagggatgaggttgatattgaaatagaccgatgagattatttttaagtcaaacaaaagaaaaataggacaggcctctcatctcctgaatgaatgttaagcaaagaacaacttgactttttagatatgtgaaaaatctcttgagaggttgtggaagcagcatgtaggaggataaatgcataactcacatcagtcttttacgcattaaaaataacttgggccattttgaaatctttctttcttgccctgggttcttataagcaatgttggggggaaaact

SEQ ID NO: 151521 - DNA, 411 bp, Homo sapiens
aatcttggctcactgcaacctctacctcccagattcaagcgattctcctacctcagcctccccagtagctgggattacaggcacctgccaccacacctggctaatttttgtatttttagtagagatggggtttcgccatgttggccagcctggtctcaaactcccgacctcaggtgatccacccaccttggcctcccaaagtgctgggattacaggcatgagccactgcgcccggctggctttcattcttaataagaagaaagcttagtgaaagatctagaattatgtgtacttttgctcataagtggtgatgaaaatgaaatgactataacaagataagaaaagccaccagaattggtattgagaatagctgggattacaggtgcgtaactgcctcagcctcccgagtag

SEQ ID NO: 151522 - DNA, 196 bp, Homo sapiens
atggacacaggcatttaaaatcagaatttgtaggtgaaatcttaattggtctcaacatctactttatttctgcattgggtaagcccttgattcacagagaagcagtggcaaagagtagctaattttttcagggctcccttcacaatttaattgggctcttcagttaaatcagttaaatgaaaatggcagaagaatc

SEQ ID NO: 151523 - DNA, 188 bp, Homo sapiens
ctgtgaggctaactctcctcctacttttctaaatattcactctggctcctcttgggctccatgctgcaaccctgcctgtacccaggtcctctccctagttctgttctcttttgtctgctctccttccctggtttgctcccctccattcacctcaacaccgcttccagggctgacctctctcctgtgtt

SEQ ID NO: 151524 - DNA, 695 bp, Homo sapiens
ccttagtgcagcaaaagcccttagaaggttataaaccagggcacccataaggctgtgaaagtaaccttgacagatatggcttagagtagagtgatggcagaggagaaaggcaatcagaagtgtttggaaagctcaggaggctgaggcaggagagaattgcttgtacctgggaggtggaggttgcagtgagctgacatcaagcccctgcactccaacctgggcaacagagtgagactccatctaaaaaaaaaaaaagcttggaaagttacagcggtaagatctgctaaaggatttgatgagatgggtatgagataaagaagaattaaaattgtcttctagatttgtggcttcagtagttgagtggacagaaatgtcatttacttagattagagattgatcttagtggagaaacaggttttaaactagattgaaggccctctgattagttaaaccattcccctactgatggtcatttagttgatttccagttttattatctttgtaaggaatatccttgtacttgtgtatttgtacgtgtggacatattctggaagataaattcctagatgtaaagttctctcatcgaagaggacagtacatatgtttcaagttttgatggatattcattagttgccctccaaaagtgaggtgttggcttggattcccccaacagagtatgcctttttcctggcatc

SEQ ID NO: 151525 - DNA, 299 bp, Homo sapiens
gcaaataatggcaagtggttgaagaatgatataattttaagatgaattcatcttcgagacagctaaataatacttctgtataaagtccgatagattttccaaatctttcacaggggtttgctgtaaaaggtagttattcagaaataaaaaggaactcagagcagattaaatcaacttctggaaatatatctgtgagtcctccaaataaaccaaaaggacctattgtaaatgggatgtggggatttcttgaatgaaatccaaatgtgttctttgttaaataaatagaaggacaaaaatta

SEQ ID NO: 151526 - DNA, 635 bp, Homo sapiens
gttgggtacctctgccttcaggtcttttatgagattgggactgtggtcttaactgaagctggactgggaaagcatgagcctttaagctgactcatgtgaaaattggcagggtttagtgtggctggagagcctgactttccttctctctactggtctgagcaccccctcaggctctgttatgtgggtctctacatggagcatctcatagcattgaagcttgcttcctgtgtttgaggtatacaatagagagagagaattagacaaaaaggtgtacacaaaaagagacagagaaagattgagggcgcaaacaggaaaaatccagtaggagaaaaatgagagctttaaaaaaatcttgacagggtgcggtggctcacacctgtaatcccaacactttgggatgctgagacgggtggatcacctgaggtcaggggtttgaaagcagcctggacaacatggtgaaaccaccgtctcttctaaaagtacaaaatgagcaaggtgtggtggtgcatgcctgtaatcccagctacttgggagactgacgcaggggaatcatttgaacctgggaggcgaatgttccagcaagccgagatcacaccagtgcactcctgcctgggatacaagagcgaaactgtctc

SEQ ID NO: 151527 - DNA, 479 bp, Homo sapiens
ttcataaatatcatacctaggtttctcactccactaattgcaaatcagttggtctcaggtgtgtgctaaggtattctactgtttcagaagtcccgtggtgattctatgtatagccaagcttgagaaccattgatgtaggggttaggaagaagacgaagagaggccaggtgtggtggctcatgcctgtagtcccagtgctttgggaggtggagactggaggattgcttgaacccaggagttcaagacaggcataggcaacatggcgagaccctgtctctacaataaaataaaataaaaattagccaggcgtggtgggacacacctgtggtcctaggtacttgagaggctgatgcagttggatcgtttgagcccgagaggtcgaggctgcagtgagccatgatcgtgccactgtactccagcctgggtgacagagcaagacctcatctcaaaaagtaaaaataataagacaaagataatac

SEQ ID NO: 151528 - DNA, 465 bp, Homo sapiens
ttacaggcgtgagccaccacgcccggcctttttccttattttttaatgtaaggatgcaacaccctagactgaaaagaactcagccttctaaactagacagattgactttaagtctgggttctgctgtgagggcaagtcatttagcctgtctgagcctcagtttctgtatctgtaaaatggggataataataactacctccagtggttttaagaataagaggtaatgtaggtagagagagggctgcacagtgcttagcatgctataggtttgcagcaaatggcacctgtgttattttcacttcacattttccacacatattcttattcatcttcaaccatctttccactttggcagcgttctcttttgtaatagtgtccacttgtgtgcatctcctgtctcacatgcatgatgcactggcagaagcaaagaatggtggcacacacttcctaatagtccctaagtcc

SEQ ID NO: 151529 - DNA, 314 bp, Homo sapiens
ccccttcagccttcggagcagctgggaccacaggtgcacaacaccactcctggctaatttttaaatttgttgtagagatgaagtctcgctgtgttgcccaggctggtctcaaactccggggctcgggcaatcctccttccttgacctccccaaaagccctgggattacaggtttgagcccccacacctggtcctaaaatttaccttagtatttatcagttatatgttcatacacagccaaaatgtcaaacagcaccataggcttaaaatgtgctgcccctcctaccctccccacccctgcctctatgtcatttt

SEQ ID NO: 151530 - DNA, 552 bp, Homo sapiens
ttcaacagctacagaatccacgttcttctaatcagcacatggaacattctctaggataaaccatatgttggcacataaaacaagtatcaacaaattttaaaaactcaaaattctatcactgatcttttcaggtcacgatggaacaaaactagatatcaataacaagaggaatgtaggaaactctgcaaatacatggaaattaaaccacatgttcctgaatgaccatggggttaacaagaaattagggatgaaataaaaacattgcttgaaacaaatgaaaactgaaacacaacataccaaaacctatgggatacaacaaaagcaacactaaatgaaagttgatagcattaaatgcctacaacaacaacaaaaaatagaaagctcacaaaataacaacctaacactgcatctcaaggaactagaaaacagaaaataaaccaaacacaaaattaatagatgaaaaaaaatgaagatcagagcagaactaaatgtaacagcgattcaacaatacaagagatctattaaacaaaaagctggttttctactggctag

SEQ ID NO: 151531 - DNA, 393 bp, Homo sapiens
cggaggcctgtgcattgagtatgcgctaaggtttttaatacaactggcttctttccattgtctcccaaatatcccaccccaggtagttgggtactgaacacaaactggtcattttgatatgagaatgagcaaatctaccagaaaattacgagccatgtatgtctgtaatgaaatccacaaggaaccatgactgcagtttctccagccccatggcacacctgtgtcagggtttacaccagtggctttaacaatacagcccaacacacacacctgttgcggggtggagcaggtcacccagggaggccagtcccaagccaggaagcagcagtgatgtgcccaagacggcacctgtctcagatgcatcccagctcaccaaggaccaggggattccag

SEQ ID NO: 151532 - DNA, 298 bp, Homo sapiens
tacaaaaactcgggtgctggtggctttgcagagcagtcaaaggatcaagtccctgccctggagatgtttgcagtcttagtagatattccccaagagaaacaacaacaacaaatcagtgtgcactgtacaaaaaccataccatggctggggtcactgcactctccgtcgatgacgggagtggagagacaggaattctgaccttcacatcgcacccactgggttacctacaaggccgccaattaagagcattgtatctcagcagaaacccaagacttaaagaccagatggagcccagtcc

SEQ ID NO: 151533 - DNA, 140 bp, Homo sapiens
tcttgctaagatttctgcagcagcctcctaagttcccatctcccttctttccccagatccaggctccagcaaccaggcctttctatgtcacaggcctgagccctccttaaaagactttcaggacaggagcggtggctcat

SEQ ID NO: 151534 - DNA, 451 bp, Homo sapiens
atgacttctcctggagagttggatcaggcccattgcgggtgagagggcaaatctttcccaagaacccaagtggtagaatgggtctggccttccctttaggtggttattggagaactggtgggtatgcatgtggagacgcagatgcctgacaaagctggtgccgtctggatggggggcaagtaaggtgtttaggagtgagactgtggtgactggtaccaaaaaaagaatgttggggtgatcagatccaacaccaggccttggtggtgacgaagtctggcggagtcaaaggaatgagaaaacacagtttgagagagaaaacggatcaagtgggctaacgcaagtatggaggctgtgaaggccctgagctctggaagcccagactatttattggcgatcaaacaggtggtgagaatgtgggggtcgaaagggcaagtgcatgatctacagctgt

SEQ ID NO: 151535 - DNA, 175 bp, Homo sapiens
tagtcagttaaaagtgtttggacaacctctctgagtgtacatgacttccatgatggaaagcaggagtggcttaggtctctttaacgctctccactgactgtgaaaatcagtccatcctgaagtgggcacagagagtgaaggggcttattccaaaggtccagccccagaggttctg

SEQ ID NO: 151536 - DNA, 289 bp, Homo sapiens
tcattgaaatatggattttaagagcaacatggctctagccgtgtttttcctttcttattattttatgtttgatttctttggttaatcattttactccttttcccttgttacctccaaagatatgacaaaatgcagaaataattggtttttaaattggcagacttttgtttaaaattttaacatggtttttagaacatttttttttcctattttgatttaaaaatacaatggataaagatttaatatctattcaagtttccccttctactccttattcacacctctacac

SEQ ID NO: 151537 - DNA, 306 bp, Homo sapiens
gtgacctggcatacccccagcagctccagaggccgaggtggggctgggggtggacatgtacctgcccttcctccaccatcaaggagccaaggtcccaggcccacctttcttggggatttagaggggtttatccgacccccggcaggactgaagggccacgggcaaggagttatcactgcagacactagtgttgcttctggcacactaggtgttatgttagactctggacagccagagatagagcttttttgtttttttgagacagggtttcgctctgtcacccaggctggagtgcagtagcacgat

SEQ ID NO: 151538 - DNA, 314 bp, Homo sapiens
cctgtaatcccagcactttgggaagccaaagcaggagtaacacttgagaccagaagtttgggaccagcctgggcaacagtgaaatcttgtctctacaaaaaaggacaagaaattacccagatgtagtggcacctatctgtagtctcagctacccaggaggctgaggcaggagaatcccctgagcccagggaggtctaggctgcagtaagctgtgatcacaccactgcactccaggagggagagtgagtaatgtgttattggaaatattcatttatgtgcagtgatcgggtgaattatccttatggtgtggccaa

SEQ ID NO: 151539 - DNA, 485 bp, Homo sapiens
gctcttcgtgcaagatccaagagcaaatctgtttccaggggcagataaggcaaataagaagtaatgttgggatcactggcacgctgggaacccagtggcagtagaggtttgaatgagcgaggcatctggacaagtcaagtcaagaagtttgcacccttgtggaattgttcccaaaataacctcgaagaaatagtctccatcgaggctgttgttgttcccacaatcaagaaagtaggaactcaagatgctttcactagaattgttcatttcagggaataatttaaggaagacgtcagtgcccacattgtcttcctttgtatatcctgttgattcagcaccacctttggaaaaatctctctttccctgattgaattgcattgtatgtggttttacataggtagatccattttgtttcattggtctctatctttatgtcagtaacactctttcttaatcagtgtatcttcagaataaaataaatctca

SEQ ID NO: 151540 - DNA, 255 bp, Homo sapiens
acaaatgtctgtggaatcttggaggtaaacatcatttttaaagtagcaaaaaccaagtacacagaaaatctgacattgtctagctaaactcacctttgtagccacatttctgctgaccccaaagcctcattctgatacattctgtttcctcctgggatgcacattcaccccagctgactctccccctccttccctgggctcccttactgggcgcatccagttattttgagctctcatagcaccgtggccctctct

SEQ ID NO: 151541 - DNA, 292 bp, Homo sapiens
attccacagatttaggaggtgtgagaggaggactagaaatctgtttttgctctttttaattattttaagttttatcactgatttgggctatattcttaatggcaagggaagcagtataaatagaataagaaatgttgtatactagatttaagatcatatacctcctatgttatttcacaaggccttaacagaacacagcaaaatatgttccggtgttttgtgtaaaatgtggaagatacattataaaatgctaaatccagaaaatctgttctatggtctttaagtttcaaat

SEQ ID NO: 151542 - DNA, 213 bp, Homo sapiens
ctctgctccagcctggccaatagaccgagactctgtctccaatcaattaaccaatcaaccaatcaaagacgcatcctttctccttcagatacaaatcacctctgtagagatgggtatggcctctgagtggagataatagtgatgatataataaacataataacgatgatagtaataaatgatcatttaaaaataatactagccggcgcggtgg

SEQ ID NO: 151543 - DNA, 1150 bp, Homo sapiens
tataaaatggtatagtgtttgcatatgacctatacatatcctcctttatactttaaatatctctagattacttataaaacctactacaatgtaaatctatgtaaatagttgttaatactgtattgtttagggaatcatgacaagaagaaattctgtacatgcttagtatagacacagccatccatttttcccccttcatattttctatctacagttggttgaatctgcccatggatgcagagggccaactgtatgtctgtcctaggtactgtgaaactaaatcactgaaactaaatcactgaaaactctagctgcagatagactggaacttggagagtctggaaatagagagtcaagagaggctattaaagtttggctgtgtcgtgataactactataaatttggtacattcactcacggagtgagtattttgccatgccctgtgttaggtacctggaacagtacctaagatagacagttcctaataacccatggatcccattcaggttggggataataatctagttggggataataataattattattaatttttctccataagttaataattataggagcatggtaagtactttgggtatagggtgagtacacagtcttagaagaggaaaaacaaggaggatttagctggtcttggttggtcaggaaaagcttatttaaagaagggcttataaactgagacctgaaggttgagtgaggagttgtctgggttaagggctggcagcaggaggtggtggtaggggaggggttgaggcatagaccccacagggttaggtcggaagatgagaaagaacatgatgcatttcaggaaggagcatagagtgtggaggtgtctggggctttatcaaagtcctgtcagccaagagcagtagggagcattgacactgaagggttttaagcaggaaagtgacgtatttgtttacatttataaaattcactagaactgaaagtagaatgagtagaaattaaaaagttggctatatgctaggcatggtggctcatatctgtaatcctagcactttgggaggttgaggtgggaggattgcttgagcctaggagtctgaggctgcaatgagctatgatcacaccactacactccagcctggttgatagagcaagatgctgtctc

SEQ ID NO: 151544 - DNA, 232 bp, Homo sapiens
ggcacacatgtgtgcattatgtaggctataaagtccatgcagagagagacttcagatgtgtgcacttcatgagaagctacatgccattaaaaacacctccagaacaggtgctccaaagggcaaggctccccaggtccaggagctgtgtcttcagagtggtcattaagagaagttccatggaagggatgagttcacaaacacacatgcatcacacacagtacacacatcacac

SEQ ID NO: 151545 - DNA, 465 bp, Homo sapiens
  misc_feature (1)..(1): n is a, c, g, or t
ntcgggcactagcttattacgcgggtgacaaataattggtacaccaagcccccatgacacgcacttatataacaagtactgcacatgtacccagaaacctaaaataaaagttaaaaaaaaaaaagacaacttagaaaagagaaacaaggccaggtgcagcggccttatgccggtaatcccagcactttcggaggctgaggcaggaggatggcttgagcccaggagttcaagaccagccggggcacacattatggagctccataatctgtgcccagggctggagctctggggctgggcacctgtgtccccagcgtgaagatgaggaagggtaccaggctttcttcattcgtttttactaaatagtgtatgagagacaacagttgtctctgctcataaagcacgcggtctggtggggatgataacggaagcttcctcagaattttggggatattagataacgtataa

SEQ ID NO: 151546 - DNA, 234 bp, Homo sapiens
ggtgattcatatgcatgttaaactttcagaagcactgaactaaaggactttgaaaataaacgcacatgaactgaaagtacaaaaatgtctgagataactatgcagaccaactgataaactagaggcagatattgactacctatactgctgatagtggagaacagtaaggataggaaaattcctgcttatatttcccaggttcaaaaccagaaaaggaaaatgtcaccaaaattt

SEQ ID NO: 151547 - DNA, 128 bp, Homo sapiens
acctggtaaacaacaaacatctgagataaagacccttaatattaatatttaaaaatctgaaaaaaaaatgataaaaggtgaggtctatacactgcaatttttaagctgcttttgttacagcacaggag

SEQ ID NO: 151548 - DNA, 368 bp, Homo sapiens
atttagtgaaggttagttgaacagtgaatgactaaatttctgaattcctgctttatatacggtgcagagagacagagaggggctaagtgacagatggtccttgcataattatgtcagctgcctggctcagcaggacgtattaggagatcggcagcgtggtgtcatgcaggccctgggacactgtacatcaataggtgacatcagtgtcccttaacagaatgagctgccccttctgccccagcaaggtggccacagatctctcacatgtcccgtgtttgtcaggagtgagggtggttagagtagtgccacttgttgactctgattctcccagtggtcatagctataatgcaatgaagactatttgttat

SEQ ID NO: 151549 - DNA, 212 bp, Homo sapiens
accccgtgttttattttttcaccgtagcacttatcacaatttacaattatggttttttccccctgcagtgtttatcatctggcttcctcacagacgtacacaccaagaagtcaagaatcatttctgtcctcttcaccattttagatgggtgcccaggcccagaactggagattaagtcacaacacatctgggttgagggcaaaacctttttt

SEQ ID NO: 151550 - DNA, 458 bp, Homo sapiens
ggccgaatccgaaatccgggcatgggatcacacttgcacactcagtcaacaaatatttttgcacccctgctctgtgccaggcacggtgcacacagaggaacacagaatgaccccatggagaacatgaaattacctgcccaatgagtggtgtggcaggcttctgagggcagggagtgatcatcgcctggattggtcagggaaggtcagtgagtggaagtaggacaggtgttggcctgagagtcagagatggataagagaagggccttttgtaagaggcagagtctgacagaggggcagctatcagagtgtgggcttgagaacacctgggcataaatcaaggctcagtcatgagaggcaaagtggaaggtgggttgggccaaacacagggtcagctttagggcccactggctgtgatgaaagagggtggggggttactagtgacttctcagccagaagtg

SEQ ID NO: 151551 - DNA, 278 bp, Homo sapiens
tctaggcccataaaagccctggattcagccagacgaggatcaatgggacggctagctgcggagagaagctacctgctcaagagtctcccttttgctgagagctgagtagatgacgaaacaacctgtgtggagagaggagctcctcactccagggtctcctctctgctcagagctgaacactcactgggacaccctggctgtggagaggagctaccctctgtgggtctcctctgagctgttctgtcacccaataaaactcctcttcaccttgctcaccc

SEQ ID NO: 151552 - DNA, 505 bp, Homo sapiens
atgaatttagttctggatatctaatgtacagaatggtgactatagttaataatcagtggggaaatgactccctattcaataaatggtgctggactaactgaccagccatatgcaaaagattgatactgaacccctaccttacaccatatacaaaaatcatctgcctgcccagcatccattcccccttctggtaaaagcctgttgattatgtgtgttttgggggtggagggaagaatgactgtttcctcccacaatgtgtgcattcctgattcctggcaagacagtcgaagtgctccaccctccactgccaagggtgtgacttgctcaggaatttgaagcaatcaagtatgagatggcagactggaaacgctggagctgattcattctagagtggtgtctgcgggaggacctgcctactgatgcccccaccttggaccctgagtctagctctcttcttctaaggcctgcttcttcaactttccctttgcttctgtgagcttccctg

SEQ ID NO: 151553 - DNA, 219 bp, Homo sapiens
ctttcttcttgatgtaaaaaggaaaaacaaggccataaatggggatttgtgttggaattctctcaataaatgctttataaaacttttttttttgagacggagtctccctctgtcgcccaggctggaatgcaatggtacgatcttggctcacagcaacctctgcctcccaggttcaagagagtctcctgcctcagcctcccaagcagctgggattacagg

SEQ ID NO: 151554 - DNA, 701 bp, Homo sapiens
cacagaacaattgtgatttctccattgataattaaaattactttacagggtttcagcatgcacagtcacttttagggtcccgtgctacggtgcaaagcaaggactgctaatacatgcacacacacacaacacatacacacgcacacaccccactggctttgatttgctgttacagttaggccttgaacaacatgggagttaggggcaccaacccctacatagttgaaaatctgtgtataacttttcactctcccaaaacttaacttctagtatctagtgttgaccagaagccttaccaataacatcaaaagtcaattaacaaatacttttcctgttatatgtattacatactgtatccttacaataaagtaagctagaaaaaagaaaacgttattatgaaaatcataaaaaagagagaatatgtttactgtattgtactgtatttatcagtatgataagtttgtgttatctgttgacaagatgaattatgtatctgaaatggctggcaacctcagctgcaggacactttgaggagacggctgattgcagatctagggcagagaatgaataaggtaagcctggaatgacatgttttgcagaaagcaagtaagcactcaaagactaatgaggtcatgtcaaaaggacacaggagccagtctggaaaggcttccagtagccaaagttgggacagttgaggatca

SEQ ID NO: 151555 - DNA, 781 bp, Homo sapiens
cctggttgataaaaatagcgctcctgaaaaccgagtctgtggacctttggaggcagggatgagtcagcctctcctaggtttcttctgaccatcaacacttcagatcagtttgtcttattttcatcaagaatctatttagttgtgattcgagtggctttactggtatctattactaggtattagggacttgaaacagacctttttgagctgtcagtcactgttgtaatctatgtaattgggcccaatggaaggtgctttaactgctgaagctttgaccctgtgccagctcttccattagctatcacagttgaatacccgtccaaaatccataaagcttgaagtgacattaactgaactatgcttaaaaaaaaatctgttttgacttctggcagtaccggtggcagtatctgccatatgttacagtagaatttgcccttgtgataggaattgtggacagtctgtggagagtttgggccgggctttggaaattgccaaggtcacctttgaatgtagacataaaaacactattggaattctcagatattaccactggtatatcagtgatggaaggaaacacatcttacattattctgcctgtcttgcaattctacaatgtcaggatataacatttctcccactgtgtgttatttttagactatatttctatcatccttgagattgaacaactgcctctcaaaatattcaaagatactcggtagtcatttaataacatttgtgtagaatgctgtatggaccttttgctaacaaggggagaattttt

SEQ ID NO: 151556 - DNA, 323 bp, Homo sapiens
ctgactcgggcctctatgacactattggtagcggggagagaagggagaagctggagttagatttcagggtgttaagaagaaggataagtggatttgctgcatctccatcctggcatcatttctgatgtccgtaaatgctaaaggcctattaggccccatagaaccaggtatctcatcgcccagaggccacatctcacagccagcatgggcatcggggcctagggtcatgtccctggctctgttgtggggcttttatgcagtctcccttgcataatctcctgttcccttttgcatgggcatgatgcctggtttgtttcctgtct

SEQ ID NO: 151557 - DNA, 281 bp, Homo sapiens
taaattgagggcctgccatttttgttaactggtatccctgaatgtggctaatggcacaagctacgtagaaacaggcccttgtcctgtttttgcaatgagcagaaatctagcccactgagacatcgagttcttttctaactttttgctctgttgagaacatctttgcttttggatacaaaggcagcatgaaaatctggaggccttctcaggaaggggaacttctaggaacttaatctgttagtgggaaagccaggaaccagcacacttggagtgtcatctga

SEQ ID NO: 151558 - DNA, 432 bp, Homo sapiens
tacatgatacgactcgagctctgacccattcatgaattcactaactggtcaagaataaatcccaacaaggccaggattcccatggcaggagatacccaaggtctggtaaagtcgttctgctaaggaaatatttccttttgctgagcaactcttcagtggtagttgaagtccagtagaagtaggcaaagctaattcacatgaagaacaaatctgtgatgggggaggtgttagagcatgtcccattgtctgggcacacaaagaagcaatcgcatattaacatgaaccaaattaatggtaatgaaaccagagtttctaagaaatggtaataaaataataactaaaccgtgcctggcacactatactttactgattgctttcatatatagtatattatttaacgtgtacaatggccccgtggcaggtggttctgtt

SEQ ID NO: 151559 - DNA, 388 bp, Homo sapiens
accgccacgcacgctttacgtatcttaggattataaagttccaataaagatttcgagcttggcatgcagcggcataatcatggctcattgcagctcgacctgccaggctcaggttatccacctgcctcggtctcccaaatgccaactgtggggggaataaagttgcttagcaacgtggaaatgggagaagctataaggcttcccagtgttcacgcaatcgtccctatttctgtgcctcttctacctttcatcccagaggttaactggtgctgtgaattctgaaatgtgtcagacccacactgcagtctgaaggctctctcgacctacgcttgctccatctcccgttcatcctccatttatgtttcctctaataaattcttgcacatct

SEQ ID NO: 151560 - DNA, 303 bp, Homo sapiens
tgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttt

SEQ ID NO: 151561 - DNA, 367 bp, Homo sapiens
ctgttacatttttcttccaaatgctcaagactctggaagccagaatcttaaggcttaaactgggttctgtgtgctactgtcctctgagtaggaggggcagggagaaccaagacttctcagaataaggaagaacagctctctaatgagaaatcacagtgcttttacccaaaaaagtgggagggtttgcttgacaggccaaagcaagggatctccgggatgctgattttagaaaggtgcacagaaaaacagggagatgattccaccctactccttcctggccgagttctgggcaacacactttcagagacttttgactgcttggagtgagaagggataggttcaaaagcagcaattaagatgcaaatat

SEQ ID NO: 151562 - DNA, 235 bp, Homo sapiens
atggcagtgactgcaagtgggctggaagtttctttctgggttacagaaatgttctaaaattagtaatgatggttgcataattctgtaagtttattaaaaatcatttcattttacccttaaaacaatttaattttatgatattgagttatcactcaattaagctgtttaaggtatagcccaccaggtgcggtggctcacgcctataatcccagcactttgggaagctgaggcaggt

SEQ ID NO: 151563 - DNA, 447 bp, Homo sapiens
tccactatgtcacggttggctaacatggatcagacacttacaagcaccaggtactgctctaaccactttgtaagtatcactgcatctcatactaaccctagtaccttatgatgtacgtactagtattattcaaagtttccaaatgaggaaagtgtggcccagaaggattaagaagcttgcccaaagtcacagagctagtgggtagcagatctggccccaggaagtctgacccctaacagtgtctcaagagacccaatccagatagaggccaccaacaggaaagcagggcctggaggaccaaggacatcctttcacaaagctgagaaggtgcaaagagcaagcatggtggctgggtcagggaaattgcaaggaaaaataagcagcaatacaagggaagttgggatctggacatgctttttctttggatcctgacccagccaaccgtgg

SEQ ID NO: 151564 - DNA, 489 bp, Homo sapiens
tacccaaagttcctctcatgttttatgaatcaacaattgtctcctaacttgtgaaagaaatcagtgtgaattagcgtctagaatcttataacctgtctgcattaaactataaaaaaaatgagtacaattagacatacaatttaaagaattcatcaatttaaatgaacaaaaataaagaacttctctgtgatctcatgttccttttcaagacaacacactctcagggctgtctggtttaccactatttcttctttacattcatgttctttatcagcaaaacgattacaatggtctttcagacttgagtgatgaatgacaaaacaacacagttccattctaaaatgtgaatggccgtggagcacagctccaaaaacgaactgcaatggttatgccagagaataaataacatccagcaacagaatcaaattctaaaattaagcaagaaaaagaagtagaaataaaaggagaaggaggaaaaggcaaaagaga

SEQ ID NO: 151565 - DNA, 411 bp, Homo sapiens
taggaagaataccacagggcgtctgtacaccccctgcaatactgacattaggaacaatatcacaggacaggagtacacaccctgcgatatttgtggggaagaaagatccattagaagattcatgaaaatgcacaagtggaagataatgatggtcttctttatggctgcagcagcagagttacaaagagggatgttcattcaagagtcattcttgaagcagaagcaacaatttcatggccaatcagagagacagtggcagatggcagctgggtgctggaagaaatggaaaaagaagactagaaaatgctgcagagattttgcttgaggagctttgaaaattattgctcatgaaatataaaataatgggctgatttggagtaatggataatgaataggtgatgtttgaagtgg

SEQ ID NO: 151566 - DNA, 361 bp, Homo sapiens
atctcggtccatctctgtatttccatttaatattaatattttcagatcatagttgactgcaggtaactgaaaccacagaaaatgaaactatacataagtggggaccactgtacacccttgtagtcatcactcagatcaacaagagaacatttccaaaggccatgagattccctcctgtacctgtgaagtctgtagcctctacctataagcactattttgatttatgtcatatcatagaccagtttttcccatttaattcattcatgtagaatcatagtatgtggtctcaatatgaagtcttttgtatttggcttttcctcaaagaattggtgagattcattgatgttgcaggcaatcaggt

SEQ ID NO: 151567 - DNA, 648 bp, Homo sapiens
tgcagggtcgcccacagaatcaggacagcagcccacctccaccccaaacctgctctgttcccagggggtgagcgctgctcggtgcaggaagtgtgtgagcgcgtgtgtgtagatgggtgggaatgaatgtgtgtgtgcctgagtgcgggtgcaagagtgtgtgtcaatgggtatgttttgtgttgagaagtgtgaaagagtatgtgtgtatgcctgagtgtgtgaatgtatgtcatgtgcatgtgtatgaggtgtgtactgtgtgtgtgaatgtgcatgggtgtgtgtgttgtgtgtgcatgtatatgtgtgtgtgtgaatatgcataggtgtgtgtgcatcaagtgtgtgcatgtgtacatgtgtatgaatgtgcatgggtatgtatccagtgtgtgcgtgtgtgagaatgtatgaatgtatgtatcaagtgtgtgcatgtgtgtgtgaatgtgtatcaagtgcgtgcatgtgtgtgcatgtctgtgagaatgtgagtgtgtgtgtatcaagtgtgtgcatgtgtgtgcatgtctgtgagaatgtgtgaatgtgtgtgtatcaagtgtgtgcatgtgtgtggggatgtgtgaaagtgtgtgtatcaagtgtgtgcatgtctgtgaattggggtgtatcaagtgtgtg

SEQ ID NO: 151568 - DNA, 357 bp, Homo sapiens
atgttgagaccaaaagactttttttccaagtagaatgaaatagaataaaatacaattgaaaatacttgcctgcatcacaggtaatgagagtaactatagtttcatgaaaccgttgtttcagttaaatatgtttttgcgtgtgtgcatgtgtatcgggaggagatatgtatttcatatatatatgtagagaggtggaaatcaacaacaaaactccataatttttcttgttttctaacagttcttgattttgagtaaaaataattctttaagaacaaaattttgagccagctaacgaaagatcagagtcaagcagcctctcattggggcctgaatagaggttcatcttatttggctttt

SEQ ID NO: 151569 - DNA, 380 bp, Homo sapiens
cggggcactgacctctgctggtggagatatcaaagtggcaggtgtgtgggcacagtctggtacttgtcgatcattacttagggcacgagaaggctcgggtgattatctgctttccaaactctacccttccctgctgagttcacacactcctcgtagataagagacttattgtttctggattatgagtagttacaattgtatgaaatccctgtaattaaagttgttcctctggagctggcgccatatgtaacatattgccctattctgtagggtctaggtacacatttcagtatctctgaagtcaggacgtgacttcacatttggtggtgtctccgacttggtgaggtagggttgttgtcttggagtagatagaggttttg

SEQ ID NO: 151570 - DNA, 440 bp, Homo sapiens
gccacaccaggccttcccaagccgccagccaatccagttccctcatgtgaccagagagctgagctagcactaatgatgagctcacagcccacccttgatatgcacatgggaataggtgaaaccagacagcatgcttccgtggtgcttctcaatgagacactgagctatgtcttttatggtttattatgctattgaaatatgattcacatactataatattcacccttttgaagtgtataatactgtctgggcacggtggctcatgcctgtaatcccagcactttgggagtctgaggcaggtctcaaactcctgagctcaagtgtttcacccacctcagcctcacaaagtgctaggattacaggcatgagcccccacacctggctttagatatgtttagatacacaaataccattctgttccagttgcctacactagttca

SEQ ID NO: 151571 - DNA, 880 bp, Homo sapiens
tccactagtgtaggcgtggtgctcctctaatgagagcaggcaatttttctaagaactggtccttttgggatcttccccagaacccccacccccaaatgacacaagctcttagtgagaagtgtgaagcatcagtttaatttgagcaatggtctacagggtcagactggggactagaaaagggacggcctcagcagtcctaaaatgcttcattccatcctcttgaccctataggatcgtcaagacaccagtcctggtggacagagggcccctgcttaaatgtacaccgaagctcgaaactgaatgatcatgtctaattatcctaaagaaaagctgactggcacactgtattagaaagaaccccaacaaaaagtcagaaacctggattctagtccttattctgacacatttgcatcagctgtgtgcaagctgtgtcagaagctgagcaaaccacctaatacctctaggcctcaatttgctcacctgcaaaatgggagtaagggggggtcattccacatttggcagtttagcaccttagtaagcaccacacactctgaagttacgctgcctggattcatatcccactttctcctcttacgagttatgtaaccttgagcaacttagctctgtgcctcagtttcctcatctgtaaaatgtacctagttcacaggactgttttaagcgttaggtatgaggaattaggtaaagctctcatcatagtgtctggcccttagctcttccaataattgtcagccccattaccatgatgattagtggaagatgaggaagaaaaaaaattccacaactaggcatttactacaaggattaaacagctttgcagtaggtggactttttacttgttagaaggtttcagaagaatggg

SEQ ID NO: 151572 - DNA, 400 bp, Homo sapiens
cgaggtaggtagatcatgagagcccaggagttcgagaccagcttgggaaacatggtgaaaccctgtctctcctaaaaatacagaagatgagccaggcgtggtgtcacacatctgtagtcctagctgcttgggaggctgaggtgggaggatagcctgagcctgtgagttcgaggctgcagtgaggcatggtcatgccactgtgccccagcttagatgacagagtgagagcctgtttcaaaaaaacaaaaaaccgcaaagccattattgtacatggaacaaaatctctggctcacccagccattgttatgatattgattggttgatattcatctctcaagttcctaaacctactcctccctccctaccatccctggttaccattacagtgtgcatgtttagg

SEQ ID NO: 151573 - DNA, 320 bp, Homo sapiens
ggcagaaagaaaaagaaagataagggcaggaggaatatgtttctagacagtcactgtttttaaaaaaaaatggacattgcctcaaagttaccctcttccactgctagcccaaatttctttttctttttcttttctttttttttttttttttttttttgagacagggtatcattctatcacccaggccggagtgcagtggtacaatcatgtctcactgcagcctcaacttcctgggctcaaattatccccccacctgagtttcccaagtagccgggactaagggtgcgtaccaccatgcccggctaatttttttttttttt

SEQ ID NO: 151574 - DNA, 576 bp, Homo sapiens
tttttaaaaggacagagagcatttgttattgagtatgcaggcagtatgctttgaagatagaggtcacatttagtgagggattcgtggtttaatagattggaagaagggattattagatgggatgggtttggtggaatatgtgagttttctaaagtcattaggtgttttatgcatgagaacataaaagagctggggctggaatcaattttattctaatctaacagatgtcttctactcttaagacacctgtgtaatgaaacgtggctttccccatatctccctactttcactccacttaattaatatacgtggctgtacattgacatactatatcatctattcctaatagaggggttttgcttccttagattttaattatcaataacttcattgcagtattctctgctttcttggtttccagctaattgccccacttgttttttgtttgactagttactttcttcttcatttatgacccctgtctgtagcttatcttggcttctactttctcttatgttctcccctgaattcctttacgtatgttaatattaagctgattgtcataatatttataag

SEQ ID NO: 151575 - DNA, 229 bp, Homo sapiens
gaaaggatcagagaggtgggaggatggagggacagacaaatcttggaatagtcacaagtcacctagataggcaaacatttctgtgggttttttgttggttttgtttttttgctgcactgacccccacagaccctgccccatatcactcacaccagggaaacaaacccttctgtgccggtggctcaatgctcagacccaaccctgcaccccacacaccaccatccaccct

SEQ ID NO: 151576 - DNA, 533 bp, Homo sapiens
gcattcctacaaagcatagttagcttgattcaaggagctggggcgtgcaggccctagcatgggcagtcttcaccctacctgtcctgcctcaacaccagggcaagtgtcaggtgccacataaatctgcatttcgcagtggagtaaaaggcaaaagaaatacttcttgtacttctctgtgtctctaacaagagtagaaaaactggctgggggcagtgtctcatgcctgtaatcctaggaggatttgggaggtcatgggggaaagatcgcttgagcccaggaggttgaagctgcagtgagccatgttcatgccattgcactccagccagggtgacacagcaagacccttctcaaaattaaaaaaaaaaaaaaaagaagtagaaaaacagaagatagaccaagaggactatgtgtttcaagcaaaatggacagagcctcttactttggggcatggtgactccactctgagtgtgagacacaaatactgcccacttcattcatctactctttatctgcctctctcctccaggcacctg

SEQ ID NO: 151577 - DNA, 795 bp, Homo sapiens
atgtccacggttggctgagggcaggtgagtttgcctggtggtggagagaaagaggtgaggtgtagctgggcaggggggctttctctgcccctcaccgaatccccattccaggctcaaggggcagaagtccccagatcgcctcagcagtcccccacagtaggcaataaaagcctgaaaaggaacgagccgggcattctcacttaagaacagagagtaagcgtcacatggatgacttctgtctccatgagtcagctcagtttgttgaagtgtgtttcagggcaaggacatgtggctcctgcgtaagtgccaccaccttctgggcactcgctaggcctcgggtcctgtgctgagctccacagggattatcttaatcagttcttggcataagcttatgaggcaggtacagttcacaaaggagttgtgaaagggaagcctcagagaggttaagtaactgacccaaggtcacacagctagcaacacgcagggcaaggtctggaactcggaagtttaaacacgagagctggcactagccaaccactgtacacaccagctctttgccgggcatgctggtggttgagtgtacagatatgtacccatctgtgaccatgtgaatacgcagggcaggcagacgacacttggccatcaccacctcccgtgtagtggggggcagaggagggcacagcaccaggtttcaatttatggaatcatccctggatgcctggttcttggggtgtggtggcggtcacatgagggttcaccccgcagccgaccccctgacgcttaaaattaagctcg

SEQ ID NO: 151578 - DNA, 335 bp, Homo sapiens
ccaggaaggcctcgaggagccggcccagagctcctagactagagaggcacccactgggtcctttcccctctttccactagaccgtaagcggcagggaatttggtttttgtcccctactgcatccccagtgtgtaaaatagtacccaggcaggagcgggtccccgtaaatatctgctcctcccacccactgcggatgaacaaatgacccaaggaggaggggcctcccaaatccgagaatgaaagaattcgcattgtctgacaaggcaagaatggggcgctgtcaccacacaacctcacccatccccacgtgctcagcccagcccttctcatgctca

SEQ ID NO: 151579 - DNA, 640 bp, Homo sapiens
gtatattggtgacatgactctctgaaggcagaacaattgaaccgttttatctttggcatagcaaggaaaggggaaatggccactgtaaaagtagataaaaggaaagcagccaaccttttaacgggttcttaaagtgtgggctagtgtgccagcctggaatccatgggagccccaaacacaagaggacaagagaaacctgcactcattattgaacacttttccacagccttcctccccccggatgcgcacagggaagattgaaggcggggcaaaaaaacccacgagcagcttccccctccgaggtggggcatgaggacatccactgcccactgactagactattttttcatatgaagcaaacgcctcaagctcccgggggaggggcaagaaaccttctcaggaaaaaggcccactgcctccaggagaaggtgagaggcaaaagctgtcttcctctgggaaatgggtggaaacctgttgccctgatcctaggaaaaatgtgaactgtcactgagggagggcaaaagcaaaatccattagtggtgtgatggttaatgtttaaaaaacagctttctggccggacgcggtggctcacgcctgtcatcccagcactttgggaggccgaggcgggcggatcacgagg

SEQ ID NO: 151580 - DNA, 183 bp, Homo sapiens
gacacctgggatggggatgcccggagcaatcttggaagccagtcagctgatctgtccctcagctgagtccctgaatgactgttgagccaattgcctcccacaacatacagatacatttgtgagcaggcacgtgcacacacacagaaacaaaacatttggaaataaactattgccttcaagcca

SEQ ID NO: 151581 - DNA, 335 bp, Homo sapiens
gaagaggagagctgaatacgggtaaagcatgatggactatgggaagaacggaatatactgtgtgtgacagcatcattcaataagctatatttttaaagacctgaaccggttatagctataggttatctacaagtggaattctcaaacacgaaaatgaaagcctgacaaataagatgctaatgccattttcacttaaaaaatagaacaagcgaaagagagaaataaaagcactagcccagtaagaacatcctctatttgccttactcataagccatttcagggccatatctgcaaaactaggaagaaactgctaagtgctaaaacattttaaccaa

SEQ ID NO: 151582 - DNA, 215 bp, Homo sapiens
aagacagagggacatatgacatgagctccagagggaggcggaagcccgtagggctctcctttaaaaatagacttgcagatgatggataactaaagctgtcacgaaaaccttgatgtggagctaccaatactgggcaatgactgccgagtacaataccaggctctttatgttcataatttctaatcttcaggccagccctggtaggctttgtaatc

SEQ ID NO: 151583 - DNA, 435 bp, Homo sapiens
aatctgcctgcctcagcctcccaaaatgttgggattacaggcgtgaactaccacgcccggccaggacgattattaatacaacacttagcacagtcatgacaagtcaaggagttctcaactaaatggtaattcttagctacacagtggaagattaaattctttgtcatactgacttttgtacacaatgcctttttaacttatgtcttccagaaggaaggaaaaaaatcactttatttttagaccctagagacttttcagaattacttgtgaagtaggttatagatgtatttaatgtccaggcctggtgactcacacctataatcccagtgctttgggaggctgagactgaggacagttcaagaccagcgtaggtaacacagaaagaccttcatctctacaaagaaattttaaaaattagctgagcatggtggcaca

SEQ ID NO: 151584 - DNA, 1073 bp, Homo sapiens
tttaggagatggggatgaagaggtccagacattcccctaaatcagtaaatatttattaggtgcctatacgaggtataggaaagttttctgagcactgatctgaagaggacagagaataacataagccactttcctttaggaagtttacaaccctataaagacatatataagtgaaaagcaatataagagctttcaaatgccaaaagagggtattagacccccccccccaaaaaaaaaaactataggatgacagaggaaaagaggtgaccatggaaggaagtcagggaagtctccctagagggtgatgataacaatactaattgtagtactgaggtagctaatgctttgtccttactctatgccagatgctttaaatgcttaacttgcataatctcatttgattcttacatcagtcttacaaggagggaactatgatatagtagaaataatgcatccagggtcaaaggacttgaggtctcgtccttacttaggccatcggggctcggtctctcatggtatcattgttactagtgttataggacttgttcatatggagcaatcaaatcattctgggagcagctacaatgggatgatgatgatttttaggaaagggctgttcaaggacaggcacctccctcatgggcctcagctactcagtggaataatatgcctggcatatactagacatccataagtctttgctgcattgtatcttcttcaatgaattgaatcagatacttgcagagttaggtaccagcaggtgccggccacatctataagtgtagagaaatactaataacaactggtaaaagagcagtaagtaacaataaagattaaacacctactttacacagaacatttttgacatataaaatccataaagtaaatatgggtggtaatttattactatttctgaaaagggagaaactgaggtaccaaagcaccataaatgctttgtataggtttatgtatatttaaacagtccatgaatcaacctgaggtttgaaattctctttctggactttaataaatagaatggccatttttacaaatgactgatgccaaaataatta

SEQ ID NO: 151585 - DNA, 160 bp, Homo sapiens
ccagagaggagtggaacagccaggaagagctgtggacaggcagcctcaggtcattaagagttgtgaacaagaagaatgcagagaaaggggacaaacataaacctcgacaattagcaatgtttcaaatgcagtttgttgttgtcaaaccccaagcaaaaag

SEQ ID NO: 151586 - DNA, 458 bp, Homo sapiens
gaaagcaagttggcatgtaacagatttggtcattataaacgtattcacttcttcagtgagcatttgccatgtgaaagcctgtagggctacacaaagaacttcaattctagagtaaggtggatgtaagtgaaacaaacccacatataacaactgaaagccagagtgtggaaagtgacatgagatgatcccagaaatgctatcaaagtttaaaggaggacaaatggggagactatgttgaagaacatcagccttctagtcagacagaggtggattgattcctggctcctatacaaatcatacagcctttccaagtctccagttctctgtgcatgtgacctgaagggtagttgtaaggggctgtgcagctgctgcagtgtcttgttagcctgctcctttcctctgttcccagggggccagtgtactccctcttgtccgagacccatggccccattttaact

SEQ ID NO: 151587 - DNA, 357 bp, Homo sapiens
cttactacttgagcgtgaaaggcagaaaggggcaaaaggaacctccccaaatctggaagtcttctggctggcagggctggcatgccttctccaccagctcagggtatgcagggatgcactccatcccgatcacccccttcctgggcccaaggcagggaagcggaacttgcagctgaacccttgcaggaaataagagattcagggtaacagccccagtccgggcacagagatgctgaaaagggaccctctgccaccacttccctggatgatcctggccactccccaaaggtgcccagtctccctgtttgtaaagtgtaattgctaaaaagaggtatcccgagggccactatagcccca

SEQ ID NO: 151588 - DNA, 433 bp, Homo sapiens
cttccctggagatactttgttctgaagaactaagggtgtgtatttagcaccaagggaccccagctgctgatgtgaaggtgaacttggactggatcttgttccttagctcctgtcattttatttcattttgattcctgtggctagtgggaacttctgtcattttagactggttaaaatgcctaaccagagctttattttctgatcttgagtccacatcttgtagcttggttagaactggagtttgctaagcttctgtagcaataattgcatgggtcacctccctcagtgggcagctccactcattccatactgctttacctgtttcagtctgagtgggagatctttcctgaccttgatcccaaattccaggtgcttgttactgtagctctgtcttcagttcagcccttgtgccaagtattggggagtgagctgt

SEQ ID NO: 151589 - DNA, 323 bp, Homo sapiens
gtgttaaataaattatgtttcgggggcagctattttataacgaggaagcaggttttgaaagggataagggcatgaggagcggggtttaaagtataagagaagggggggcaggggtttaaggcaaagagaacaaagaatgaagaggggtaaagggaggaggatctgtgtgtgatgagggcagacggggttcagagaggaaaaccaaggcgggctggtgagttgtgtgtgtgaaaagcctgcgggccctgcacctggacatgaccagtaagcctgggaagctaggagctcgagagcaggccaagaaagggactcgggaggcagca

SEQ ID NO: 151590 - DNA, 332 bp, Homo sapiens
gagacctttctgagaacacaggatctgcaaagaggtgcctgggcttcaggggaacgaggcaagggcttctggtcccagctacccacattgctggcctggggttcctggtgccttcaggattctgggtcactgcagcagagcagcctgctgttgtcagaggtgtttgaaccagagcaactccatcttgaataggggctgggtaaagtgaggctgagacctactgggctgcattttcggacggttaggcattctaagtcataggatgagatgcgaagttggcacaaaatacaggtcataaagaccttgctgattaaacaggttgcagtaaagaa

SEQ ID NO: 151591 - DNA, 553 bp, Homo sapiens
caacgatggtcctcagctgggtgtggtgtcatgcctaagtgggcagatcatgaggtcaggagttcatgatcagcctggcaacatagggaaagcccgtgtccactaaaaatagaaaaattagccggccgtggttgtggtgtgcctgtagttccagttactggggaggctgatgctggagaattgcttgaaccccagaggcagaggttgcagtgagtcaagattgcaccactgcactccagcctaagtgacagagcgtgacttgtctcaaagaaaaaaattaggcgtcatgacagccacctgtaataccagctacttgggaggctgaggcagaagaatcacttgaaccttgggggtggaggttgcagtgagctgaggaccatcgtcaacgatggtcctcagccttccaaagtgcccaggttacagtcatgagccatcatgcttggcctaaccatctttttaagagttatataatattctgttgtatggctgtatcattgttaagttaaccagccctctattaatggacatttatttgtaatctttcactattatt

SEQ ID NO: 151592 - DNA, 134 bp, Homo sapiens
agtgtggggcagcagcatagtcacttcagtgcactgactgcatgacagagtccagccccccttctccccacgttctatctgtggggggcagcagctggaacaaaaccaagacctggatgaagcatagcataact

SEQ ID NO: 151593 - DNA, 215 bp, Homo sapiens
agatggagaaaaaagggaaggtgggtaggtagaaagataagaatggaaaatagaatgacaagtacagagaggaaaatggagatatatgtggaaaagtacagaaggctccaaacagagaggcagaaagaaaaaggaactgaagttccacagggtctgaggtttcttactcttcattcactccctgcagtttattaggtccaaagcaccagcgctta

SEQ ID NO: 151594 - DNA, 252 bp, Homo sapiens
agacgaaggttgccgtgagtcaagatagggcctctacactccagcctgggtgacagagcaagactgtctcaaaaaaacaaacaagcaaacaaaacaaaacctcaaagtccctcctcagggagcctccagtgtggactcaattgtaaaacagcacccagccattgatcaccatctgaaggcagcccacctacttgaccacttattatccaactcccacagtggactgcgagccccatggcgtccaggccagcg

SEQ ID NO: 151595 - DNA, 397 bp, Homo sapiens
tttttttgagataagatctcgctgtgtgcccaggctggagcacaggggtgcaacaacagctctctcgacctcctaggctcaagggatcctcctgccttagcctcccaagtagctgggattataggtgcatgccaccacacctggctaatttttctatttttttttttttttttttttttgtagagacaaggtctcactatgttgcccagattggtctcaaactcctgggctgaagcgatcctctcgcctcagactcccaaagtgctggcattacaggtgtgagccactgcgcccggccctcatctctttcaagatcaggcccatctatgggtcacagctgcaactccagtgcccagcacagagcctggcacataggaggccccataaatattcactg

SEQ ID NO: 151596 - DNA, 272 bp, Homo sapiens
gctcttaccggtgttattgatgcacctgggtatagtgttggacgcctgtagtcccagctacccaggaggcatgggaggattgattgcttgagcccaggaggggcgactgcactccagcctgggaaacagaatgagaccaactggaaaaaaagaaaaaaagaaagaaatgctaagaagaaagtcctatggttgctagtaatatcatcgtgattttaatggatggtgatagtaactaggattatataaaggttctgtgacattagccgataaca

SEQ ID NO: 151597 - DNA, 304 bp, Homo sapiens
ttattgatgagtttcctttcacatttggaggcatcctgttggggaaactgaagaacagatgttaagtgtgaagtgtctccctccttagttcatattcatatcacattgtttgagctgccacatgtaaacaatatagacactaagccaactggtcctctgcctactgctgacgtggcagaaaatatctaggaggtagtcagaggggcatatgtatacctgttaagtggtctggttctccaatagtcatgcaaatattgctaaatttgtttcactcctgggaattcaagcttctatttcagattcc

SEQ ID NO: 151598 - DNA, 557 bp, Homo sapiens
atctaattgtcaaagtacagaaattacatgggacaatgggacagatgaaatgacatcatgaggaagccatcagcaaaatccagacttgggaaaaccctacaggacaaaccacctggtttttccacatcataaaaagaaacagagggaacctgcaaagtacaagagacgtaagagccactttagcctattgcaacctgtggatttagctggatcctgcttcaaagaagcagtaaaaagaaagcacaggctgggtgcaatggctcacgctgtaatcccagcactttgggaggccaaggcgggcagatcacttgaggtcaggaattcaagaccagcctggccaacatggtgaaaccccgtctccactgaaaacacaaaaatcagccaggcgtggtggcaagcacctgtaatcccagctactcaggaggctgagccaggagaatcacttgaccacgtggggcagaggttacagtgagtcgagactgcatcactgcactccagctgtgaaactctgtctcaatcaatccatcaatcactcactaaaacaaagggcggacgat

SEQ ID NO: 151599 - DNA, 275 bp, Homo sapiens
cagcctggtcggaaccaccctttcctgggtccgcctcctgcctggactgtgagccatgtgtggatggggtcaggtctgtggtgctcactgatggttctccagagcccagcacaggttcgggcaccaggaaagggaggtaaatattgatgaatgtgggtccgggcatggtggctcacgcctgtaatcccagcactttgggaggccgaggcgggcagatcacttgaggtcaggagttcaagaccagcctggccaatatagcgaaaccccatctctac

SEQ ID NO: 151600 - DNA, 182 bp, Homo sapiens
ttgtgcggtctttgcgccgggatccctgctgtcccgggattcgggatctgactctccccctgagggagctgcccttcctctctcccctgaactatctactcgcccattttccccccgtcctccgcgaccggaatccggaggcttctcacgcctctccgtcatcgtctcccgtggtcccacct

SEQ ID NO: 151601 - DNA, 519 bp, Homo sapiens
tcagggcctatgcacttcctaattctgcatgcaacactctccagagagctgaagagttcactgtcactaccttcagacgtttactcaaagatcaccattccagtgagagcttccctgaacagcatttctaaaagtataacatcccaactcccaagaccccccagagcattctctatatcgttttcctgcataatttgtctccttatcacttttcaccatctgttataccatatatagtattttactttatatagtatttcactggtataatgaaaactttaaatttctcagtatctccacatcacccagtggggtgttaaatactcactggagtgttaagaaaaagaggccaggcgcactggctcacgcctgtaatcccaacatactcgggaggctgaggcaggaaaatggcatgaacccaggaggcagagcttgcagtgaaccgagatcacgccactgcactccagcctgggcaacagagcgagactctgtcttaaaaaaaaagaaaaagaaaaattc

SEQ ID NO: 151602 - DNA, 811 bp, Homo sapiens
tttaacactttttacttcaaagaaaatcacagtgcaagcaatctgagtggattcatcaaaagttatacatgaatattctgcagagtctggtgttgctgaaagttttgatttgtgttctgctgagacacaaccatgaaaatatgcacttgcttgtattccgaagaggatagttccagtgagacttggacaatgagcagaaaaaatttttttttgagacgaggtgtcgctgtgtcgcccaggctggagtgcagcggcgcgatatctgctcactgcaacctctgcctcctgggttcaagcgattctcatgcctcagcctcccaagtagctgggactacaggtgcccgccaccacacccggctaattttttgtatttttttttttttagtagagacggggtttcgcagtgttagccaggatggtctcgatctcctgacctcgtgatccacccgcctcggccttccaaagtgctgggattacaggtgtgagccattgtgcccagctcagaaaatttaatagtactagatctcgtgtgtgtgtgtgtgtgtgtgtgcgcgcgcttaggttgaaggtggaatttaacattgatttaaaaaaaataatagtaggaaaaaataaatgcggtttgagtccaaagcagcatttttcactaattttatgaaggaagtccttttgagtaatgtcttaaattaggaaaatggcgtacttttacatgttagacattaaactctagggcagataaccatgccctgtgtgttgtgtatcaagcttagcatatacataggaaaagatgtattgtgagagtgtcttacat

SEQ ID NO: 151603 - DNA, 543 bp, Homo sapiens
cttaattatttttcatacttcactacattccagataagcaaacttaccaactgtaaaagaagcaaatttcccacactgatttaaataccttcacctatgatcaagacctgataaatgcatagttcaaatttctgtaagccatacatgtacaaattttgcttctcgaaatgattgttaactccccaaaaggaacattatccattttacatttgatttcattttctcatggcactctgcatagtgcctttaacacattccccttctgaaacaacaaaaaagattaaacttatctgggcaataaacaaggataccaatttatctacatctccttgttaaaacagaattatcaaaaagaaaattaaaacaataatctaagacatagatcccaaattttaagatcagactttaaatgacagtgaaacaactagcaacctcatgacaaagtttatttaaggccaggagcagtggctcacacctgtaatcccaacactttgggaggccgaggttgacagatcacctgaggccaggagtttgagaccagcc

SEQ ID NO: 151604 - DNA, 434 bp, Homo sapiens
tggggcctcctcacagcttctcagcggtggagtaaagcaggtcacgaggatcagagggtcatggggcaggggtcacccgcagccttctgaagggccacatggcagatgtttcaggctttgcaggccctggggtctctcttcaactgctcagctctgaaagcagccacagacgaggtgtcagcgcatggtcgtggatgtgctccaacaggacactgccttcagaggcgggcagcaggcccaccaccccctccaccctctgctttagggcatggcgtggccaggagcacacatctgcgcaccagaccacgtgatgtgcttccagcttgaaacccgggggttgcttcgtgctggtgcttgctgtgtggatcacagtgtggagtgcgttgagatatatagacgaatgagaaatggccctgatggcagagcgtgcggtc

SEQ ID NO: 151605 - DNA, 336 bp, Homo sapiens
cctgtaaggtggggataatggtgatgtctgtcgcattgggctgttgtcagcagcatgagttcgtgcgcctaaaggtctaaagtgcttaagagggtgcccctctttctcaccaatgctgattggcaccggctaattgccagggtacccagcttagactgggtgtggttcctgccgtcaaggagtgcacagtgtgaccaggggacagttgagcgccccaaacccagtggctgcacagtcagtgatgagatgagatctgggagcctggagtggggtcaggccgaggggtgtggggtaacggacacttggcatttccaggctctgtgcggtgcctggagg

SEQ ID NO: 151606 - DNA, 125 bp, Homo sapiens
gattacgactcgagttcggtacctctccacactggcctgggggaggcatgaaggagccctctggggtgctggtcacttgcgttgcacacacacggaaacacagagcttcagatgtgtctcatact

SEQ ID NO: 151607 - DNA, 355 bp, Homo sapiens
atgtcttcccaggcatgacaaaagtagagatctaaatacaaacactcattaccattaaaaacaaaacaaaaaagaatactaataaatttgaaaggtcaacatcatcctgggcaaaaatatatctaacaatacatctgagaaaaaaagtggtaaaatgtggtaaatgttcataatgttcagtttaacactccctttcatctaggctggacagcattttgggtctacattctcgaagcaggagccagacgaaaagcaagtgagtaaataatgtttggggaacattatcattccggataaactggacaagtcctctggccatcaggctctttctcactttcctcagaggccagctgag

SEQ ID NO: 151608 - DNA, 277 bp, Homo sapiens
ggtttctttcccacatcatatctgaggaatcaccagctggtgtttgctgagaattccttattggatacttaaaatgtctttaacccagaactttgcttctgtgaacatttgctgttttccccgaaagcaaatgtttcagagaccaacttttagttttgtaactggctttgtctgtctgaatgtgcaagctatcatctcagttacaggacagtatgttcacataccatcacagggccatttctgaggccagatctcctagggaacatggcaaacacag

SEQ ID NO: 151609 - DNA, 467 bp, Homo sapiens
cgactccagaggatacacagacgacgcagagaacccaatttgtagtcttgcggttttcgggagttaagaaagccgccttttgagacggagtctcgctctgtggcccagtctggaggaaggaagtaatattgtcaccctcacctatagaggacaggttcccgaaggtttcctgcatcacatctctgtagagattcttctgggaaggatccagcaaagcccactcctcctgggtgaagctcacatctacatcctcaaagaccactgagtcctaaaacatctcacacatgtaaaggaggatgggtgagactgacagcactgggggcctagactctattcctaagaagttcccatgatgctgtggactccagacatttattccatgacttggttatcacttggtgtatacccactttcttccataaagcgattctgatgctaaaactgaactaagcaataccaacagcaga

SEQ ID NO: 151610 - DNA, 430 bp, Homo sapiens
atgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggt

SEQ ID NO: 151611 - DNA, 316 bp, Homo sapiens
gggccaagggataaggacttcaccctgaaggcaatggggagccttcaaagggttttaaaccctttgagttaaaatgtactttacaaagatccctggcaccatgagggaaagagggaaggaggaggctggagtcttcctgcaggtgaaagatagctgaggacggacagaaggagacagatgaaagagtctctgagagggcagacaggacgttccaggatgcaggagggcaactaggaaaaggggggagggggaggaaggaggagcacaaggtaccccctgcaactctggccaacccagtcctgcatggaaaggccac

SEQ ID NO: 151612 - DNA, 412 bp, Homo sapiens
attcatttggaagagagatttgattcccaaaagattatcatactcttcaactgtagtgagattatggtgactttgcaccagagtaatgttatgctaaaggcattgcagtagaatgatccactggagattaaaaacctcattctgtatcataaaacaaagacctccatcctcagtgaacacattatctaaattctactccaccaagaatgtatctctagttaagctgtttccttgcccgaaaaagcattatcagctctgcattgtttacatctttaatttcacaccctccatgatttgacaccgcctgtttctgatcatgttcacctctcattgtgcccttcgttgcagttacctggtacagttgctgttttctaaatataccatatattttgtctctctactcctgccacca

SEQ ID NO: 151613 - DNA, 294 bp, Homo sapiens
aacgaatggtcctcagctgacaccatcagaagaaaagttcctcagaagaaagccgctcttgtttttttatagctctggagtctggagaaaactttaaattgccttttaaaaatacctgctgacctttaatcataaaaaagaaaagctgctcaatctcactttaatttttaaattttaatcacaattttaatgcaaataaaaaccatactgagataccagttttcatctctcagatgggtaaaaattcaaaagttagacaatactcactttggaaagtaggaccattgagttcat

SEQ ID NO: 151614 - DNA, 193 bp, Homo sapiens
agttggctgtgactgtgggtggaggctgtcttggaagctgcggatggttgtggggcggtgtgggccacttgttgccactactcaagcagtccctgtgctatccttggcatggtcgtagcctagtagacccaataaagaggaacagagactccccaacagtaagaagagagagggtggccacagtttacgaggt

SEQ ID NO: 151615 - DNA, 177 bp, Homo sapiens
cctcttccaggggggcctggagcagccctccgccccaccgagagccagctgtgcttcccgccgcgcgtcctgaggtcacactcctgccctttgccgaacgcacctgcgcccgcggagcgcggggtgggcttagaagggcccccaaccgcttttcttccgggaaccacgcagcgggac

SEQ ID NO: 151616 - DNA, 235 bp, Homo sapiens
cacctggggtctttgcagacatctggggccaggcaggggagggggctaggaggagaggggctggccacggcaccctgtacatgctcactggtacacacaggtctgcacgggtacacacacaggcagacgaagaagtgcacacgtctcagccccacaggcccacccggtaccagggcctccattccaaggggatgacttgggggtaacgggaggagggagaggtgtcgcagacgcc

SEQ ID NO: 151617 - DNA, 459 bp, Homo sapiens
aacaggagggaagggatagataatggcgggtagtgttctttgaatgatatgtgtacccatttgtgacaacatctcttaaagttgaaggtctacacatgtgtatccatattagcatatgaacttcatcagacaagcactctccctccaacagagggagaccctgtctcaaaaaacaaaaaaaaatagcctttagagtcagacagacctggaatcaaattctagttctgtttcttaatatgtaaatgacctcaggtaagttgcgtaaagtctcaatttagtctcttcatatagagaatggggcaggccgggcacgcgcctataattccagcactttgggaggccgaggtgggtggatcattggaggtcaggagcttgagaccagcctggccaacacggtgaaaccctgtctctactaaaaatacaaaaaaaatgagccgggcgtggtggcatgcacctgta

SEQ ID NO: 151618 - DNA, 490 bp, Homo sapiens
tgatgactggctctcagacccacctaggaaccagtcaggaagtaaaagtcatgtaacatgcgaacaaaacaggggaaatgccaatatctggtatttacttacttgactctgaaagatctcaagccaggttaagcacctcctgggtgataacccatggcgggggagatgggtacacacagatatttcatttttattgttttgggtgtcagtatttttaacttacagattgagttacagaccctggttggtttccttctcggtctactccgcactttcaggacccatttgcattgccacgtgcagtctgctccagtgcctctgatagctgcctcgtcctctctggggtgcacccccacatctgatctgtccaccccctgccatgggcacctgattgcagtcaactcccggccaccacaaacaatgttgacaaggccttcttatcgccctactttgtctctgggctgtgtatctgtggctggagagggcctac

SEQ ID NO: 151619 - DNA, 194 bp, Homo sapiens
tgacaccccacaaagaccacaccttagaaaaatggaccacactgaagaaatataaacaaagctcaaacagacctaacctaagaaaacattataccaggccttgacagaacaaagatgaagagctgataatttaactgcctcttagaacaaaatgtgacatctttcaaaagaagacaattcacagcttctacaac

SEQ ID NO: 151620 - DNA, 437 bp, Homo sapiens
ccacatatgtgatatcatgatagcatgaggtttttattaaatagtttttgtactgaagtcctaatttagcatgtaaaaaacgattaagtttagtggcatatatactacatgaaaataaggtattcacaaatttaggtaatgtcttcctattcttaagttactaaaattttgctcctggactctttttctacactcttccaaaatagtccatccaatactgtattttaaaataccatccatgtgctgatgactaccatatttatatctccgatcctgacttctctcttgtacactgctgtcttgtggacagctccacttggatagctattggtatctgaaactaaaattatctaaaacagaatttttatccctctaaatctgttcctttctaagtctaaatgttactaccttcttctcagccactcaaatcaaatatc

SEQ ID NO: 151621 - DNA, 304 bp, Homo sapiens
tgtttattatgcatgtaatatgtacacatgtagtgtgcatttatatctactagctctgcccactaaaaagactagaaacaatgaccaagccagtagcaatgagtatcactggcactaagcatctagcttgccttaaaatatcatttccccactaaaagaagtcaggagtttttggaaattgactgattccaggtttggggcataaaacatatgagcctaagaaatcttgtcatactacaaagaaaaatagctaccccaaactaggaaggcctgtcaaaagaactaagaagacaacttgaagatg

SEQ ID NO: 151622 - DNA, 252 bp, Homo sapiens
catcttcccttttcctcctctctgggtctttgtccgaagtgccccaatgcttataataacttcctcctgctgttttgcacaaaaaaatccatctggttctttaagcatttctcaagtttgattttctttgggaagctttccttgatcaactctatcaatccttaaacgacctgcacaatttcagccctgggctctccctacagctctccttccatgtccctcagcaggctgacacctggggcatccgcttgc

SEQ ID NO: 151623 - DNA, 184 bp, Homo sapiens
atggttcttgcctctcggtacacctgctttcctgttccttactctacatactggatggaagatggcctcccagggctgcctggtgtccacctccttgaacctcagcctccattctgaagtctgtgaaacaatctgatttgcctgcaatcccagcatttggagaggtcaaggtgggcagatcgct

SEQ ID NO: 151624 - DNA, 460 bp, Homo sapiens
accatcctccactgaaagtacccagggatccttggaggagtggctgctcccaaggccgagactgggaaggacacaaggagcctggaacaggagttaagacagagctcaaaagctgaagggggcgtgtcaaggacacagcagccagcctgaaagggttctcacccaaactgggagtggcttgagcatcaattgagtatgtcaggaatggattctaacacatgcagtcataattttaaaaatcccggagtccacattggtactattactactattaataatgatgatgaaattaaagctagtaaaagggaggatgggcaggaaagagcttctttacaaaagaatgccaactaataaatgtggaaagaatgacaaaaatggtaaatagccattttacggacactctgataagtgtttcactcaagaatcatcaatagatgctaaagctatgaaataaaagatt

SEQ ID NO: 151625 - DNA, 205 bp, Homo sapiens
aatttgagttgtttcgagctgcaacgttggatttgcattgttgtaagcacactttcttgctgtgaccactgacaccaaaattagtttgggcccagggagacttcagttaattggttcatttgaggcttagccctggactcatttgtcaccagccaagataacttgccacatggaatacagccagaccaggggtccccgaccccca

SEQ ID NO: 151626 - DNA, 623 bp, Homo sapiens
gagtggtagcaaaacctttgctaagcctggaattcatctcagtttggaaagctgctttctaatagaaggaacttgctttaatttgcttttgctatgtctatggaaggtcaagtcagcagatggtccctgctttaaggggtaaaccaaacaagagttcgttctagcattttggcagggaaattttcaaggacattgttaaaacacctgcttggtgcttcagtctgaatgcttttggcatcactgggagctttttgaaatatgtattttcacttataacagtaattagttttagtcacatggagatttaaggataagaatattcagttttgtgttgatgggtaatttagcctgtgcatatttttataccccaaaattgttctgcaagcctcatagagaaagtggtttgggtatattcagtgggtggcttagttatttcaacaagttggcaaattctagcatataatttcaaagagttccatttgaaacaaatgtttgatcaattattagcttcttgttttcctgcttgtcttgctaaaacactcaattaaaaattgttcaacagattccttctggcatataatctggggatcatctctcaaatttcttacgctggaattagataa

SEQ ID NO: 151627 - DNA, 254 bp, Homo sapiens
gtagaagcagggagactaggtaggaggctactgcaataattcaagcaaaagatgatagtgacttagaccacaggcagtgatggaggtagtaagtagtggttggagtctgtatatgttttttaaacttgttatttttgaataatttcagatgttaaaaaagtttcaagagtattacagaaaccttctgtgtactttccactcagattcccattattaacattttaacatatttgctttatctctcttactgctct

SEQ ID NO: 151628 - DNA, 251 bp, Homo sapiens
tttcaaactgtattaccttcaagaataagttcaagtgtgttaacctggccttgaagatccttcacaattacatcctccctgaccatatcctcctctcttccctcaaaccttcccaaatcttttcagcataaacttaccatcagttcagataggttagtgccacacacctgcaaataagtcctcccccactgtaaatactctcctttaaggtgggctgaattcctacctcccggaaagttagttaccttgtc

SEQ ID NO: 151629 - DNA, 308 bp, Homo sapiens
ggggtgggggcatccaagaaagattcattattactttaatttcttccctttgctaaggaaatctgagagtaatggctagccactgcacccagaatagggacaagtttttttaaagggaataaaaaagctgtcagggctactaagtgtaaaattagactttcaagctgtgtgttggttagcaggtgtgggtgtgtgactagaaaccagatgtcactctgtccctgtgcatggcctgttggctcaattcagagatgggctcagaataagtttcctttagaaactaagccttgctctatgtcctctttaca

SEQ ID NO: 151630 - DNA, 578 bp, Homo sapiens
ctgaagctctcaccagaagcagatgctggcaccatgtttcttgaacagcctgtggaactgggagccaaataaactgctttataaattactcagcctgaggtattcctttatatcagtgcaaacagactaagacagttttatttggtaaaacttctctgattttaatctcaccaaattagaatttataacaaaacattcataacaattttaatgtttttacctcctactctgtatgtaaacagtttgatgatcaaatgaataccatgaacaagaaggtatattaccttcttattatacctactcaagaaaccaaacattactgggtatatacccaaaggattataaatcatgctgctataaagacacatggacacatatgtttattgtggcactattcacaatagcaaaacttggaaccaacccaaatgtccatcagtgatagactggattaaggaaatgtggcacatatacaccgtggaatactatgcagccataaaaaaggatgagttcatgtcctttgtagggacatcagtgaagctggaaccatcattctgagcaaactatcgcaaggacagaaa

SEQ ID NO: 151631 - DNA, 547 bp, Homo sapiens
tcctgcaactttactaaattcatatattagtcttgggagttttttgtgtgaattccatggtattttctatatagacaattgtctgcaaatagagatagtttactttttcctgaaacatgtgagacttacttatattcttgccttcttgtactgcctaggacctctggtattaggttgaatgggagtgtgttgggagaaacaatccccataagccctgaatatccctgaacattcttgccggatatgctgagaatgcaaagccctaacagaactaccctttactccatccatttctcaggaaggggttgtagctagcaaccttgaggaatgaagtaatgacaccctagacaaatagaatgcaagcagacttgcttttctttgttataaaaatggcaactttcccaagctcagtgctcttcagctgtgaaaaaacccgtagtatacagagcatccacagtccctttgccagggacttggagggcaaggtgaattttcactgatatcatgctcatactgcttgctgcatcatgggtaatacagttctttg

SEQ ID NO: 151632 - DNA, 544 bp, Homo sapiens
cctgaggcatagtctcacagccaggcttccccctcccttgtgagcctgactcccctgcctgcatctcaccgtctcctttttccctgcctgccttcaccccaccaccaagaaggtagtgttttctattgtagggtggcgcccatagggacttttctttcatgtcctggaactgaacgtccctagaaaacagtaagtcatttgcttctgcaagcgtaggtgcccacggagcgctcttcaacacttcggagtgtggtcttctaaagtgggggtggcaaggtttcctcagcccctggagaccctgcctcatacccaggggttttccccacactgctctgggaactgaggggtaagagtccatgccggcctgtcccaccagctgccctcagttatctccttccatcggcagcacacccccgttctcatccacatgcagcccctgctccgatcctcagttcccccgaggagatatcaagttgttggaaggctcacctgtcctcggcccccctggagacccctgcaggactccctggggcctccttgatcc

SEQ ID NO: 151633 - DNA, 431 bp, Homo sapiens
tgtgtgtttaggatgtgtggaaaaagagggaagagaagcagggaaaccttttggggggtctctacgttaattattcttctagaagagaaatgaggatctaaatttaccacagtagcaggggaaaaagaaaggggattcaagactcatttttagctacagaatctgagccaaatttccttttcaatgaatagaggacaatgagacctatgtcacaagtcagtgtaccaatcaagagccactcataggcagatgcccagccggtatctagaccaaacaagagcaacacacaggcagatgcacagccgggtatctaggcctaacaagaagagcaatgcacaagcaggtacccagcggggtgtctagaccaaacaagagtaacctataggcaaacgtccagccaggtgtctagaccaaacaagagcaacctatag

SEQ ID NO: 151634 - DNA, 427 bp, Homo sapiens
atgctgtctcattgtggttttgattggcatttgtctaatcggtgatgttgagcttttttcccctatcacttgtaatatttagactttgctaactttagtcattttataaatagggaacaacttgaaaatagtgaattctgggggtggaggacaggtatttctcaagcaaaaagttctggtcctagccttaagtgtttgaaactgtatagtaatcatcttgtagacttcaggtagttgcatccaattaaattaaactggtacttctgtttccatttgtcaatatgcttgagtcttgtaattgtatgagagttcatccaacccttatcctagaaagtgagacttgtatctcactactgtgtccactgagagaggccgcaccctgtcctgtgtgagaccatttgtagcgtgagacagcatatacggagtc

SEQ ID NO: 151635 - DNA, 347 bp, Homo sapiens
tgctttatgcattttcaataacttttatatgttttcaacaattttaaaaatgattaactgccctaaataagacattgctaggtattcagttgtgttctgttgttttttaaatcataaattaaaataagaataccagaggaaaattggaaactaaaagtataaataataaaacacacacacaacaatctcccataatcattccccactcttaatattttggtcaagtttctttagctctgttttgctatatatattttatttaggtacagttagaaccacagtgtatatccagtttacagcttaagctttaaccttatattttgactgtatttttctatcctcaatgt

SEQ ID NO: 151636 - DNA, 425 bp, Homo sapiens
tcttttaggagcagaatctgaggatggagcaaactctccaatgaaaatggaaaatccccagggagaccggctaccaggcagagaggaggggcagcattcaagatggagagaccactctgcacaaaggcaggggtctactgggcaccgtgtgctaggaaacagtgagaaccccagtgtagctggactcccaggggtgtgggagtggccagagagggtgctttagagttgtgcagggctttgaaagccaaacctggaagtctggacctaatcctaaatgcaagatcggatgagtagcagggtgactacaccacaacaaagccagtacgggaaggagaagaaggaagagagagaggaggagagggggagcgggaaaggaaggagaaagagaaaagaataaaaagctaaaaccaaatacccatactcag

SEQ ID NO: 151637 - DNA, 239 bp, Homo sapiens
tgcagatattggggaagactttttagaagaaaggacatctcaacacaaggctgagaagtagttcaccaaggcaagtaaatgaaaagcacacatcaggctgagcatgtatgaaatccagatgcagacacaaggacctcttaagacctaaggtagtattactgaacaatgagagcctgggtttctttcacctgcttggtgtggtacactcttaaccttctcatctacctctctctccccag

SEQ ID NO: 151638 - DNA, 393 bp, Homo sapiens
ctagatgcaatttagaagaaagagcagagaaaggagaatttcacacaagtgacaataaggactggaatagactttgagatagggcttaggggaaagaacagagaaagaagtaatttatgggggaccataaagcctcaaaacctctcagtgaagaatattctagattcccattagagcagtgacactttgcatccagagctctggatgcaaagtgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaa

SEQ ID NO: 151639 - DNA, 188 bp, Homo sapiens
ggctgccaccccctttgcagatgaggaaactgaggctcagagagagctcccttgtgcaagtgactagccaggcactggcagactgtgaggctcagcctagcctgtgtcccctgaacctggactccctgggctgttgtggggattgctattatttatagttaagactcataacaatccttttttttttt

SEQ ID NO: 151640 - DNA, 302 bp, Homo sapiens
aggtgacagaagaaccaggatatcatcaagatactctaacgatgtctactactcaaataagactatacaatagagatctgagatatccttctctactctcctcccaaagtgctaggattaaaggcctgagccactgcggctggcctaaataatgtttaaaaggaacttcaagaactatttctccattccctgttgcatgattgggaggtgggaggtggaggtgacatttggggaaactggttttttcttctctttacacccactgccattacttttgttggatcctggtctgtgggttctat

SEQ ID NO: 151641 - DNA, 399 bp, Homo sapiens
gtaggaggaggaagaggtccccatatatttgatgtcagaagtactgtgagtagatagatcatactaaggaaaaatgccttttctcctgtaacatactgattggagattaaagctataaaaacacagatacattttacgttaccaagatcacgctttatcctgtaagtttttctgactacaacctataaatcattaaacatagtacatatacacatatatgcttacacaccaattgccacaaaagcttcacaaaccagtatttacgtttatcatgagcaatgtattctgttattttctattctatttcatttttcaaaaaaatggttaacagtccaccagtgattctgtaacacagtgctattagcctgaaaacattctccctggtgtcgggctccatgc

SEQ ID NO: 151642 - DNA, 285 bp, Homo sapiens
agtgaatggaggggcagaacagagggcttgggtgctccacagggatctgcttttgttaagtaatgttaatctcctttgctgtctccccaaccaacaaaatacggtgtgctcaatgtattcttggaacatatagaaaaatgtaaagaaaacaaagcccacccattctcctaacatcacattgatgaaaaccactcctagcattggaatgcatttccttctcgtctttttcccccctcttccaaacaaaattgccaaccctctttctctttatatcctttaaaaaat

SEQ ID NO: 151643 - DNA, 291 bp, Homo sapiens
gataaacctgtgtgtgtgtgggaagctgttctacagaaacattttaaaaatggagtttatatttacctgcatcatattttaattcaaataaaagaaatataagcaccaactatcaaaaataatctctgggtttgcttatccacctgccctgttgttcccaagctcccgaaagccctttcagctttactcaacctgtgcctcagtctggctatgaccacccagtaacacactgtaccctttgctgactgtgagcttcgctatacccagtatcgtattccaagaccctattct

SEQ ID NO: 151644 - DNA, 269 bp, Homo sapiens
gtatttacaaaataaaggcagaagacggaagattaatttgggtccttctgtttataggcaaattgaacacctgcatttgcctcagactcctccaagaattccattaacacatcagcaacaacaacttttaagacactaacccataaaaataaagataataggagttctctaagttccacagcaagcactttggaagttagaaagcagaaaaacagttagttgctgacttagcagttagaaaagtcatgtctaaatcacctgtgaaaaaa

SEQ ID NO: 151645 - DNA, 2288 bp, Homo sapiens
gtcagaactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaaatacattcataaagtctttcctacagtggtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcgtcatctatggtcggggcacactggacgacaagaactctgtgatggcattactgcaggccttggagctcctgctgatcaggaagtacatcccccgaagatctttcttcatttctctgggccatgatgaggagtcatcagggacaggggctcagaggatctcagccctgctacagtcaaggggcgtccagctagccttcattgtggacgaggggggcttcatcttggatgatttcattcctaacttcaagaagcccatcgccttgattgcagtctcagagaagggttccatgaacctcatgctgcaagtaaacatgacttcaggccactcttcagctcctccaaaggagacaagcattggcatccttgcagctgctgtcagccgattggagcagacaccaatgcctatcatatttggaagcgggacagtggtgactgtattgcagcaactggcaaatgagtttcccttccctgtcaatataatcctgagcaacccatggctatttgaaccacttataagcaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacactgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacggtgagtggaacaggtttgagcagcaggtgggagaaaagaaatacacttgatgtgtccttttcctaccccatgctcctggcagtccacagaatcagggggaaagccaggatttggcaaaatgaaatggagacattgtagaacctaacccatctactgtccttattgccagagtctcattgtcaccccctagaatttatggaaattggcccctcttttacaaagatggagataattgggtgattggggagaacctggtggaatcggtacccttgggtgctaatcccagctcttcctctctttgggagagggcttatcctctggaccccgttttctccacttacaaaatggggagactcctcagcattttctgaaatgcagacacatatgaggtcaaaggtggatgcgtgttttgacttctcagaagaaagcactatggaaatccaagatcatccatggagtcaacgagaaaatctcagtccaagcctatgagacccaagtgaaattcatctttgagttgattcagaatgctgacacagaccaggagccagtttctcacctgcacaaactgtgaggtcaaggggcctgctgggttaggcatgcccgaccccgggacaggactaacccaagggggaaagctagtgttgatgaaacttttgatcaaaaccacattgtaaaacattgcccatctgtcttgctcactcttaaactctcccaagaacaaggccggggtaaggtaaagtcagcagaaatctggcttctcccttcctcccgacatctgcatcccttgatccactggcatttgctgccctcttgtcccttatctgtcttatgctggttatttcactgcttcaccttcca

SEQ ID NO: 151646 - DNA, 2149 bp, Homo sapiens
gtcagaactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaaatacattcataaagtctttcctacagtggtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcgtcatctatggtcggggcacactggacgacaagaactctgtgatggcattactgcaggccttggagctcctgctgatcaggaagtacatcccccgaagatctttcttcatttctctgggccatgatgaggagtcatcagggacaggggctcagaggatctcagccctgctacagtcaaggggcgtccagctagccttcattgtggacgaggggggcttcatcttggatgatttcattcctaacttcaagaagcccatcgccttgattgcagtctcagagaagggttccatgaacctcatgctgcaagtaaacatgacttcaggccactcttcagctcctccaaaggagacaagcattggcatccttgcagctgctgtcagccgattggagcagacaccaatgcctatcatatttggaagcgggacagtggtgactgtattgcagcaactggcaaatgagtttcccttccctgtcaatataatcctgagcaacccatggctatttgaaccacttataagcaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacactgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacgcatccatggagtcaacgagaaaatctcagtccaagcctatgagacccaagtgaaattcatctttgagttgattcagaatgctgacacagaccaggagccagtttctcacctgcacaaactgtgaggtcaaggggcctgctgggttaggcatgcccgaccccgggacaggactaacccaagggggaaagctagtgttgatgaaacttttgatcaaaaccacattgtaaaacattgcccatctgtcttgctcactcttaaactctcccaagaacaaggccggggtaaggtaaagtcagcagaaatctggcttctcccttcctcccgacatctgcatcccttgatccactggcatttgctgccctcttgtcccttatctgtcttatgctggttatttcactgcttcaccttccaggcttgacttaacaaatgtagatttgagaaatctcaaccagttgttacctgataggagtctttaatttagggcactcttgctgggatgctttctccagagcttatatatttcttcttactagaactttcttcccccttttattcccctctcttcttggactcatgagctgtctcttcatctctcctctctctcctgcatctctccccttactcttcaatttattctacttctggacctggacttacccaaactgtgatactaccataattgtcaccataatcagtcaaataaagtgatctgtgcatca

SEQ ID NO: 151647 - DNA, 357 bp, Homo sapiens
caaaatgttaagattggtgagattaaaaggattgtgttcttttttgtgcttctctgtatttttcacactgagatgaaaagttaatatttaaaagaggggcaaactttctatgccactatttttatcttttatcatattctcagtacaacttttcccaaaccaacctcatgaaccaaatactctgaatacttactattttctcctggtattgaaagaacttacccttttctatgtggtcatttcctccttcactatcagtttgttctcactgatgtttatgttcacatgtagatcattcattccattctgtaaaccctttccccagccctgcttggcccatccagctgacacctgagc

SEQ ID NO: 151648 - DNA, 604 bp, Homo sapiens
aaagggcattctaggtagatgagaaaagacacagattttgagaggaagctctattcatagttttgtagtcatctgatgtggttagagaataggccaattatggagagtggtaccagataataagctgtggccacgttgtgaaggcccttctaggatatgctagtaagtgatatgataagatctgtgttttaccacccccaaagctggcagaagacaagaaataaccaaaatcagagctgaactgaataaagttgaggtgcaagaaaccatacaaaagatcagtgaaaagagaagttggttatttaatataataaataagattgctagactgctaactagactaatacagaaaaaagaagatccaaataaacacagtcagaaatgacaaaggggacattaccacctaccccacagaaatacaaaaaaccctcagagactattatgaacacctctatgcatgtagggtagaaaacctacaataaatggatatattcctggaaatatacctcctaagattgaactagagaaaaattgaaaccctgaacagagcaataatgaattctgaaattgaatcagtaataaaaaacctaccaaccagaaaaag

SEQ ID NO: 151649 - DNA, 101 bp, Homo sapiens
agggtacacaacagtgtgaaagtacttaatgccactgaatggtacagtttaaaatagttaaaatggtccaggcgcggtggctcacacctgtaatcccagca

SEQ ID NO: 151650 - DNA, 484 bp, Homo sapiens
ccccatctcaactgatttcccactgtttttttttccttcttctttttgagacggagtttcactcttgtcacccaggctggagtgcagtggcgtgattgtggctcactgcaacctccgccttctgggttcaagtgattctcttgcctcagcctcccaagtagctgggatgacaggcgcctgccaccacgcccagctaattttcgtatttactattagtagagacggggtttcaccatgttggccaggctggtctcgaactcctgacctcaggtgatccacctggctcggccccccaaagtgctgggattacaggtgtgagccactgcgcctggccgatttcccactctttaagggtccgaaccttgtgaagagtaattgaaaaataggagtaggatggagacattacaacaaagaaaccatgcagctatactgcctagttcagtgccaggctacataatagttttttcacagactagtaagcaaa

SEQ ID NO: 151651 - DNA, 399 bp, Homo sapiens
cctgggtggagggtggacgggaagcggggggccttctgctgaagatctcaattaaactttggactggctcatccagggaggtggcgcgatttcctctggaggtttaaaataaatagcaggtacttgatttcatctggaatggagggtgtggccctgcctggcactgggatggacccaatggtctccccagccttctttgttctgatactacacaccccacccctcaaccgcctgagaaatttctggaactgcgtttagtctcagtacattaggattattgctagaaataaagcatccctggatcctttggcttcttggacaatatgcaggaaaacacccgccttctcttagacatgtagggttcgcgccgttgacctgagcttcagtgccagagagtcg

SEQ ID NO: 151652 - DNA, 515 bp, Homo sapiens
agcttactaaatctaaggttccacagagggcttttggaccctgtagaaactttaaaacatggcaccaaaattcctgacactcctcttgagaagtagggcctatgtaccctctccttgaatctgggctctgtgtgtggttgactgaaagaatatggtgaaagaagagttgctgtggcagtttctaaaccgaggttttaaaaactggcagtttctactccccatctcctggaatgtttactcttgaagagtaacatttagccatcatgctgtaaaaagaaacctaagcaactcatggtaaactccatggtctttagggaaagagcgtttccacaatgttagggagagccaagaaaaatttaaatagtgtattttccagcttcccgtctctacaccaaaattaagtattgacactcacaagaggaaaaaagttatcctctgtcagccatgtgaatgagccttcttggatatggatcctccagccctcagctgagctgccccagctgatgccatgtggg

SEQ ID NO: 151653 - DNA, 177 bp, Homo sapiens
tcagcatgtttctaaagaaactctcttttgtcatttacacaagtggcctgagtgtcatgctgctgacaagttaagaatgactatagataagttatgcttataatgctgccaccccaaaaatgaggcctctcagcccgtaggcatcagatgtggcctctgtcaacagcaggagcttca

SEQ ID NO: 151654 - DNA, 436 bp, Homo sapiens
gagagagagagagagagagagagagagagagaacgaacctaaaaagaaaaagagccaggtagcatttccattatcaaggtataaaaacagttggatttatggacaatactcagactcccagtgctcacctctgtggggtatcaggaagcactcccaattcacagggacctacagagaggatagcagtgacaccgcacctgcattaacttttacaacagacctgtggtcttaaaggcaggaagggatcaatccctggaaaaagaaaaagtaactgaataaataagccctcgtgcctctctcctcagtcacctggtgatacagttacactcaagttaacatgatttttacatccacagttttcatgctaagcaattgtggtcagagtcagctttcacaccttacccatttagcatctctactacggaatacaactgtg

SEQ ID NO: 151655 - DNA, 473 bp, Homo sapiens
ccttttttatggctgcatagtattccatggtgtatacgtgccacatcttcttaatccagtctatcattgatggacatttgggttggttccaagtctttgctattgtgaatagtgtgtagtattttagatattatttagagagtagatagaaatttattatttcctccagatcagctggttgaaccttgttttcttttcttttttttttttttctttttaggttctacttctaagtgtataccttagattctagggtgtagagactatctcccaagtgcacatgagaagacacgtgcaatgatttttattgctatgtatttgtaagacagacaaattggtttatcagtcagaatgggataggttaagttacaggaacaaacagcccccaaattctatttcttgctcatactgcctgtccattggagtcattaggggctgctgctcgttgtaggcacttgaaaactgagacttgc

SEQ ID NO: 151656 - DNA, 616 bp, Homo sapiens
tcgactctacaggatctccaccgcaatctcatcagaggacttttaaacagcatttccactaggaaaagctgaagccttatgctacaaatttggcatcttttttattcgcaggctgaaattctaaccctcctccttcaccagtatctctaagttaccaagaactcaagatattttttagaagtttgatatcttgaccaagttctcttgaacccccactggataggtgacagaactagggatattccttaatgcccgtatgtagacatattttcagggcagggataagaagtctgctactacatttgtagtctgcaattttatgcaattctaaaagataaaaaaagaaattgaagtcaggagtacaatgtagaaattcctatctacagctgagaatgttaatcatatagaagtgaagttggggacagaatgagcattcactgaatcaagatatgagtagattaagattcagcttggtttattttgtaacaaatgtcttacacagcactggaaatatccatcttaaccacagatgagataggtgcaataaggaagggttcttttagctttctgaatagaaattaagatattatagctgttctagattgcggtgttggta

SEQ ID NO: 151657 - DNA, 257 bp, Homo sapiens
aaaagttccggcaagccctgtggacaggtttgcgaatctggactcagcttctgcaatccagacctcagtttcctcatctctaaaagggggagaatggtacctagagcatggagcagtgaggaagcccaggatgtgacgcacaggagctcgccaaaagtaagcactcttctttctgagcagcctgttttctgcacagacgcctgccttcggtatgtgatggtgcgggagaaacgttacagatttcacggtgagacgct

SEQ ID NO: 151658 - DNA, 449 bp, Homo sapiens
ttaagaagccctgcagaaggagagacatttggtctgggccttaaaggatgaattgaaattctaaacgtccacaaaatagaaaaagcatttcaactgtaagtaaggaccgaacaagaaagaaagagacacaggagtgcaaattttggggtgtgttcagagaatggttaataattcaatgcagccacagactggaggaagcagtaaaagataagatgggaatacgagacacaaagatgtgtcagatctgtgcagttctcttggcatgggccacatgatccatgtcttggcattatcccagtctaaagaatatgtctaacctgaaaatggctattcttctaaatctgtgatttggcttcctggcagaaccccaatatgggtgatgaacaacagtagtctaagaaaatcttgcaatcttttctatacccatgtatccatatatccttatgttg

SEQ ID NO: 151659 - DNA, 160 bp, Homo sapiens
ccaccatgttatggcagtacatccatggaataatgttactccaagaaaatttggcttttggaattcctccacaaagtattggccctagagtagtccttactgcctgattaacttttgcaagtttctcctgaggcaatgatgctagccaagtttctgaaag

SEQ ID NO: 151660 - DNA, 414 bp, Homo sapiens
gggatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttcta

SEQ ID NO: 151661 - DNA, 160 bp, Homo sapiens
aaaaaagagaaataaaaagtattcagattggaaaagaagtaacacgatctgtatttgcagatgacatgatcttgtagagagaaaactcaaatccactaaaaagctcttaggaccaataaacaagctgaacaaagctgtaggatacaaaattaatacacaa

SEQ ID NO: 151662 - DNA, 484 bp, Homo sapiens
ttcttagcccaaccccaggaggggtggatttcatcatcccattccacagataagaccatggaggtttcaagctggaagactgagggtcatacctcaactacatggaggggtcaagttaggggccagagtctgccagaccccgggttcccatattgtatgagtagcaggctgggccaaatccctgtcagctgggggagttctctatggaattgagtgacccagagctctcagcatctgtgccaaaaaaaccaaatgacctcacttttggtggcttttccttctttggggaaggaatgtgctggccactgctgggagctacagcctgctgaggcctgtgtgctctcagacctgcaagggccagaatcagactccagacatgggggaggggttacagcaggatcaaactgtaaccccggaggaccggggaggaggctgttctcacactggcctcccggagcgggtgccactctgcttcgaagaccag

SEQ ID NO: 151663 - DNA, 335 bp, Homo sapiens
agaggatccccccgcatgacgagcttcaggatgctacgttttactatggtaaaatctgtgccaaaaacagtcccccatagtttaccacaactccagtgggcactaccaagatcagctctcaggcttgaccagactggctgcagtagttaagagaagacgcagggactgtctttcgtaagtgtagtgatacatgattgctattaatcaaatggggcatttttttctaactcaagttaaaaatgagaaagagacatattttcattcggaactgtccgaaatgttgacttttctgtgggtccaccctgcttttctccaagctctccttgcttctctcc

SEQ ID NO: 151664 - DNA, 141 bp, Homo sapiens
tctataccataccaccattttgcctttatcaaggatgatgagaaaaaataaaacccatcctacagaggtccccaaatgtggctgaggattcaaaatagcacagggggagcctttcagaatgatgcgataggaccaggcgca

SEQ ID NO: 151665 - DNA, 789 bp, Homo sapiens
ctggctctcgcattcagggatgaagcaagctaatctccaaagtacctgacctacttcctacaggatcttttcagcattcttttcttcccatctggaccttttctcctcttctccttctcctttcttcctcatagattgaggggaggagaaggaaggatgctgggggctgcggtggggggcgtggaacagaaggctgagtccaaatcaatgactctggggcctcagacagttcactaatcggttaacagctaatcatgctcacgggcacatcagtgattaaactgcactttgcattaggctcaacaagtggcacgaggcacacttaggatccaactgctagatcactgctagctgccaaatctgcatgtgcttatgtgtggggagtgcatgcctcactgattcatttgtagctgacatctcactaattacgctgccaccaccagctaggcagagtaaagccttcattctcacccaacaccccaaaggatgtaattctatctaaacaacagagctttaaatgccaatttggcgcctacctgcatgtgctctccttccagaatctcctagaatccaagaaaggagcaaatcatctttgcaattcaatcttggcccctgggtgtgtttttaatgctgaaaaatctttatagagctatctcttcccactcttccctgctcaatagcctaaagagtggttaataacctgtccttttaaaatacaatactggaattaacaattccaaccatcatgaatcacgtgttgggttttttttgttgtttgtttgttttgag

SEQ ID NO: 151666 - DNA, 426 bp, Homo sapiens
tggccgtgtatgcgtgcgtgtgtacgcatgtgtgtgcgtacgtgcacgtgtgtacatgtgtgtgtgcttgtgtgcacaccacatgtgccgtgtccataggtctgtcatcatatcaggtaggactaggtcggctcatagcttggaagggctttggagacagccactctcctaacagatgggagaagttgttttgattcttactaaggtcccagaatcctattgatggctttgctgagtattgaaaggctggccttaaattaggtttgaaactgaatttggtaataggacaggatgtgttaaggaagggaaacatacagggagctgcctgctctggcagctgttgaaagtgagcaggccacggtgcctgcagcggtgtagcacagaagtcgaactctgcaaggaacccacgcgggttccgagctcgaa

SEQ ID NO: 151667 - DNA, 751 bp, Homo sapiens
cacctagatctgacgcccaggctgcctccagaagactctctgcccctggagacttctccccagccagagacaggtgattgtgccatgaaatcactgggtgctaggagggctgcagaccatgttggaggaaacgcctgcttgcctgctgcatcactgattgtttcctgaatatcaagaaagacgatgctgggaatagtccctccttgcccagatctctgaaaagccaggagaaaaaaaatcaacagaactctttcaccaaaaaataatcctccttggaaacaaattcaaacaacagaatgtaagcttcatgggaatcagactttgctgggtcactgctgtattccggtgtctggaagacacttggcatgtgaaatttgttcaacaagcaactttgaatgaatgaatatgtgagtaaatgagaccaaagagaagaggcttcacttggaggaggaggatgtttctgtccatggggcattcgccttgccccaccccttcacccaccttgctctcaaaatatcatcatcaatgagacacatttgagagagctcacagcatcctgtctcctccagaagctcttccccagctgaaatggaagtgaaagactggtagtctcctcctcaaccacccacctcctggggccctgactgtgtggatgaactcctcacacccaggatttgtgtctccagtgaaaagcagcaatttatcctacactgaaaatttcctgaataaaaacctggcctcgttggcctca

SEQ ID NO: 151668 - DNA, 437 bp, Homo sapiens
cacctagatctgacgcccaggctgcctccagaagactctctgcccctggagacttctccccagccagagacaggtgattgtgccatgaaatcactgggtgctaggagggctgcagaccatgttggaggaaacgcctgcttgcctgctgcatcactgattgtttcctgaatatcaagaaagacgatgctgggaatagtccctccttgcccagatctctgaaaagccagagagctcacagcatcctgtctcctccagaagctcttccccagctgaaatggaagtgaaagactggtagtctcctcctcaaccacccacctcctggggccctgactgtgtggatgaactcctcacacccaggatttgtgtctccagtgaaaagcagcaatttatcctacactgaaaatttcctgaataaaaacctggcctcgttggcctca

SEQ ID NO: 151669 - DNA, 337 bp, Homo sapiens
agtactttgacactctcttgagtctcactgctcagtgtgtgacaggtaactaaggcaaaacacacttgtgtgtggccaggtggctagttattatctcaattaggactgactcccttcccagccagaaagtgccataaagatgacacctcctcccctaacaaacctcaaatgtccattatgaatgtgcaaaaacagtccatatttctcaataaactgtgcaatattccaccccagtcccagtcagataacttaatttcacttattctataatagtattatagtagctctcctagataactcttttaaagagtagaatctatacttacttaaaagaatt

SEQ ID NO: 151670 - DNA, 476 bp, Homo sapiens
tgtagaactgaaagctaactcccacatacgagataaaagttcaacatcaggtgatggaaaatcacatattgaggagaaaagtcagtccttgggttctaaatcatttgtctttgttttctgttaaaatggggaaattttctatcttttttcctttcatttagaatagataatttctattcctgatcacctttaaatgcacacactgaggttttgttttcactgactaaaccctagggatatgactaattctcatcataaattttcattcaagaaatttctgagtccatattacatattgaacctaataatagagttcagatttatgatgctcaaaatgtcatgtaagagtattatggtaatgtacaaaatgaaatactgagaatcaccacacttttcaggaagtcccactgtaaggcaaaagattaaaataaaaaaccctcaataaaaggtgtgaaggtctttgccagtttcaggat

SEQ ID NO: 151671 - DNA, 492 bp, Homo sapiens
ctccataaaaggccaagagaacagggtttggaatgtcccgatagctgaacatgtggaggttcctggagggtggagctcccagggagggcatgaaagcttcatgccccttcccccatatgtcaccatgcagctcttcatctgtatcctttataattagccagtaaacaagtgtttccctgagttctgtgagcctaggtactagcaaattaattgaacccaaggaaggagtcatggacaccccaatttatagatgtttggtcagaagcacaggtaaaacaaccttgggcatgcaattggtatgggaaatagggagcagtcttggggcctgagccttcaacttggatctgacgctatctctaggtaaatagtgctggaattaaatgggaagtcccctggctggtgtccgctgcagaactgctggcttgctggtggggaaaaatttccacatatttctactgacaaccactattaacgttttggtctatgtcctcc

SEQ ID NO: 151672 - DNA, 447 bp, Homo sapiens
ctgtgttgcagccttgaggaagattcctttttagggaaacctcggtcttcgcttctaaggccttcatctgatgagatgaggcccatccacgtggtggagttcatctgcttgactcaaagtctactgctttcaacatcagtcacatcttaacactttcacagcaacatctgggctggtgtttggccagacaactgggagcaatagcctagtcaaattgacatgtgaaattaaccattcacactccaatctgtgctggtgaaaaagcttgatctctctctgctgtattaccagagagaacagacccagctgtgaaacagcccaaggacctgcgcttattgatcaaaatctaaaatgagctccttaatatgttaaattgctacaatgtatgtgtggatcgcaggtgaaattcaacattaatttaaaaaagaaatgcatgcctaagtaata

SEQ ID NO: 151673 - DNA, 288 bp, Homo sapiens
agagttgagtggccagagagagaatccattgggtgaggagagggaaggggtgatgttggggcacctcccccaggttggtgccaggtgtacgtaggaagaggctggtgccatttacttagggagggaatgaaggaggaacaacaggcacgaggggtaaagatcctgagttctgcatgttgagattgggtgtccatgagacaaaagtagatggtgaaggagctgttgaatattcaggcctggagcttagaaaaagaagtatgggccaggcatggtggctcaacgcctccg

SEQ ID NO: 151674 - DNA, 495 bp, Homo sapiens
cttgaattttaacagcagcgctaacaaagctctaatcccctccttccccctagccttttcccatcaacccaaagagatttcagaatggataatatatggataaaaggcacttgatgtcagagtgtactttataataaaatatgtgtcttttcattgaagggaccatttggatgttgctgccatacttttcagcggctgaaaaggtatttcctaaacatttttaggttcctttttggccaaattaattagtgtcatagaatgagcatacactttgaaggcagacaaaaatttaagaaaaaattcagatgtctctaagtctttctccactaacctgaaaaacacattttaaaactaccaagctgctgtccccttgataagttggcatttcttgtttgttctctaaattttaaagatgctgagtcattttgctagtacttagtacacttcccaaggataaccaagatgtactttagtttgcttgttagcgcgtgctgt

SEQ ID NO: 151675 - DNA, 405 bp, Homo sapiens
tcagtacctacagtgggggccagaacctgtattatcctttccagggagcaaggaatagattttagggaaaggctttggaatcaacatcctaatcctagtcaccataaaaggattccatttagtttacctttagggtagaattgagagacaggcatagtgacagcaaaggttccattccccaacccttttgttaaattcttgaaatccctttaaggaaacaaagactttcatttcacagatttataactgttggaaggaaaagaccgagtcaaactttcaagtatgagttgggactctttaatctttttttggagggacaagaaaataggcagctgggtgcggtggctcacgcctgtaatcccaacactttgggaggcccaggcgggcgggggagatgacttgagg

SEQ ID NO: 151676 - DNA, 1059 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (60)..(60): n is a, c, g, or t
  misc_feature (978)..(978): n is a, c, g, or t
  misc_feature (980)..(980): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1003)..(1003): n is a, c, g, or t
ccgaattngncntgccggggggtgtattggccggctcctaccctgaaggtgcacctgcantcctcgccgataagaggcagcagttcggaagccggttcctgagagatccggcgcgcgtcttccaccacaatgcctggtaatcaccctgccccctcgcccggcctgtcgctggccgtctgtcccgccgcctcggagcattccgaaaagcccctgaccgccggccacgagtcaagctgccctacccggccacgagtcaagctgccctacccgaggcactctccaaggggagagaaactcctaggccagcgactcaccctgctcgcagccaggacgtgaagcccctaagctgcccgtttgattttctcagggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactcttgtttatgctgtgattttcttccacagctatagaactggtcagacaattcagaatatgatccttctcgagtgttttgcctttgttcacgacctgtgtgntnaaagaaananttcccngtggccnagggaggtggatattataattcatttttgaacttacgacattgttccgaacaatgc

SEQ ID NO: 151677 - DNA, 828 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (60)..(60): n is a, c, g, or t
  misc_feature (747)..(747): n is a, c, g, or t
  misc_feature (749)..(749): n is a, c, g, or t
  misc_feature (757)..(757): n is a, c, g, or t
  misc_feature (759)..(759): n is a, c, g, or t
  misc_feature (765)..(765): n is a, c, g, or t
  misc_feature (772)..(772): n is a, c, g, or t
ccgaattngncntgccggggggtgtattggccggctcctaccctgaaggtgcacctgcantcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactcttgtttatgctgtgattttcttccacagctatagaactggtcagacaattcagaatatgatccttctcgagtgttttgcctttgttcacgacctgtgtgntnaaagaaananttcccngtggccnagggaggtggatattataattcatttttgaacttacgacattgttccgaacaatgc

SEQ ID NO: 151678 - DNA, 157 bp, Homo sapiens
agcatacagactgaggggtaagccagggccgagatccctctccatgccctgggggagccctctctctcagagagcagccaggcttggtgggggagggggataggcacctgtggaggcctataggactagtctccgaggagtggagtccagcagggac

SEQ ID NO: 151679 - DNA, 162 bp, Homo sapiens
gtgagccaccgcaccaagactccagctcttatgtaattactgtttccatgatttgacttacttttttctttcatcctgtatttgtctttgatttacggtgtgttggcccaacacggtgcgttgtgtcccaacacggtgcgttggcccaacacggtgcgttcg

SEQ ID NO: 151680 - DNA, 374 bp, Homo sapiens
attttttaagcctagtccttctctcaacttgtttccactgaaatcattatagaaaattattttgctttgttctacaaggacagaatgtattttaactctgtttaaaagacctagaattctctcctgttacagggagacccacatcaagtaccccaattattgtctgtatgtagacacattctcaaggtgcttactatagaatacagtggaacttttctcatttgatagtttacatcaccattgtaagaaggaagagaaactgggacataggtaatgttttcagtgatatgtatgggcagatattcctgggaagctttggtcagaccttttcatcacaaccacactcatcaaatcagaaatgaaaagggccttag

SEQ ID NO: 151681 - DNA, 442 bp, Homo sapiens
gatttcccggtcagtcctagaataaaaaagttcttggcacccagagttggaggaaggctgcgtgaatagtggtcctccaagtgggttcccttctggcctgtttctgcctgccccacccagcccctcgtacttagcttcatacctagttctgactctaggtggcaaatgaacctcctaagaaggtctaattattctcatcatcatcaccaagcacctgctatttgggtcagcgttaccacatcatcttctggagcaatgtggaggcttatgagaccctgtcttctgccttacaggtggtaagagatatgtgtccaaatataagtaatatttgctaattccagaatgtaagttctagaaagctgatggaagatcacattgggcttgggtgatctggaaaagcctcttgcaagaggaagtacttgaggtgggtcttttttttttt

SEQ ID NO: 151682 - DNA, 564 bp, Homo sapiens
acagaaagaaaattgagtcttggagagggtagagtagcttacccgatgtcacacagctagtaagtggcagacccaggaattaaacttagaaatgtctgactgcaaagcctatgctcctaacatctgctcgatataaagaaacaagtcccttgaaaagttgacagggcggtcaggcatggtggctcacgcctgtaatcccagcactttgggaggccaaggcgggtggatcacgagatcaggagattgagaccatcctggccaacatggtgaaacctcatctctactaaaaatacaaaaattagctgagcatggcagcgcatgcctgtaatcccagctactccagaggctgaagcaggagaattgcttgaacctgggaggtggaggttgcagtaagccgagatcgtgccactgtactccagcctggcgacaaagctagactctatctaaaaaaataaataaataagaaacaagacacaccccacaccctttcctaatactaaggtaggctttgcagcggagagaaaagtagcgatacattccacaccaacagggatctttaccagt

SEQ ID NO: 151683 - DNA, 395 bp, Homo sapiens
gtccagtcctgagtgagtaaaagggatttggaaggagccatttagctggagaaaggaggaaggaatttcttctctcaagcccatgaaagtggtcagcaggaagcttggtgggatgtcaaccctggggatccgatggtctctgatttcctctttctggacctttaacgccatcttgatgtagcagcctggtctccactgggctgtgcaataagctagagcaagggtctgtgtctgggccttggccagggctgtcaaagggaaagcaatgctcaccctctagagtaagcatggggctgacagggaccatgattgaggtccccaggagcaggtcaatgtccgaaggtccagctgcccttcttcatctgggaaatcgtcttccttttcttcctctggtt

SEQ ID NO: 151684 - DNA, 276 bp, Homo sapiens
ggcggaccagacttctgtcacagcattgcctggcgctgtcctggggttgctgaaagatccacatggaacaggattaaaccctcgtgggtgttgtctgtgaaggcagagccaggagcagggcgtagcagtgcggggtggacatggggctgtagggtcagcttcttaggtgctgctttgttgaaccagaggcaggtggacccctgggctgtgcctcactggattgggagcacagaaggagaatgagactgacttttaagaaaatctcacccagaattt

SEQ ID NO: 151685 - DNA, 213 bp, Homo sapiens
ttgaacccgggaggcagaggttgcggtgaaccaagattgtgccactccactccagcatgggtgacagagtgagggtctgtcaaaaaaaaaaaaaaaaacatacacacaattaaatgaaataggagccatcactactgattccacagactactgattccaaggataatacaggaatattatgagcaactcacatccacagagttgataaccttg

SEQ ID NO: 151686 - DNA, 226 bp, Homo sapiens
ctcagattagcatttagtatcagtagctatcctggacactctgagcttagtagcaacattgccagcaattccaggctgtttccagttggagaggatcagggaagcattctcctggaaaagcatgcacagagacttcactttcacataagaaactcacctgacttctcaagaccatcctggctaacactgtgaaaccccatctctactaaaactacaaaaaattagc

SEQ ID NO: 151687 - DNA, 302 bp, Homo sapiens
tttatactacacgtgtatattgatttatctatttgctgtggatacaggctttgcttttagccgcagctctcagagctggctccttgcttcatcttgctgtctttctaaatgaccatcagtgatgtgtacgaccctcccaacggggttctcaaaatgtctcacttcttctccagaaaatggaagctctgttttgctactgcacccaccctgaagattagtaggcccaaggtgggaaatgaaatctttttttttaaacgaccaccaggtgaatctgttgtgcagctgggtttgagaaacattag

SEQ ID NO: 151688 - DNA, 307 bp, Homo sapiens
cccataccttagccatcctatgcccaccgactcactccctagaagagacgtaaaaagcccggtatgtgccacggccacaccagcacagcttggtgaggtgcaaagactcccacatctttagagggaaaccttctcaaaatccatctgtgcatttaccaagctgcagctccaatggacagggctgacagccgcaatcacagccctctccggacacatggccagtgcgcggcacaccggggccgggctcaggtctcttgacgcccctggatctgagtttaagggatgattatcaatataaacaaacatt

SEQ ID NO: 151689 - DNA, 542 bp, Homo sapiens
tggcctgctacaacaaaatacctcagactgggtaatttataaacagcataaactcactttatggtctatgagtaaaaagtagaaccaatgtaacaatacatgcctaacaattttatagcatttactatgtgccgagcattgtgtcctcaattaacagcaagtgtatgacagaatccaggaagtcagattgtagagtccatgttcttaactattaatgcttttcaaaggaaggaaaacacagacttgtatttttccacaccttcaactcctagaatttaaaccgaaggagaggctacaagaaatataaaacattgtgtgcgagcttctctgaaatgaatatgagattgcacatgtgcagaaaagagttaacagagcaggcctaagaatgctatctttagaaatgcctgcttgcaaggttagcccctgaatggcacctaagccgctggattttggaagggttcctaccattcactgatgaacttctctaatggacaatatttcacatgtgtcgtcacaacttgctcctggaggaattaagtgca

SEQ ID NO: 151690 - DNA, 425 bp, Homo sapiens
gggcggcagtccgagccttggaggtttttttcagccctggcccgagagagctgctggccaccaccccgtccaagatagagctgtccgctctccgcctggttgttagaaagttctgatagaaagttccccctttgatgctttttgcctcattgtgacgtccacccatcctctcctctcagaactttctttccttagggatctcaacccgaacggggtgagaatgaatcttactgaagaaatctttctgttcccccttcttggtcttccccagacaaaccgtctcgttgaaagtatcttcacccattcacatcttcagttgaaagactagacaaacaagaaacaaacagactaacaaaacacaacccaggagtcgtccctattctctttgttttactttgttctgttctgttttatttaaagacagg

SEQ ID NO: 151691 - DNA, 395 bp, Homo sapiens
gccaggagagagaggcatgtcaggaaaggtttaggaaaaccccagtgccttgcacagtacttgtgcctggtgagtgctgtggaattaacgaatgagaggcgtcctggagaagctgtttgagctgagtgctgagaaacgagtaggcatccaccaggtggcaaaaggagtcagggcattctaggtacagggagcagctcagacaaggcctggaggcacaacatgacaccatttgctctggggactgcaagtggtggggcagtggagcacggctgagaggggtgcagaaaggggcaggcagggccgggccatgggccagaggagcccgtgtgcaggtagaaggagatgctggcatagctcaggtcttaggttggcccacagcagaagctaactgtagc

SEQ ID NO: 151692 - DNA, 349 bp, Homo sapiens
ataatgacctcattttagcttgattacctctgtgaaaaccctatctccaaataaggtcaccttctgaggttagggggagaattaggactccaacgtatgaatttttgggaggacacaagtcaacccttaacacaactccatgcccttccatcctagaacagttacactgaagccctggcatccccccactgagctggcactgtcatagaccttagctccactgttcatccttgggactgttttcagcatctaagagagtgaggctggagcatcacagtttttcagtgggtgccactgcataatattaatagcaagagtgaacacgtatggatggctgaccttctattac

SEQ ID NO: 151693 - DNA, 445 bp, Homo sapiens
agactggtgtccttaaaagaagagggaaatatggacacagacatagacacagaggaagatgatgtgaagacacacagggaaaacatcatgtaaagacaggcttggagtggtgcacctacaagccaacacagaatcacagcatctcagagttggaaggaattcttcatatgaccacattgattttttttttcctgttggtcggcatcagatttgtgaaggcccctggaagattggatggtgcctgcctatacggagggcggatcttcccctcctcgtccactcagactcacatgcaagtctcctctagaaacacccttgcagacacaccccaaaatgacacttttagagcccctagaagatgccttagagatgaaaaaaaaaacacacgcatttcctaatgaagaggcagccagatgcagcctctgagccctgactgcacagtgtg

SEQ ID NO: 151694 - DNA, 653 bp, Homo sapiens
agactggtgtccttaaaagaagagggaaatatggacacagacatagacacagaggaagatgatgtgaagacacacagggaaaacatcatgtaaagacaggcttggagtggtgcacctacaagccaacacagaatcacagcatctcagagttggaaggaattcttcatatgaccacattgattttttttttcctgttggtcggcatcagatttgtgaaggcccctggaagattggatggtgcctgcctatacggagggcggatcttcccctcctcgtccactcagactcacatgcaagtctcctctagaaacacccttgcagacacaccccaaaatgacacttttagagaagctgtgtgtgctcccgaaactgccatgcaggacctcagtagatgtgtgccatagaaccacaagcaagctcagataaatgactaggaagcaggaagatgcatctgatggcttctctgcatgaagaccaaataaaaggaaccttgtacgtggactctttttaaaaattaaaatttattttgtttcttgcatctaatatagaaataattcatattcattgtggaagatctgtgggaaaaaaaatagaaagaaaaaaagactcacctgtcatctaccaaacaccaataaacacagatcggcctgatg

SEQ ID NO: 151695 - DNA, 751 bp, Homo sapiens
agactggtgtccttaaaagaagagggaaatatggacacagacatagacacagaggaagatgatgtgaagacacacagggaaaacatcatgtaaagacaggcttggagtggtgcacctacaagccaacacagaatcacagcatctcagagttggaaggaattcttcatatgaccacattgattttttttttcctgttggtcggcatcagatttgtgaaggcccctggaagattggatggtgcctgcctatacggagggcggatcttcccctcctcgtccactcagactcacatgcaagtctcctctagaaacacccttgcagacacaccccaaaatgacacttttagaggaacaactgagtttggtggacttgatgaggccatttcctgcactcttaccgatcctcccactatgtgctaattgctttactttctcttaaaactgaagaagctgtgtgtgctcccgaaactgccatgcaggacctcagtagatgtgtgccatagaaccacaagcaagctcagataaatgactaggaagcaggaagatgcatctgatggcttctctgcatgaagaccaaataaaaggaaccttgtacgtggactctttttaaaaattaaaatttattttgtttcttgcatctaatatagaaataattcatattcattgtggaagatctgtgggaaaaaaaatagaaagaaaaaaagactcacctgtcatctaccaaacaccaataaacacagatcggcctgatg

SEQ ID NO: 151696 - DNA, 254 bp, Homo sapiens
agccacctcactgaaggccttcaacggagacatcggatatacctgcccgctaagataggtgggttttccaggacttgaaacgtgggccctgtttgaggacccactgttcgccccgacccaaggatcatcaatcggagccttctccaagcctggctttacctcgctcacagcacaattatattgtcagaagttgccttgcctgagcgcggtggctcatgcctgtaatcccaacactttgggaagccagggcagga

SEQ ID NO: 151697 - DNA, 717 bp, Homo sapiens
aaggtgggaatgctcgtgcaactctcttgtgggaaaagagtcaacatgcttctcttccctttcagattccctctgacctgctgcccctggcctttctcctgccccagtggggctttagcacaactgaccgctgctttcctgtgctctgtggccagggaactcatgtggtgaagcactctggagtttggctttgcaaagaagtgaaatctacaatgcaaatatccagatctccaaaccctggtcaaatggcagtgactgaagctcatgccccacctcccagctgtgcaaccttggggcaagtcacttcacctctctgggcttcaacttcctccttggaaagacagaatgccaacatccatcctgcctcttgccaagatgttttatagactgcatggttttatatcttgtaaaacataaaatactgtgattcagaaagagatcacctttaaaaaagtccaaaatccccccctcttagctagcacgagcaggcatctctccaggtggccttgacctccccaataaccctcctggcaggagtgtggaagaacagaacatgcaggcttctggccactgtccttagagctttccaggacatggggatcccagggcaacctgtggcactgccaacgggccccgtcacaagaggagagagggatctgctatcgcacaccagtctcaaaacccacccacagttcacttgctttatggacagtcctt

SEQ ID NO: 151698 - DNA, 162 bp, Homo sapiens
cagggctgccagcactctctcctgatgactttatcttggctcctggaaggatgggggtgacaacagtgtgtcggcaggagaggagagcctaaagcagggactctggaccctggtgtttcggggggatgtgggctgcaagagtagggtggagggggcgactgc

SEQ ID NO: 151699 - DNA, 460 bp, Homo sapiens
tacagcgtcaggggaacggctctgccggcccccaggtgccctcgcgcatattcatggaggcccgcaggtcagaaccgcagtctcacctgtcttggcggaaatgccctgcgatcctcccggagatagaaggcgggaagttttatgaggagccaggtacagtttccctactatctcctgcagttcatatatctagtctttcttcagactttatttaagcgactgcttcatgtttgatgtctcactcccacatcctacatccattgccaggcaactttctagatagcaccgtgacccatccttcccacccccaagcagccctttcctatttctggtgccagtgtcctccccagtccctctttcttcaggccctcgcttatcaccttcatggacagaaaatacttagttctctctcaacctgcggtttatacctgacacgcgtcagtacctgacaaattcctta

SEQ ID NO: 151700 - DNA, 832 bp, Homo sapiens
ccaagatttattttcctttcacatatgtatatatttataaatgttataagtacaacagaaggcaagaatggagcaaacataagagtgaggaggaggaggaggaggaggagaagaatggtaagtgcaaattaaaatggtagtactaaatccacacactggaaggtggtttttgcaacacataaaactgaaaaagcaattgtatgcagaatacatcaagaattcctacaaacctttaaagaaaatacaagaccttgaaaaaatttgcaaaggatgtgatcaaacaattcacagaagaggaaacaaacatggccacaaagcatatccaaaatccaaaagcaaagcatagtctccccagtaactagggaaatacagattaaaggcacggatttatacccagcagattggtgaaaacttaaaagtctcgtaattccgagtctgagttgggatgtggaaaaacaagccagaagtctcacacaggagtggtgaaaggctacgctggtgcaacttcttcaaaacaattttaacaatttctagtaaagatatgatctttgtatcatatcaaagatgcacattctctttacccggtgatccagcagtcgacttaatgtggaacatagactcttgcatgtgagttcagaggcatatgcataaatgttcttgggggtttccctgtgataattaaaaactggaaataaactaatcttattgccagagagtagattagaatgtaggatctttatacaatggaatactgtgaagaattaacatgaattgctactatgtggccatagattctgcctatagattctttaatgttctatatcatagaaca

SEQ ID NO: 151701 - DNA, 212 bp, Homo sapiens
aacacacagaggtttctgttatggcctaataattacccacatttgtaaaagttttctattttatatataaaaatgtagaatcctttggtcctaagaatttggagaagtctagtgtgaatttccaagaatttcttctcaggcttcatctgtttttgttatttttcagcccagtagggcttttgtgctgctcagatgttaccagtggatgcagg

SEQ ID NO: 151702 - DNA, 194 bp, Homo sapiens
ccacacagctagtaggaggtgacaccatatcacactgaagatcatcctgcccaggcttgcggatttaaacttccatgttttaaagcatctacggattttattaactgtaccttccctgcctgtgggctcaaaagatggccagcagaagaagcatagtttgcctgaagcaaacagaaaatagtaaaagtcaagct

SEQ ID NO: 151703 - DNA, 454 bp, Homo sapiens
tctagaggatcccagttcgacggagtctctccgactgaaggcatagtaagatcacttggattttaatcttaagtgtgatgggaagcccattgtaagtcggagagtgacttggtcagatgaacattttgcaaagcttactgtggctactgtggggagaatagacagactggaggataagactcgaacagggagataggtggaaagaccattgcaatagcgcagtgagagggactttaagcttgcactagagtgacagcagtggagttgtgagaagtcaagatgtgaaaagtgatctactcccattttgaatagatctagctgaatgcaggagatgaggaaaggagaactgtcaagttccatagctagttgctttgagtttcagtattgaaagtgtgagtacccataattaagtcatactcattgggagaggaaagaagagagggtggggtggcta

SEQ ID NO: 151704 - DNA, 330 bp, Homo sapiens
cacaggatgaagacatgaagagaaagtttcaagatcttctgtctgaggaaaatgaatccacaggtctatcccaggttctagcccagccttctactagtcgaaagcggcctcgtgaaggggaagccgagggtgccgagaccacaaagcgcccggctgtgtgtgctgctgtgttgtgaactccgtggtttgaacatgaaagaaatgtaccttctttcactctgtcatctttcttttctttgagtctgtttttttatagtttgtatattaattatggaaataattgctttttcacagtcactgatgtacaattaaaaacctgatggaacctgg

SEQ ID NO: 151705 - DNA, 164 bp, Homo sapiens
gttcagggaggtggggcagagctgatgtgacccggtccctgctctgcctctggcccttagtagctgccaaaggttgtaaaagatcgattgctctcagaaagcaagacacagaggttaagaatctttgcagcagagcctggtgctccatttctgagttcactgct

SEQ ID NO: 151706 - DNA, 374 bp, Homo sapiens
agagaaagtgcagagggatctcacaggtccttctcatggtatactgggttcactgtcttttctccatgaaggctgaaaggattgcaaaactgtcaatcctgaacccattaattacaatcagtgtgccaggcaccatgctagacccttgatagaaacacatactattttggctgggcacgctggctcatgcctgtaatctcagcactttgggaggccatggcaggtggatcatttgaggtcaggagttcaagacaagcctgcccaacatggtgaaaccccatctctactaaaaatacaaaaattagctgggcatcgtggcccatgcctgtaatcccagctactcgggaggctgaggcaggagaattgcttaactg

SEQ ID NO: 151707 - DNA, 626 bp, Homo sapiens
ataaagccaaaaatagtttctcaaggtcatttatctaagtcataagcaataagaaagaatgactacttcaaaaaaagagtctgtctgcttccaagacatgccaggaactcgagaactgagaacctttaatgttttttatgccagctggacgtcttctgttagtgaatttcccattctgtactgggtcatacgaaatgagtttttaaaaactcattaatcagttattaaacaaaacatttttccttagactaatccaaaccacatttgtgatctttttaaaaatcagaaacattaacaaaaactcatttttctaaaaactgacatatttctggagccttgaccaattcattattataattttgagtaactaatagtgattgacatttatgtagtgcttattattgccaggcactgttctaagtgttttttaaaaataaactaatttagtctttgtaacaaccatgtgagggaaaaactatcctccactttacagatgaggaagctgaagaaaaaataagaaatgtactcaaaagttgcacagtcaatgaaggatgaagctaaattcaaacagacattctggctctagggtctgtgttcttaaccactctgcaaactgcctcctaggg

SEQ ID NO: 151708 - DNA, 680 bp, Homo sapiens
ataaagccaaaaatagtttctcaaggtcatttatctaagtcataagcaataagaaagaatgactacttcaaaaaaagagtctgtctgcttccaagacatgccaggaactcgagaactgagaacaataatgtaaagcttgtgtttcagagttgagattagcattatgcttaagattttctttaatgttttttatgccagctggacgtcttctgttagtgaatttcccattctgtactgggtcatacgaaatgagtttttaaaaactcattaatcagttattaaacaaaacatttttccttagactaatccaaaccacatttgtgatctttttaaaaatcagaaacattaacaaaaactcatttttctaaaaactgacatatttctggagccttgaccaattcattattataattttgagtaactaatagtgattgacatttatgtagtgcttattattgccaggcactgttctaagtgttttttaaaaataaactaatttagtctttgtaacaaccatgtgagggaaaaactatcctccactttacagatgaggaagctgaagaaaaaataagaaatgtactcaaaagttgcacagtcaatgaaggatgaagctaaattcaaacagacattctggctctagggtctgtgttcttaaccactctgcaaactgcctcctaggg

SEQ ID NO: 151709 - DNA, 1349 bp, Homo sapiens
ctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcgggggtccgaggggctgcgagctgagatcaacgggcacattgacagcaagctggctgggctggagcagaaactacagggtacccccagcaacaaggaggatgcagcagcaaggaagcctttgacaccgaagcccaagcgggtacagaaggcaagcgacaggttggtgagctcccgaaagaagctgcggaaggaggacggggtcagggccagcgaggccttgctgaaacagctgaaacaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaagaataacctgagtaacccgccgacaccaccctcgtcgctgccccccacccagccccatcggtgcagcagaagatggtgaatggcgtcaccccatctgaagagctgggggagcaccccaaggatgctgcctctgccgggatagtgaaagggcactgagggatacttcagaggtgaagagtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctc

SEQ ID NO: 151710 - DNA, 549 bp, Homo sapiens
acagccatggtcctcgggcagtgatgagcgcggcagtaaattttgtctccatgggtgctaagttaaagttccttctttcctttctgggaagggtcagaagcagtgagcagagagagttggagcataaggacagactggggggatgtggggaggtgagtggggatgcggagcaaaggggagatcatttcttccctgtgtggccccagagaaaagccacattgccatcatggtactgctttgtgacatcagtttcttgtctatgtgactgttttcccactggtgctctgagagcaagactcttagagaggctgtgaggactcatcctgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctc

SEQ ID NO: 151711 - DNA, 354 bp, Homo sapiens
ggcttgagagtgtggggatgtctttgtccactcgctgccgttgcggagacccctgttgcgagtctccatgtgcacgtgctggggcgtgagagcgcgggggtgtcttcagtgtccttcggctgttcagggaggaggctgagctgtcctgccctttcattcagactaaatggctttttcactgttttccaggttctcactttaaccactaatgtgctgggtagttcactctttggaccctaatcattttctcttacctcaacttggactggagttctgctaagcggccgttttggaatgcacaaagatcactgcatcttgcctttcacttaattcttgcggatcacattggaatca

SEQ ID NO: 151712 - DNA, 195 bp, Homo sapiens
gctggagccagggaattccaaggggccagagcctgcctgagcactccaaggcctctgtgctcgtggctggcagcctaggcaggaggaccctggggcagctcagggctctgggatttttcaaagctccatgtggctggacaggcctctacagactccctgccctgggagtctggccagcctgtggagactgtgcag

SEQ ID NO: 151713 - DNA, 440 bp, Homo sapiens
accatatcgcactgatttaaaatatttacttatttgtcttcctcataaagctattaactctctcccaattctaagtgcagagaattcatcttatttgattctacaatcttgccccagcaactacttaagcatttacaacagtcacctttcagagggcctgcccaactactgtagtaggcccccacatccctgtgagggtgaggctctgtagctgttttatttgctataagcctagaccccctgatcacagcacagtctagagggagtttcaggacaatcagtccaaaggctagattggactaggccattcagattctttagggaatatgtaactggctggtggcactagaccaaaccgcccgggtggccactttttaccaaagccagtccttggagaaaagaaaacttgagacttgaagcatgggccaggcgcagtggct

SEQ ID NO: 151714 - DNA, 239 bp, Homo sapiens
agggcctggctgcaaccggtgtcctgggaccaccccaccggatgctcccacccgagcaggccaagatccccagacctggtcttgtgtcctccttccagaatgtggggccaggcctgcaatggagaagcccacccgggtcgtgggcgggttcggagctgcctccggggaggtgccctggcaggtcagcctgaaggaagggtcccggcacttctgcggagcaactgtggtgggggaccgct

SEQ ID NO: 151715 - DNA, 452 bp, Homo sapiens
tctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaagg

SEQ ID NO: 151716 - DNA, 197 bp, Homo sapiens
atagagtttactcagtgctgttatttagcagctgtgtgtatgacttcataatttagggggctgtctgttttgtgttctaagccacgtggctgctgtggtgactgctttagaaactttcagttccctttgctgtgaaacaggtttcagtgcatcgtccctgtgtataaggtcaggtttcttacatggactcactctgt

SEQ ID NO: 151717 - DNA, 475 bp, Homo sapiens
tggatgagtgtctgggagccccccagaaactgcaaacgtgcatttcccaggtgcgtaggtcctcaactttcatggatattttaaaggttaagaaccaaggctcaaaaagcagaactgtttatctataaaaagggttactgagccatatgtggcttatccagagaactttatcaccactgacataagagtgtttctgtggggaaagtctacagtcagaagattccagtcattctatcctagcacttaacacgctctgccattgggttctatttgcttactaagaaagataagaaactttttaaagaatggagatagggttttattcccagggccaaactgtctggcacatggaaggtgttcaataaatatttgtaagatgattaattgttattacaaaccaattttttttttttgagacaggatctcactttgttgcccaggctggagtgcagtggtatgatcatggctcactgca

SEQ ID NO: 151718 - DNA, 474 bp, Homo sapiens
acaccacccagtacacttgtgaccccagatgttgtaagggtttctccccacaaaccaaacaaatctccagaaaacaccatctgaatgtcctctaattcagttcaaaactgggaataatgtcacataccacaggctgagggctcagtcccctaagactgtctccacttcagatgccagttacaagccccagtggtgacctgtgcttttgactgaccagctgtaaatgtgtttttttgcaagtccctcgtcgggttcaattaatttgctagagtagttcacagaactcagggaagcactttacttatttattataaaggatattacaaaggataccgacgaacagcagatggaaaagatgcatagggcaagacatgtgggaaggggctcagagctcccatcccttctccagtgtgccaccctccaggtgcatccatgtgttcagctatttggaatctctccaaaccccgtccttct

SEQ ID NO: 151719 - DNA, 346 bp, Homo sapiens
tataggggcttcaagggacacagaagaggctgcaaaaatacaagtaagattttcttttctgtaagttgaataataggcaaagtcctgttatatcattataaaatatgtacctgcgttttagcctttgtggtttactttccattttctatatcttttacccctacaattgtcaatgggttattctcaaatttgcctatgacagaattctttctgttctcttcaatatattttcccttagctcattttaatcaaaaatggaattttgcatcttggaaaagttcaattcaaagactgtctgtatttggttaacaggtagcatggccaaaaataaataggtttcttcagg

SEQ ID NO: 151720 - DNA, 954 bp, Homo sapiens
agcacttctctctcctgccaccacatgaagaaagacatgtttgcttccccttccgccatgagtgtaagtttcctgaggcctccccagccatgtggaactggacatggtcacccaggctggagcacggtggtgcaatcacagctcactgcagcctcaaacttcaaaggatcctcacatctcagcctgctgagtagggcctctcagcttgtggcatgattcactgaaatacatcaaacatgacagaagatgcaagcatttggagacttacatcagccatcatcaaattaaaaagctaaaaagtgctatcagctggcttgctcatcattgagagacctgaagtgatggatgatggagaggaggttgctgtgagggtagaggtggctcagtaccctgcaggagcaatgcaaagagagactgtgcccaagaccatctccccgggggggatgggtggcattcctgccttccttccaccaacaaatgttgactgtgccatgcactgggatgacagagatgactcagatgtgcccttgttctcaatgtgttcatggttggatgaggagaacaccagtcttactctagagactgaaggctaagacaaagactccagcctcaaacttgaggaaggaagttcatgtttcttcctgggttggccaatagaaagtggtatttgtggccggacatggtggctcacgcttgtaatcccagcactttgggaagccgaggcgggtggatcacgaggtcaagagatcaagaccatcctggccaatatggtgaaaccctgtctctactagagatacaaaaaaattagctgggtgtggtggcatgcacctgtagtcccagctactcaggaggctgaggcaggagaatcgcttgatcctgggaggcggaggctgcagtgagccaaaatcgcaccactgcactccagcccgggtgacagagtgagactccatctca

SEQ ID NO: 151721 - DNA, 211 bp, Homo sapiens
tctgtgtgggaggacactccggctaggggtacatttcatcacttgccagaggaacacagtcaatttcaggaagatacaaggaataacaatgtatttcccccaaatcatcattaaccaatattttggccacacttcctacaaaaacctgaaattagctaaaaccaccctgctgttttcattgcactcaacaagccccagagtagttaccatc

SEQ ID NO: 151722 - DNA, 354 bp, Homo sapiens
agacagccaatacaaaattaataaaagttttgaaaagctaatattgaaaacataaaagcataatactaaaactaccttttcagctactaatctgtgacagtaacatcttagttcattcaccaagcacttttccaaatggtgggaacactggcaatattttcacccaggagatgttactaaataagtatgaggtttgcccaagagaaattatttttaaatatttatttaaaaactatctatgtccttttcttttatgcaatatatgcatttatgcattgattaattcatttctacatgtattagttgtcacaaataccaccaaaagttttaagaagctttaaggtagctacaggt

SEQ ID NO: 151723 - DNA, 233 bp, Homo sapiens
tacataagaattttccaaacatggattttattgctaatgacattatggatatacaggtggaattgagctttgaaccactaagttacaacatgcataccaacagttaagctgaccctcacttgattttaaattattgaaccattttaatgactgtgtcagaagaaatgcaaatgactgctaatttagaaaagctacatttctgtcatctaaaatggttcaataatttaaaatcg

SEQ ID NO: 151724 - DNA, 459 bp, Homo sapiens
  misc_feature (433)..(433): n is a, c, g, or t
tcattatgtattattgattcaatctctaactgttgctattttcgttaaggccgatgtcattgtcaacagcgttcccatgaatcttcagcttggaggaggaccactatctcgggcatttttgcagaaagctggtcccatgctccagaaagagttagatgacagaaggcgggaaaccataggaaaaagtatgtaacatattcatgacaagcggctgcaatctggactgcaaagctgtgctccatgctgtggcttcatactggaataatggagcagagacttcttggcaggtaaggaacgctcttagttctccaacgtattgagaggctttgggaatctccttctggagtggtatagatctgtgctcaagggaagcaatattgccccacagaggacagttcgggttgctacaactgctgctggtaaagatggaaanaaagaacaagagttggggacagtacg

SEQ ID NO: 151725 - DNA, 761 bp, Homo sapiens
  misc_feature (735)..(735): n is a, c, g, or t
caagcctgttgggtggggcgcaactgcagtcccagcgagctgaggatggctgcgccaggcccccttcctgccgctgctttgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatgtccagagacaacaagttcagcaagaaagattgtctttcaatcaggaatgttgtagcttcaatccaaaccaaagaaggtctgaatctcaagttgataagtggagatgttctgtacatctgggccgatgtcattgtcaacagcgttcccatgaatcttcagcttggaggaggaccactatctcgggcatttttgcagaaagctggtcccatgctccagaaagagttagatgacagaaggcgggaaaccataggaaaaagtatgtaacatattcatgacaagcggctgcaatctggactgcaaagctgtgctccatgctgtggcttcatactggaataatggagcagagacttcttggcaggtaaggaacgctcttagttctccaacgtattgagaggctttgggaatctccttctggagtggtatagatctgtgctcaagggaagcaatattgccccacagaggacagttcgggttgctacaactgctgctggtaaagatggaaanaaagaacaagagttggggacagtacg

SEQ ID NO: 151726 - DNA, 280 bp, Homo sapiens
caggtgtgagccaccatgcccggcccctggagtatatttctgatcaatatttacttgattattatttaatattccagacacatcaaaacaacagtactatacaagctttttaaaagaatgctcagatgactttgaaaaaaaatattttcataagagactaaaagtaagactagttttggttatgaatattttgtataagaatatttaaagataaacatactcttcaaggaaccaaacatgctatatgcaaatcatttttagcataatgttatgttgatac

SEQ ID NO: 151727 - DNA, 388 bp, Homo sapiens
gggatcacatattagaggatttcatttatatgaaatacccagaataggcaaatctttagaaacagaaggtagagtggttgttgcctagagggtagggaggatggaagattttgcaagtgatttgctgatgggtacagagtttcttgttggggtgataaaaatattctaaaattgattgtagtgagggttgcacaactctgaatatgctaagagccattgagttgtacactttgtgtgggtgaattgtatgtgaattatatctcattaaagctggaaaaataatcaatggaattgaaaggttaaaggatttgtcattggcctagaaaacagtggggggtggcaaacatacggaagtgataacaaaactgaaatgcatggctgtggagtg

SEQ ID NO: 151728 - DNA, 782 bp, Homo sapiens
gtgaaagaaacgtcaggaatgtggcttggcttggtggttcatgcctgtaatcccagccctttgggaagccgaggtcggaggatcgcttgatcgcttcaagattgcagtgagctatgattgcaccactgcactccagcctaggtgacagtgagactccgtctataattgatttttgtggatatggaatgataattttgttttttttttctaagtctgtataaattggaatttggtgaagttttgagaccgattattttggctttatgctatagattgctaccttcaggtgtaaaagtgtgtagatttttataatgctttttgaccgtaacttctcttcaattgagactgttgtgatccctgtgctttgagaagagaacacagtgcccagattatttatcatttttgaatttgggaattgtgatttcctccaacgtagctgaaaaataggggctatagctaaggtagaaccttggggagaaataggtgatcaagctgactagattagaaatactataggaaagagccaaaatgcttaggaaaaaaaaaacaaaaaaaaaaaaaaaaattgtttgggacggttgggaccttgagaagaagttttttaagaacatttcgttgtggggggcggggccccatgtgtgttatgtgaacactgtgacactagggtggtgcaaaggaaaatctggcacagagatagtggttgggtctttccaccataaaaaaacggcgcgggaacacgacgtttctggaaaactcaagatgggagttcggaggccaacggg

SEQ ID NO: 151729 - DNA, 457 bp, Homo sapiens
ctctgatatgtatgctgtttggggagaggaggagaggagaagcttcgtgtgctgtcatgggaaattaatggtctaacttaaggagtttacagactatcatttttaatcaaacacaggcagcctgccagctaacataaagcaataaagattgcaaaacaaaagaccttctttatctgcttcagcctcatctttacaattacctaaataaaaactagtcctctttacataactttaccacaaaatacatttggaagtgcatatttgtaatttgtctatttggatatcaaaagcaactccaagaagaaacattggatgaaaatctattttagggggcaatggtccaaaggtacacaggagcacaaaacctgaacgatgaactgtgtgaattcctaacaaccctgttcttgatatcctggttctgacagagaactatatgaccttaatttccataaaaaaa

SEQ ID NO: 151730 - DNA, 200 bp, Homo sapiens
tggagggacacaaacatttatcctatagcaactggttggatgtcgtgcaaccatcggattccttgaagcaggtccagaaaggagcacgtgcgactctgcccaaacctaacgggattcctgtctccgtctcatgactttgattctccgcagaacacccagggccaccccagtgaccttctgtccatttctgtttctctcca

SEQ ID NO: 151731 - DNA, 407 bp, Homo sapiens
aggaatgtattcaaaattaaggatgatgtggcaatcagatggaaatagaaagcagaacataaatcctagggaccaggaagggataaaataccacctaatacccacttggactttgcacctgaaggaagagaaattgatgatgactcttggattgctagcagttgttgtatctccttttttacattattattattattattattattattattattatttttggagacggagtcctgctctgtcacccaagctggagtgtagtggtgcaattttggctcactgcagtctgcctccccgggttcaagcgattctctggcctcagcctcccgagtagctgggattataggtatgcgccaccatgtcctgctaatttttgtatttttagtagagatgtgatttcaccatgt

SEQ ID NO: 151732 - DNA, 232 bp, Homo sapiens
gggccatggtaccagtgctggggccttaggctgtcaggctatgccccaagggcttcaggcaagatttcacaggagtctgagtcagaaatcctgtccttccaatgcttccccctggccaggacacagatgccaggatcgggccatcatcttctgctccttctttggggtccctgaaactggtcagggaatcctccattgtgtgagcgtctgtgtctcctgacctaggccctga

SEQ ID NO: 151733 - DNA, 178 bp, Homo sapiens
gacaaaccagcacgcaaagttccaggtttactattaggtcactgcaaacaggcagagataattcaaacgctaagttctgacaaacgccccagtcctctggatatccacctggagaagcattactggtcccgtggggttagccattccttggtaactcacattatggacgctggtgcag

SEQ ID NO: 151734 - DNA, 432 bp, Homo sapiens
ctctagatgaaacatgatgggagcctaaactagaatgatggcaatgaggacaaaaagagagacgtgggtgactgacacatttgttgaattgagtgttaagtgggaagtatgatttggtttgtagtctggtagaagccacagagtattggaattgattgtcatgggggttgcttaagctgcaactcacagccacttgaaactcatctctacaaatagataggtgaaagcaaaaaccatgtttgtgagttccttgagttatgtcctcaagtttctgcctttgttatgggtttttttttgttgtttgtttgttttggagacagggtcttgctctgtcacccaggctggagtacagtggtgcagtccgctcactgcaacctcaatcttgcaggcttaagtgatcctcctgcctcagcctctcgagttgctgggact

SEQ ID NO: 151735 - DNA, 706 bp, Homo sapiens
aaaaggtgtaaagaaagctgcttttatgaaagcagacgtttcccaaaggacttgaccccctccccaagtatttccgcagggatggtgtggctatgcagaggtgagggtgcttccctgaagtgctttggtgagaatttgctcacctggcgaggggtttgcttaccagttcatcttaacctaattaagtttgcattgtctctggaacgccacgtttgggggataaaactcatagaaatactgaaatatagcaatgttgttgaaaacctgtggttatgtaaatatcctcagaactctttgtgctggagtaatatgaaatctcgatggctttgcagcagccttccaacaggtctgcggggtgcgggtgaaggtgacctttccaacatcaaggagaagggccagagaggcgcccggactcacagtggccctttcctggacccttcccaggggcggagggccagagaggcacactccgattatggtccatctttatagtaatgctgggacacaggcattgtcatgccaactccataactgatggccagggagtgtaagtgatgtcaccaaggccagaagccacagagaggcaccaagatcccagcttaggcctgtctgctgccgaagcctatatccctaaccaggatgtgagacccccactcattacataacaaaactaggaaaacttttctgcttatttatgaaaaaaagg

SEQ ID NO: 151736 - DNA, 285 bp, Homo sapiens
gtaatttgctcaaggccccataggcaccaaagctgtttgaaccaaggccattctaattccaaagcccttacattcaacattcttttcagaggagggtatataaaggggtttagaaggagaggtaaagtctaaaagctaccgcagctgcacataatttatttcctaatagtttgctgtccgtggcagaaatgactgccctctggggtgtgaagccaccgctgcagcaatgattgaaatcacctgggaagcttaaacaatcgccctgccctcacccaggccaccccc

SEQ ID NO: 151737 - DNA, 415 bp, Homo sapiens
gtgcattgctagtatgaatataaactggtacaggtgttttagaaaacagtctggcatttcctaaaaatgttaaacatagaggtttttgacccaccagttgtacccctgggggaaaatgaaaacattttcacagaaaaacttttatgtgaatgtttgtggcattatttcataatagccaaaaagttaactatccattaacaaatggataaacagaatggtatatctatacaattgaatatttttcagtgataaataaggttgatacatgctacagtatggatgaaacttgcaaacatccatgaaaggccgtgtattgcgtgattccttttatatgaaatgcccagaataggcaaatctataaagataccaagtagattactgattgctggggagatagggaggattagagtgataa

SEQ ID NO: 151738 - DNA, 305 bp, Homo sapiens
agaggccaaacacgcaatctctgataagtttttatgtttgtctttatcattgtaggaagttacagggggaggggacttgcattcatcatgtactaacatttgaatagtattttgaggttaaaattttctacttggttttttaatttcggttatgtggatcataattagtggatcattggccttcaaattatatttcctatttctttcattcttatgctccattaaaaatgtatgggttgcttttaggtgaacatatctatattgatatagatataggaaagatattgacagattgcggaaataaa

SEQ ID NO: 151739 - DNA, 362 bp, Homo sapiens
gagtttaattagccctggcgcttgattctgaaagaaatggagagcagtgatgaacacaaacaggagagatctgggcagtaacaagcctggcatatggcaccatggatcacccattggccttagggctggactaagtcctaggtgactttacttctaaatgttactcatgtttattctttcaagatgctagataattaagacctgactacccgaaaccaaaaatacgagctgcttttggatgattagtggtgcatgcagagtcattggaaatgtagtgggagtagggaaaacagttctgggtttggattcaaaagactgagcttgaccccagactttccccacaactacctgtatggtcatgg

SEQ ID NO: 151740 - DNA, 236 bp, Homo sapiens
tgagctaagtgtgtcccaagtatggtgaacagctttaggtcaaggaagaaagcaaagaggagagaaagcctatagctgagtgtaaaagtttgaggatttcaggagggaagatgatgatgaatcaggatctgtcagttctgatggaatatactaacagtggctgggtttaaatcctggctccagggccgggcacagtggctcatgcctgtaatcccagcactggaaggctgagatgg

SEQ ID NO: 151741 - DNA, 303 bp, Homo sapiens
catatttttttcaatgaagattgtgctatactggactgctcctagttcatcactctcttcattctcagaaatatttcttcactattttattcagtgaattgagatcagtaagcatgaacttcctggtttttgcctcttgaagcattttgccttctctctcatacttaccttcaatgtgtcacagctttagagtatgacaagcttctatatctgttcaagaccaaccctggaactaaatttcttgcttgttttcccttcacccctctggaactccttagctctcagttcccctcttttcctatc

SEQ ID NO: 151742 - DNA, 572 bp, Homo sapiens
gtcaggacttgactcctacacacacatatgtatgcacatgttcatgtagacacacatgtactttttaacaagaaacaggcccattttcaaccatattgtcaacactcttattgtaagactcttgctttttaggcttaacttcagggttaatcataaagcaattggcttatttgcccccaagcataaacatgtgttactcccatgagaacaaggacattatttcatgcttagaaagcaggcataagtatcagtgttcaaaacagcctaagcgaaaatttaggcttggacaaatgtcaggctaggcctgtggtctatttcactgttagaaagaacttttgatgggtaaaagttaatcactggggctaagcattcctgcactcggattccttcttccagcagtctcaggacttcacaccaaatatgagaaatggagtgattactagcttcctcttttctcctctcacacatcaaagtgggagctggaaccaattgaggccatgtaggaatctggtttatcattgggattgtaaaagatatctggggtcaatactggtttggactggtccgctggg

SEQ ID NO: 151743 - DNA, 433 bp, Homo sapiens
tgcaacaccaaggtaggagagggaggcgtggtcctgattaaaaggtggggcagggcaagaaggaagacacagaagtggaagcacacacagggcgaggcctagggcagtcctgatgagtttctgaaaagaggccagccatcaggctatgccacactctggctacagtgcgactaaaatgatttgtgtaaataaaagagcattttattgggcaaatttatgcacatcagacttcataaagaacactttcagcaaagatcaagtctcatctctatgattatcatactccccctaaaaaactaagcagtacgctttcaaatttgtgttaaacatggccgggcgcagtggctcacgcctgtaatcccagcactctgggagccaaggcagatgggtcacttgaggtcagaagttcaagaccagcctggccaacacagtg

SEQ ID NO: 151744 - DNA, 409 bp, Homo sapiens
aagttgcgaatgtgtgtggccaccggtctgctttcggatggtgagagcaaagttctttactgtctggaaaggtgatctggggaccttttcacaggtcaccagccacctgtgctctgtgatgtgcagctgtgagcacagtagggtcgcagttctaggcagccacaaggcctcatggtgtcctggatacaggatgctttcccagaacccttctggggctccacatctatctccacactttgggtggggaagttgcttcccttgggtggatccaaaaattccagctgacttggagggaagtgagttgagagcccctccagcggtgcttgctcaggtgagtagcttttgctattacatgcccaggcccagctggcctagactggaagctcccagagtccaaaaaacaggggct

SEQ ID NO: 151745 - DNA, 539 bp, Homo sapiens
ttaactgggcacccatccattccttggcttctggaagttctcggatgccttaaattatatgtacaatgtctataatgtaagcacccgagagaggccaacacataatggctagtttatgttgaggtgctggatactcatctccaacagactctgtgtaccaacccacatggcctcctgaggcacagagaaaacgagtctgtgcacaagattgctctactccccttatacagaacaatacttgagttctgagcagccctcctaccccaaagagcagaatcactctatcgtagtgatgttctggtttcccaccttggaatgggaggaatgtaataaaaaacaagcccattctccccatcagagctcctgctgttggatacttcccgccttaacagctgaaaaagaggcaatttctgatgaggaaattggattgggttgaagaagagtcacaaataccttcttatttgctcctgacccactagtgtgtactagggaatgcctggcctcgaccttttctgaggtcaaggctgctacagaggaat

SEQ ID NO: 151746 - DNA, 301 bp, Homo sapiens
gatggaaaagaaggggcacatttgggccaacgaaggggctgggtgtcctgggtaataagtgtggccacactgtagatgatgagcttagcaaacccatcagcagcccccaagaactacagcctagtcaaaggcaatgagtttctgagtgctacactaggcatctacatgcacgctgcctcctcctgagaggtggttaccccaggctgaaaagcaaatgcgccaggtggaatctggaccaactggatgaaataaaagcaccaagaaccaaatcctatcactgtcttatggaacagggttgctg

SEQ ID NO: 151747 - DNA, 612 bp, Homo sapiens
ataatgaacattctgtcattcttaataaggcttccaagacttggagctaaagcagctgtcaacctggaagtaccaatggacactgacaaaacaataaacaaatctccaacaaaagcctgttctctctagccaaaaatccaagacagtcttgagaagactagtaagacagaaaacttttagacaataacagctctactccagccagccacaacaacaataacaaaaaaactgtggctctaccccacccatggcaaaagccaagtggggaagccaagctttccactcatgcctgactgtgacaaggcactcacccttccttccagggtaacgtctgggaaagctgagtaaggaattggtagtttcattctcactgggtggtaaggagtccaccttactgttagcagagtccacatgactttagtagtgttggtagttgtggtggtattattagtagaggccatttagggagccatgacaaggcactcatatccatcgcagtcagtgagttaccagcagacacctcgtgtggagttggaagtcccaaccctagcagttggagacagactccctgctacaacttgagagtcaacagaggccaaataaggaacctgg

SEQ ID NO: 151748 - DNA, 1031 bp, Homo sapiens
tgcaatattacttcttttgctttgtgctggttacaagcaggtcacaagcctgctgaaattcaaggataagattctagaagataaggagccgaaggaaagctttaccttcaacttctgaagatgtgttaaaagtcactgacaagagtcaaattaataacagaaaaggcatacaaatttaattgatcatagttttacataacacaggagccttcagaatgaagatccaaagatacagaggaattgtacattttaatgcttagggtcgacaaaatatggacagccatgtacaaatacgattgggcaaaaagagaatgatctactgccaatagagttgggaaacccagcaaggcctgtctgtctagactcctcttggcctcactgcgcagcattcgttcctccttggtgtgtggcaggaccctctatggaaagagggtgttatgacctacaattaaaaaagacttggagctaaagcagctgtcaacctggaagtaccaatggacactgacaaaacaataaacaaatctccaacaaaagcctgttctctctagccaaaaatccaagacagtcttgagaagactagtaagacagaaaacttttagacaataacagctctactccagccagccacaacaacaataacaaaaaaactgtggctctaccccacccatggcaaaagccaagtggggaagccaagctttccactcatgcctgactgtgacaaggcactcacccttccttccagggtaacgtctgggaaagctgagtaaggaattggtagtttcattctcactgggtggtaaggagtccaccttactgttagcagagtccacatgactttagtagtgttggtagttgtggtggtattattagtagaggccatttagggagccatgacaaggcactcatatccatcgcagtcagtgagttaccagcagacacctcgtgtggagttggaagtcccaaccctagcagttggagacagactccctgctacaacttgagagtcaacagaggccaaataaggaacctgg

SEQ ID NO: 151749 - DNA, 312 bp, Homo sapiens
acagagcagtgggtgggaggtgaacagcacagagaatgtggagaggctgtgagggaaaactcacaattcagggaccccggagtcctgaaaaagaggacacactgcccacctatggaagcagtctaatttcccagtttccatttatcatcttcaaatcaaccacttccattttcagagcttaagctttcgaagaccttcaatatgaatgaaataaatgtggatgttagcaagactcttgcttaaaaagaacaagttctgtgccctgttacaatggattttcctagttctaagtgacccatttgtattcgtcac

SEQ ID NO: 151750 - DNA, 1312 bp, Homo sapiens
ggggaggcgcggggcggtcggctgcggtggcggcgtttggatgattgtctctcggcggcggagtcggatactgtggcgtatgaggacctgtctgaggactatactcagaagaaatggaaaggtctcgcactcagtcagagagccctgcactggaacatgatgctggaaaatgaccgtagcatggcttctttggcaggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaatcct

SEQ ID NO: 151751 - DNA, 244 bp, Homo sapiens
aggagggacggtagatttccatcaaggaaggtgttctgaaagacacctgtgttgtagatttggggtacttttgtcctgatcattgatccctgaagagactgcccatttgacaggaactatcaggtcaatcaagaacatttcctggcaagggaaggtatgcaaaagccatgatttggagctttgactcacaaaaaaacattaaaaagcatctgaggcttcaaaaaagggcaaaatgactccaaat

SEQ ID NO: 151752 - DNA, 460 bp, Homo sapiens
caggtacatctacatgcttatcaaaaacaacagcaaaaccacctaccatgacaaatactattgcagcaaaactgaacaaataaattctgtgccataaagtttcctaaacctcatctattttgtagaaatctagtcacttgagtatcatccttcacaaagttctttctattctttctactgtacaaagttttctgttgtcaaatagcaagagatctctgttttctacttggaatgggcctggagaagggagacagcacccgctccctccaccccttgtccctgagcacagcatggtgacctgccaagccagagggtgacctggacactcataactcaatgcagggccaactgtagcctctggccggtgtccctgagtgagggcaaagttgtaataacacttgttctctcctttctccaatttgctcccaagctccattgctttcgttcaggccctccccct

SEQ ID NO: 151753 - DNA, 392 bp, Homo sapiens
ccactgcctcaacacacctgaggcttggtttcatcacttgcagcaatgatgctgagcgcagagacttccctccaccttttatatatgaagaaacaagacccaggtcacctgatttctgaggctcttctttttgtttgattcttctcacagtccaccctcctactccctcagcttcagaagaagctcaatctcaataggtgatgatggggactgaggagggcagcccaagtggacagactaatgagggtaagggtatggccttggggaggctcagagacctgccctgactcactcagaaccagctaagtctttgggagctgccccaaagggatgagcctcagccacctgccaggttcagggtaatgccctcccccagccatgggtgccccagg

SEQ ID NO: 151754 - DNA, 527 bp, Homo sapiens
ttctgtttgtatggtgaatcacatttgttgatttgcttatttggaaccaatggtgtatcccaggaataaagcccacttgatcgtggtggattatctctcagctgtgtgactagatttgttttgttagtcttttgttgagaatgtttgcatctgtgttcatcaggaagattgacttgtagttttctttttttggttgtctctttgactaattttagaatcaggatgatgctcactttgtagaatgagttagggaggaatccctccttctaaatttttggtaatagtttcagtaggattagtcccagcttttccttgtatgtctgatagaattctgctatgaatccatgtggtgcagggcttttttggttgggtaggtttcttattactgaatcagtttagtacatgttattgatctgttcagggtttcaatttcttcataattaaattttaagaggttgtatgtttccagaattcagctatttcctctagattttctagttggtgctcatggagacgctcatcataat

SEQ ID NO: 151755 - DNA, 374 bp, Homo sapiens
tgcctgaattccccttcctgatcacagtgccactgttccataaggcctgctgacccctcaacaagccctgttccccggagatggaattatggattctttcacctcaaaacacaggccagctcagcggcctgccctgctgccatgttgcccatagaccagcaggttcctgacaaaggacaaaggttgcttttccatgctccccaaaaactgtgaaaaacgaaacaaatacccaggctctttttagaaataaagcagtacaggccagctgcagtggctcacacctgtaatcccaaaactttgggtggccgattatcggactgcttgagcccaggagttcgagaccaacctggacaacatacagagaacccgtctct

SEQ ID NO: 151756 - DNA, 122 bp, Homo sapiens
tgctcggagggctgggacaggagagtcgcttgggtgtgggaggcgcaggttgtagtgagctgagaatgtaccactgcactccagcctgggcgacagagcaagacaccgtttcaaaaaaaaaa

SEQ ID NO: 151757 - DNA, 287 bp, Homo sapiens
cctcaccctaaactcacacacacactctccacaatgtcttttttttaaaaaagagggaaagggagaaagaaagagagaaacagggtctcactctattgcccaggctggagtacagtggcatgatcatagctcgccacagcctgaaactcgtagactcaaacaatcctcctgtctcagcctctggagtaggtgggactacaggtgtgtgtcaccatacctggctataactttttaattttacttagagacagggtcttgctaagctgcccaggatggtcataaactcc

SEQ ID NO: 151758 - DNA, 591 bp, Homo sapiens
cgcatttagatccattgtagtaccggccgcaggtgttatgagtatctagcagaatatcaggctacatctaggagtcgcttgtgttcactgaagaatggcctgcaccagtgcttcatgatgggtgaccgtggggcaggtgaatgtctaatctgtgccacactgttagggataactgatgcagccacagagggctccctgcctatgtctgagctgtaatgatttgcagccaggcacatgtttggggggcaccaactactgaactacaaacgtgcaagtaagtatgatgtgctaggatgcctctccttgaatctgtgctaactagaaggttagactgtcctttaaatgctacatctattaatctagatgaggtcaggtgctacgaattccaagtcaatctaccacactcccctgttttcctgtagggtaagctacactacatttgactgagttacatagggaagaaaatacatattgaagacaacaacaaaattaattctagggaggcaatgtagtgtagtctaaggaaaatggacttctaagaggccttgaggcctgtgttcaaattctagtcccacctcgtatgactttggg

SEQ ID NO: 151759 - DNA, 408 bp, Homo sapiens
ggtgaaggaatcgttctggaagacaggcgggaggggaggggagctggccagctgtgggccctgctcttcttgtttcctgcaagcaggtggtaagtgaacactagggcaaggtgcaggaagagaccatgacatgttcaggttctaagcccatcccactccgtctcactcagactgacttatccccgggcagtggcagggagtcttcgcccatcttgccctgtgggaatcttggaatccagtccatctcccttccctctgtgtcccgtaaaaaagccttagaagaaaagcaggtgagaagtcattaccactctctgcctttgcagcccagggggaatttagcccagactcaattatcaattatcacaacatctttgatgtggcactaagctcttagattgtgctttctcg

SEQ ID NO: 151760 - DNA, 274 bp, Homo sapiens
tgagtcttgggcatcaagtcaaccaggagaaggtttcggagaccatcacccatgtaatggctctgcagtgagcctgctgtgaccccagtggttctcagtcctggctgcacattcaaatcaccttcgaagcttgttagactacagaagcccacctctggagcttccgatttaattagttgaaggtggtacccaggcattgctacttttaaaatatctgcctggtgatcccaatcagttttcaagtttacagaccagctcagaaactgctttggag

SEQ ID NO: 151761 - DNA, 438 bp, Homo sapiens
tgcctctgaggatatttaaatgtggccaggctgggccgaaatacctctgaaggaactgtgcattcgttcataagctttgtagcgtcacaaaactctgaccagtatttttgattgaattctgaatatttctgagcttttgtgtgattccgtggttacggcttccagtgtcattcagtggacgtgttccaggtgtgtgaacacacgcacacacacgctcacacattcacacacgcgtgcacacaacctacacacatgcaaacacctacattcacatgtgcacacacacctacaaacatgcacacctacactcacacatatgcacactcacacacgcacacacacctacagtcacacatgcacacacctacattcacatgtgcgcacacacccacacacctacacacatgcacacacctacactcacacatgcacactcgc

SEQ ID NO: 151762 - DNA, 303 bp, Homo sapiens
ggcgtgggaaactgttgggctaaaaccaggatagttttggcggagaaagtggccaaagggagtgtctccctccgatgccctgtaaacttctgatagcttcttccagttctcccttcaacaaatccagcaatccaacaaatcttaaaaacaatcccatcggccttcgcaggaatttgggctaagagtgattttcctcactaagaactccatacggttttcataccaaggtcaggaagaacaatcctctgccccacccccagcgcctggcagatcgttttcctgcctgctgaccagcatcatctg

SEQ ID NO: 151763 - DNA, 313 bp, Homo sapiens
aattgcagctacttcggaggctgaggtgggaggatcagttgatcccgggaggttgaggctgcagtgagccatgatggtgccactgtactccagcctgggtgacagagcgaggcctgttatactaacatcctttcttagacaaatggaaacataccagaaaaattttttttttttttttttttttagtttttagcttaatatattctggaaacctcttcaacctgtaacataacatggagctctcattttttttcacagcagactggtgctcccttatgtgcatgaagcaatttatctaaccagtgccttgcgg

SEQ ID NO: 151764 - DNA, 804 bp, Homo sapiens
cctccacacataccatgggtgtcggaaggaggacagaaagaagagcagtgactttttctcctccatttcaggcacatggatttcacttaatctctgccacaggccactgagcagctcccagcccctccaatctagcctcccaactcccaacttctcaggactttccttgagcagaattgagtacacccctcccccaagagcctctggggcaccccagagcgggagggataaaggcctacccctccagtccacacctctcccacccgatccatgccagtgctcccccacacatgcccttcgttcctgccagcctgaactgcaggctgcttggctcctccaaccgctgcacaggctcttgccgctgcctggaatgcccactccctcgctatcccattaactcctacaccaaccatcctctccctggggagcctcccctgtcctcccaggctcctgaggaggccgctgcatgcggtggacagaatggacacacctagccaccaccctgacaggcacggccgctctgcctcaggctttccgagcctcagatttcctagttgtacaatgggaggcaggattgctctgaccagtaaacatgaaacagtgtgtgcctggcattagtgatgccaaccagggtcacctttctccctgttccaccctcctactctggacttgaagctccttgaaggcagggagtatggcttctgattcagaggccccagcaacttacacagacttcagcacagaccagatgctccctgtatggtgaacgaacccccatttcacacccaagaaaacccaacaagt

SEQ ID NO: 151765 - DNA, 435 bp, Homo sapiens
agtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctttgttgcccaggctggagtgcagtggtgcgatcttggctcactgcaacctccacctcctgggttcacgccattctcctgcctcagcctcccgag

SEQ ID NO: 151766 - DNA, 661 bp, Homo sapiens
tgtgatcccagctactcgggaggctgaggcaggagaattgcttgaacccaggaggcagaggtggcagtgaaccgagatcacgccattgcactctagcctggacaacaagcgaaactccatcccaaaaaaaaaaaaaaagtaacctgaccaaaaatggttaagtagtaatgttattattgattcattagcctggatggcctattttctaaactccacaaatgggttgggaatataccaagtgttaataatcacatctgagctagtctccatctttggagttcacaaccccagaataccctagataaactgaagcataattctggaagaagttctaagaactctgtcatcactgccgaactacataactacattgttagttatccaatgctacttaatttaaaattggatatttgatctcttaatgaatggctgttgtcacatttacccagaattagaatttctcagagctctctggagaaatattggacccaactaatggatttgaagtttcaggaacccagcctaattctaaactgattacaaataaaatcattagatttgttaagccaagaaaaatgtatgatccagtatgtgattgattctgtgtctgcaaatttatatgcacagcgtatttaggtaaaacattgctcttataccatca

SEQ ID NO: 151767 - DNA, 113 bp, Homo sapiens
aagtctcaggaaggatataaaatgattattatgcaaaaagtctacactgaaaaacatcaatataaaatgaaataaatgaaaaaatgtcatgtgtccttaaaaggagattaaat

SEQ ID NO: 151768 - DNA, 289 bp, Homo sapiens
tttgaccactgaagtcaaggagaggagcttgctctgaattgttacacacattaagaaacttctagatgttttagcactttgtgctcaaaggcgaaacctgcaggatttagaaataagtaaattcggggtgctcttcctcggaggttgttttctggctgcggtttatactgctttctcctccgccattcgattagaccctgggctagtagaatcctttgaaactcacttgtgcctactgtgtgccgatgaatttgggaacctctttttactttgcagaaacttttatttc

SEQ ID NO: 151769 - DNA, 253 bp, Homo sapiens
gttcttgaaaaagatcaaaattaacattataaaggcagaaactgctggtgattatagctcagtaaatgacattgattgaacaaaattgtaggtggaaaacttgcgttcagttttttccttcaccttttctgaaaaatgagcatgttcataagattatggcaagtttagaagacttagttttactgtgctattgagacctctgctataaagcctctacctgcttctcagatgggcaaaaaactcgacatctgta

SEQ ID NO: 151770 - DNA, 304 bp, Homo sapiens
ttgtcctgtgaactttgtcctatggtagtaagtggcacaggtgagattcgaacttggacctgtcagatgctgatccctgtacacagctgcctcgatgctggtcctgacagcctggttccaggagcctgtgctattgctgattacattttatagttagtcaggggacattgtcagctcagtaaccctttgaatacaatactcttcaatagcacagactttctattatattttgcatttgtaaaactaagtgaactgagtctattcctgtataacagaaacgagagagagagagaaaggaataaag

SEQ ID NO: 151771 - DNA, 372 bp, Homo sapiens
tctgaggatccctgtgcgcgggatcctcacacctgcttggagccttcccctcctcgttaacttcaacacagtgaggtctcaccgcaggcctccctgctgtagaaagccttcctaaccgcacaccaggctcgacgctcatctctggctggcatgtgactctgcctcctgcactgggcgtggtaactgtctggctcctcgtctgttccctgcatgaacctcgagttccttgagggcaggaaaccagcccaggacctgcccacagggccacctggtaagggaacaggtcagggaaagcccagcccaggtcctggtggtcctggcacgtcccctctgcctagccatccaggctcgcatcctggcagcccctccccc

SEQ ID NO: 151772 - DNA, 189 bp, Homo sapiens
atagagcacaagaaagagacgtggatgaagtgtgttgataagggtatcagtgtcacaaagaaaggtaagagtggatgaggccgcatatattacagccaactcggaatgtagactgagaagcatgtactgttaaggttagggctcaatttatcaaacctctggtatcatctctttataccttagatcctc

SEQ ID NO: 151773 - DNA, 542 bp, Homo sapiens
agtcgagaccatgccactgaactccagcctgggcaacacagggagactccatctcaaaacaaacaaacaaacaaacaaacacaaacaaaaaaaacaaagccaagccaggcctcagggagatatgttgctggggtgctgtctagccctcccactacatcatactcccaagcagccttacaggatcgtcctgcaggctccaccagactatcaaactgaagccaccaaaagccctctcatgtgacttcatacacagatcacccagcacagttctgatgatataagctgtcacttatctgcaagtgaactgaatgtcaagatcagtggtttgtgatcttgccatctgatgtcagatttagctcacaggagatactcattaaaatcatttaggaagccaaataggatgtacagcaggtcaaaacccccaccacgaggaaggaagggaagacatgacccattttctgcagacttttactttagtttggtattattctttgagagtcttcaaccaggattacaactggcttgaatcctgctcattctag

SEQ ID NO: 151774 - DNA, 326 bp, Homo sapiens
ccatccctcttgtccctctgtccttccagtgctttgacatttggtgggcacagagtagaacaatacaaagtactgaacaataactttggttttcttgccaattttattgcttggcaataaaattgtatacctaaggaaagaacgattttaattttttaactttagaactcaacaagcacttgtttggtattgatactttactttgtaagccttccacaagaaatcaaataatgtctcttgcgctgaaatcgtcaacgggttacacactctgcaaagttatgggaagcacagccctgaccttaaataaatgccaaattgggtggtaa

SEQ ID NO: 151775 - DNA, 145 bp, Homo sapiens
atattcactgtgggcaaagcaacatctctaaagatcatatttcccttttggaaaactgtgttcctttttgagggccataaagagtttggaatctggactgagaacacttgaggaggccacagcagcaggacatcaaggccaatgg

SEQ ID NO: 151776 - DNA, 569 bp, Homo sapiens
aaattcaagcaaggtgggtgtttggaagctgagggaaattgcccacaatggcctctattttcccaatcaagtaggaagctaagttccagcatggaggagactggggagggggacactgagggaggtagatgctgaggacactggaaggagctggcaagacaaagaaccaataagctccagatgaggttggaaattttgagtttgtagtggtgtctacttggatgtgattttcttcggcaatgatcaagctcaacggaaaaggtaaaattttagtactgatccatgctggggttttgctgggaagataagcaggaagaaatggaagggaatctaaaacattagcttaaaatgataatgataaagtaacgaaatcaacaaaaagaaacctggctacaacagttagtatttcttgagatgactacacgtcaggtactatcctatgcattttgcatttatcatctcactcagtcttcacaacaaccctgaccaaataggaccctgcccactgcccctttgatctgctttgggcaccctgtactcacagcacttaggatgctgccctgtcactg

SEQ ID NO: 151777 - DNA, 335 bp, Homo sapiens
tctgccttggcctcccaaaatgttgggattacaagtgtgaaccactacatgctggggttttgctgggaagataagcaggaagaaatggaagggaatctaaaacattagcttaaaatgataatgataaagtaacgaaatcaacaaaaagaaacctggctacaacagttagtatttcttgagatgactacacgtcaggtactatcctatgcattttgcatttatcatctcactcagtcttcacaacaaccctgaccaaataggaccctgcccactgcccctttgatctgctttgggcaccctgtactcacagcacttaggatgctgccctgtcactg

SEQ ID NO: 151778 - DNA, 235 bp, Homo sapiens
aacaaagaaaggaaagaaaacaaaaataggacgggtatagtggctcacaattgtaaacccagcattttggtaggtctaggtgggaggatggcttgaggccaggagttcaggactagcctaggcctaaaaactaaaaaagaaggccaggtgcaggggttcatgcctataatcccaacattttgggaggctgaagcaggaagagtacttgaggccaggagtttgaaaccagcctggg

SEQ ID NO: 151779 - DNA, 450 bp, Homo sapiens
gtactgcttctggctgcctatctctaaccttatttatctaacccatcaggagaatttgtgagttctctaacatttttctgataaactcctgatctgcttaaattacagctcatttatgatactggtaagtaagaatcctgactaacagagtggttgcaaactagggaaaacgtgttagaccaaaacctaaaacatggtacagtagagggatggagtattctgaaaggaccagacactgtgacattctttccttcaggggagatgactcaccctgaggctgtacaaagggcaacccagatggtctcactagcaggtcatagcaggatccatgcctgtgtctttggtatcctctaaaattcagtcatgaatttcagttagcatgtgaaagctcaggcccaagaattttagctcttggagacaaatgtcttcattagaagagtaggagaatca

SEQ ID NO: 151780 - DNA, 357 bp, Homo sapiens
gaccttgccacaaatcccacctgctccctccctatcattacctatatcctccagatatccaagtcaaaagcttgtgtgagtgatgaagaaagagactaggaaccccactcaagaccttcagagagatggccctttctgagagagtctgctagctcttcaaactatagaaagaacatgggctttgacatcaatgctttaggtttgaagtgtaaccatcccataagttaactgcatgctcttgggtgaggaccctcctctgtgaagccaaaatcctacccctcactctggcagttgttgtgaggattaaatgagacagtatatgtaaagcccctgcccctagcaggctccttttccaca

SEQ ID NO: 151781 - DNA, 277 bp, Homo sapiens
ctaagcccagggttctccatgacagcattcccagtatcaaatctgtttcttattaacatgtccctgcagtggagtcgacagtaaagggcctcggagggttctggagaccaaaaaggaggccggatgaaagaggccagtctcatgcatcatcagacattcctgcaaatgtgtaaagaatccacgaggagggagggggagggcaagcattgccagatgtctccaagccaaccctttaacccattcctttacctgcttcccaccttcaagttttgtttct

SEQ ID NO: 151782 - DNA, 496 bp, Homo sapiens
ccaggcaattgagaaggtgaggcaaggaaaatcacttgaacccagaaggcagaggctgcagtgagttaaaagggcaccattgaactccagcctgaaagacaaagcaagactctatctaaaagagaatgtcaaccatatgcctgcagcccaggccactcctcagagtcccttggccattcctccctatcattttcacatggggtttcactggtgccagataagttcacttatcccaaacttaactcttgcctttcttccccaaatcagctcctctctcctgggcctcctgaccttagcaaagacgctgtcacccaaacaactgctgaagcccaaaacctggggagtcattctttacacctccctctccttcaccaccccatccaatccaacaccaagtccatttcaaatccttccccattgctccatttcactgccactagaataatgcatgccccctcatctctcacctcgcacgccccctccatctctcacctgg

SEQ ID NO: 151783 - DNA, 362 bp, Homo sapiens
agtttgtccatggtaaagctttgtgaacacaatctagctactgtttcccccagcaagaccatgcttatgtcctagaaaacctgacagattcagaaatggtcacagattatataacttctaaatgaatcaggtaaaaatggaagggaagaaaactcaaaccaatggaaaacactaaagaaatagaagaaaaaaagttcaaaaaatacaaggtaatatggaagaaataaattcaaatatggtattaatcacaataaacgtcaatgggctacacttgctagttcaaaaacaaagagtctcaatttgcattaaaacatactgctttattctgtttagagaagacatgctgaagacataaggtaacc

SEQ ID NO: 151784 - DNA, 883 bp, Homo sapiens
gagctctcctgtgcaccccaggcctgaatagccaaatgcctacttgatatctcaactggtatgtcctgctccattgatgagccaatgaccttgctatcaactcagaagttgatcctgtcacctcgctcttacctcacctacaaaatgcactcagtcactaaggcctgctaatccaacctcttaaagagatctcaggcctctcagctcacaccgcttctcacagccattaatctggcataggctctttcctgcatccctcggatcacccacctggccctcgagtcctcagtcttgctccctcccagcacacacacattcgttcccacatttgggtcacagtcatctttcttaccccaatccgaccacgtccctccccttcccccttcttttcctcaaaataaagttcaactccttaataccgaccataaggcccccccaatctgactcttgcacccactctggccccaattcacccccgccatctagtcagggtgtggggaagagagatgggctctgggaaggagctcacacccttatcatcccttctaggctgtttctcctcctacgaaaaatcaggatggacatttcaggtcttcccagggctgaaatccagcaggtgcccagaggagtgtttcccaatcctttggccttcaaagaccccttattattatctcccagggtcctcagctttgtctgtaaacaagcagtgtttatgaagttggcattctcagtttaagctgatcagagacacagaaaggccaatgaaagtttctgggctctcaagggacagggtgttcagccctgggaagacctgaaatgtccatcctgatttttcgtaggaggagaaacagcctagaagggatgatacgggtgtgagctcctt

SEQ ID NO: 151785 - DNA, 145 bp, Homo sapiens
tatttcattgtcttcccttgagacagggagagtgggtgttctcccctaacccaagaagaaaccgaagcccagacagtgaaagtgagtggcccaagaccacagtgactcagtgacacagctggaataggactagaacccaggtcct

SEQ ID NO: 151786 - DNA, 444 bp, Homo sapiens
tcacctcttacatcccacctttcagactaggtcaccctagacccagactggcataagtcaaacaaaagtttgccaccccactgaccccccttaccactttgggcaagtctgaatgttagactcctggttaggatgacctggagctgacctggtcaccagttctgatctgatcctgacttcccttccttacacctcagctcatgtcggtgtcacactcatgtctctgttatgaatccaggtggcttatggctgtttatagaactgtgttctataaaacctggaagtttctcaaagattcactcattttattcaacaaataccgaatgcctgactaatatgagtgctataggttctgcaagaaagtgtaaaaatagcaaaatgaagtccctgtcctgtcctcatgaatgacactctagtaggggtggaagtgggagagagtggaca

SEQ ID NO: 151787 - DNA, 350 bp, Homo sapiens
cagttcataatttccatagtgggctcataaaatatttcccatcccatgtgctcttcttacaatctaaccctgacattccatcagggggtgaatctgggcaggcctgtgactatggcagaaatggccctgtgggaatcccaaggctagcttagaaaaaatagcacagcttctgcctggagtgtgctcacactgacacactctggaagccagccctgcaacccagcaaccatgctgtgaggaagcccaagaaggcctacaggagggagacacgcatgcagccaccagcagacctgtgagtgagcgagccttcaggtgactccagccggcagacttcaagccgccttcagtgc

SEQ ID NO: 151788 - DNA, 539 bp, Homo sapiens
tacacgcatctcagctgtaagcctacctaagaagataaaaccgcctatttcaatttaagtttccctgaattccgtcctttccccaatacaattggagcgccggttctgaccctagtaacctcagacacatcagctcaggacagtagtttaaaaaaaaaaaaaacagaaaagaaaagaaaaagaaaaacaacgcatcattgtgagtcagctcaggtgagcaggctgaggttggcttttgcctgattgtccatgacgaagatatacctggctgatgaaacacattcccacctttgccctgagttccagtaaatcagacctcaccggagcggattagtgataaaaatgcatcttgttccgaccgtggggtttgatcctgacaccttcacaccactctccttgcagcttgtcctttttatatatttcctctgctgaggtctcagttcccataaaagaccatgttcagcacacggaactcaaaccctcaaagctctttatctggccaggcgctgtggctcacgcctgtaatcccagccctttgg

SEQ ID NO: 151789 - DNA, 404 bp, Homo sapiens
  misc_feature (286)..(286): n is a, c, g, or t
  misc_feature (399)..(399): n is a, c, g, or t
tgttgagtaggttcagtcagctgggtacccatttccatttcccttaaaggggcagagggcagtcagagggcatggctagctataatgccttccttttgggctttgtggatgaagggcaaaagtgtagatggcagaggggccttatagggggacatgtaaaaatcagggattgggagagtctgaggcctccattcttggcatatcactgctcttccccaaactgggaagactataacgaggagcaggctgggacccaggtggcagggcatggcgatgctcccaagcnctggctgtgcctacccctgcccacaggaaagctgagagaagaatggagagagggaggaaggagccataacttcggtgggagcagatgggtcagataggataaaatatgcagangagag

SEQ ID NO: 151790 - DNA, 388 bp, Homo sapiens
tggcatgggctggaacggctcaggactgactgccactgcgtctccctgtaagcccctccctttctggggagggaagccccccaacaacccacagccagcctcgaagccacgtcgccctggctctggttcccgctaacccttgctggggagtcccccgcacaacctgtcctgctgtttcctgctgtttctggagctagacaagcctcagctggcctcctggctcccggcatgggtgtcaggccctggggagtctccagtccctcctgtgggtactgggctgggctggctctgaagggtcttgaagaacgtggctgtgtgcctccctggcattcgcggtggtggctctggagcttgcgtttggctgagcaggccagcaggtgactcgcgc

SEQ ID NO: 151791 - DNA, 566 bp, Homo sapiens
ctacagctgtgggaatgtggaggggagacactccaggaggaggtggcgcctgggcctgcaatgacgcggacagggtcaaggcacaaagcacacgagaggctgactcagctccaagactgttgagagtggccagtgagggctgtgaaaataggcatgaccatgtgcaaggctgggaaggccacagtccaccaggacagcagtgagaactgaacagccccaaaggcctccatgaagagagaggagccacaaggggccagaatctcccggcaggagctgcggctagctactatgtttttatgttcttcctgcctcagtcttttcaggcaggggtggctgaaccaagaactcactggggtcctctctggctcaggggctcatcaaatcctagccccacacacacagaagcaggctcccaggaaaatgtgtccctggtaactccacagggcagcagggcgagaggtcctgggggctgcagggtctaagaaaggcaaggcagaggcagtgggacagacccctagccccaggggatgcaggagtggcccctcagatgctggccaggtgagact

SEQ ID NO: 151792 - DNA, 783 bp, Homo sapiens
ttctcaggttgaagatcatctcttctttttttcatggtgttaagcataatatggcgtaagtgacattttacaagttccagagcctgggactcaagatgtcttggagattctgtctttgcagtcttataatgatgccctgagatcatcattaaagaaagccagtctggcctactgaggatgagaagctacataaaggagaatgaagattccccagccaacaggcaatatcagtggtcagatatgtgaataaagccatgttgaacctctcggctagacgaccctccagcatatgaaaccagcagatgaatatcccagcctgcctgaagagctgtacaggaaataaggaatcattgttttttaagccactgggttggtgggtggtttgttacattgaaattgttaactaaaacagaaattggtgcatagaggtcaggtgctgtcataataaaaatctaaaacatatactgttggctttggtgatgggagtgattggtagctaaagaggcagtgaaacaatgattagtagatactgggaagttaataaggaaatttctattggagggtggagaaagggccacccttgttatatagtggccaaagaatcagcaaaatgttgcctgctgcaacctggaaagtagaaacttttcttaaactcacggatctggctgggagatttccaggatgcatgcaacaaatgtgaatcaactttgtatagctgtgtataataaagtgtgctgtatttgtccattctgatgctgctaataaagacatacctgagactga

SEQ ID NO: 151793 - DNA, 526 bp, Homo sapiens
gactagaggtcccctcacgcttatacttcagtctcgctgtctctaagtctcagactcatagatccaacaacctgctgaacagacagacatgcacataaacgtatagatgtttcttagacacctcaagtcagtatttccaagactgaactcaccatcttctttccccaccaaatcggcttctcttctcatatcccaaacttagttaatggcttaatgtccagtcacccagaaagccagaatcttgtgagtcattctggactctcttctcccctcaccattgcccccaaagacatcaaaattctgctaaattcgcttccccaagtatcctggtattttctctttcccttctgtgcctgcagcaatgatctcattgggtctctcatggtctttttcctaaacactgcgaggcctctagtcctgctgtccatgaattcttcttccaccccgcagccagtcatccaccttctgtgtacatctgactacactactggaggtgggaaaatgttccatgggctaaccagcagcc

SEQ ID NO: 151794 - DNA, 567 bp, Homo sapiens
  misc_feature (74)..(75): n is a, c, g, or t
  misc_feature (226)..(227): n is a, c, g, or t
ctagggtcaccagacccaaaacatatttctgaaagtctaggagctgaggtggaggtctcgagaaagatctgttnngtgaatgggattaccctcggtgttgcatttgtgcatggatcacctctgtgacaggcgaatcaccctgatgagatgaagaactctaagtggattgagggaggcctttgactcatcccagccccacattggatattggacattgtgttcaaanncatttgaaaatggacaatatttggacatttatggaattacaagggaccaggctggggaatatgaatgcagtgcggaaaatgatgtgtcattcccagatgtgaggaaagtaaaagttgttgtcaactgtaagtgtcatcaccttttatcaaggtaagttctgagaaaagataaaacaccttgaaaaattctgactgaaatttatgttgctgtttttaagaggttgtctattggtaaaaatcacctactaacactgaagacgtgtagatgttgaaatgttggttaaattagtctatgtagcaacaattgtcccaagtaaacccacaatagttcagtctgaag

SEQ ID NO: 151795 - DNA, 288 bp, Homo sapiens
cagaagggattctggagaggtatgctatttgtgtgcctttaggtaagtaattgaacctcattgtaaaaagcagttctatctggctgcctatctcttgagtttgttttgagattaaatgaattcgtggttgaaaatccactctgcaaactgaaagtcctatactatggtatgagacggctatttcctccactcatttgagcaaaggcctatttagtactcactgtgcactggataccaataccgagggactgagtgtgagtcctctctgtcttctccctgtccctctgc

SEQ ID NO: 151796 - DNA, 247 bp, Homo sapiens
tgaaagcaaaggtgctaaggtggcaaaggtaaatactgggagatggagcacaaggaagaagggggagattagtatgacactagtctggtctggagagagacagaaatcttgcacagtttataatggttttttttgttttttgttttttttttgagatagggtctcactctgtcgcccaggctggagtgcagtggcacaatcttggctcactgcagcctcaaccacccaggttcaattgatcctcctg

SEQ ID NO: 151797 - DNA, 786 bp, Homo sapiens
aggaaatattaggtttaacaatttgaaaagatctgtcgtttttgtgagtcaaaaatgattgattatggacaatttcatgtggttcaacctaatcaaacctaccagtagattgtaatacatcacaatatacagcatgttgcaaatatagtttgctcactctgaatagatttgtatatctttttctttttttgttatcaaaaattatttgtaagaaaatatttactggtatcaaataaatctaattttattaggtgtcagaaacacttgatgtggacatttttaatagagattaaagctcaaaagaaacctttaaagtaatgagggggcaatagagtacaaatgacctcaaagcctaacgctgatgaactgagccaacttataatgccctcatcaatctctcagctgatattccaggactcagagattttccacagccatatatccacactgcagatctccccgattcctaggagtctgaaatctcaggaaagatgagagtcaatgtaagtagtaataataataatagcagctaacacttaaacagtatttactgtacccaggcactgttttaagtgttttacatatattaattcatttaatcctcaaagcaatctaattaaataggtaatattaacatcaagaaataggtgaggaaatgcaggcacacaacagttaagcaatttgcacaaaagtgccacagtaagtaagtacctgagccaaaatttaatcccaggcgttctggcacaagagtcagtacttaaccagcagcaaactgcttctcaatat

SEQ ID NO: 151798 - DNA, 761 bp, Homo sapiens
  misc_feature (300)..(300): n is a, c, g, or t
tctttctttcaattttgttctaggtgctgtctctcctgctgttgttgtcctttacacgatggtgttgcaagaaaatggatatggtgttgagaaagacattccaaccttactaatggctgctagcagtatggatgacattctggctctcactggattcaatacatgcttgagcatagtcttctcctcgggtggtatgcttaataacgccatagcctctataaggaacatatgtattagtcggctggcaggaattgttttgggaatttttgttcaatattttccaagtgaagaccagaaaanacttacattgaagagaggattccttgttttgactacgtgtgtttctgctgtcttaggcagccacgtattggtttacatggatctggaggattatgcacactatgtgttgagtttcattgcgaggacaagatggtccgaagaaaagagatgacatctcaccatgttgcccaggctggtatggaactcctgagatcaagtactccaccaagcttaggcttccaaagtgcttagataacaagggggtggtcactgccgcgagccgatggaggcacctacttttgaatatagatccaatgcagccggccactaatgaggagtttccgcagtttgttcgctgtaatggagagcgaacttggagctagtaggagcccttatggttagtaatgtcctagtaaccatgtgactggttagcacgatacgatagtaacgacgaggacgataacaacgttacgcccgggggg

SEQ ID NO: 151799 - DNA, 402 bp, Homo sapiens
ggagccattcccaccgctgcagtaaacattcttataaacatctttacatattggtggaactatttctgtagtacagattcctagaagtggaattgctaggctaaaagatataactatagaaataacatgtttgaaaaactaatcttttcatttatcaaataatacatattttcatttatcaaattgagaaagctttttggttttctggggtttttcttgttgttgttgtttttgttttttttctgggttttcttgggagacagtcttgctctgttgtccaggctggagtgcagtggtatgatcatagctcaccgtagtcttgaattcctgggctcaagcgatcttcccacctcaacctcctgagtagctggggttgtaggcacatgccaccatgcctggcta

SEQ ID NO: 151800 - DNA, 392 bp, Homo sapiens
ggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacc

SEQ ID NO: 151801 - DNA, 803 bp, Homo sapiens
cacagctgcggaaaacctcattaagggaagatataaagttgtaaactaaaatgaaggacagaggcaatgttgctgctcaatgcccagaaactctctccctctacagaagtctgcatctctcccagtccattcctacatgtcagaaagatctgcaggtccatttacacagcctccttattcggaacagggggatttaaatagaggtgcttcagtgggaccacctgggaggatgttgcagagctgcccaggtgccagggtcctgtaacctctcaaattcttccagggatgcaaatcaggctggatggacacagaacatgaagtccttctccagagcacagcacttgtgagtggctgctaggctgggtggtctttgcttcctgtggtttctcacctggcatatgtcaaaggaaggtcccttattctctgatcctcatcctcacaatcttccagagcacaccctggagacctccatccctatttaaaggaggaggccacttcccaggatgcacagtggtgaagtggtgaagggctggtctggtctagtcaccgccttcctgagaatctaggatactagcatgtgagtgctgaaaaaacactctaagatgcttggtctcttgcctcatgcaccccccaccccagcccagttccactgggctcaacacacagggtttgttctattcccgaaggtttgacctgtaaggatgctgggtttacccttcccctcagctaaatgagctctctagagcatacgaaacagtgatctcctgtttagagatctagtgaataaatgccaaagaagtgga

SEQ ID NO: 151802 - DNA, 301 bp, Homo sapiens
ctgaatacacttagccaatatgtgtctgccccctttctcagggctctggtttctgcctgccaggttcaagcctcacctccaggatttttggaaaatcatgtagctgccctggtctcctcatctctaaaatggatataacttacatcacatggctacacttagaagaatggctatagcatgtggggtcagtgctcaaagtggtagctgctttttttttttttctgaaatggagtatggctctgtcgcccaggctagagtgcagtgatatgatcttggctcgctgcaacctctgcctcccagg

SEQ ID NO: 151803 - DNA, 484 bp, Homo sapiens
gagtggtctcttattgggcccataccataggttggttttatggtcatgaaaacttcctggagttttcctttttttcttttaatttgggaggctatctgttgcacattgaggatgcaatttttcattttatcaaattgatcattagagggcttaaggggatattgagctaagggcagctggttcacagaacctgtggcttttgcagttacatcagccaagtaatttaccttctttagtatcagtttttgagtgtcctgggattttcattattgcaaaagacttaagagttttggatagtttttagtaatttaggacatagtagctgttttttatcttttggccagtagcagttagaaaaccactttgtttccagagtgaaccaaaataatgtgccaccccaaaggctcagcagctgtaagtgtagctaagtgcagtcctattaattgacagtataggtgttcagagagagtagcaagttctgcct

SEQ ID NO: 151804 - DNA, 337 bp, Homo sapiens
cgtgcctctggtaggtattattgtccctcagtgtggacaggactcggagaggttagtctgtccaaggtcacaaagctggtaaatacaaagctagggctcaaaccaggagtgactccaaagtcaccttactacctggctattccacctcctaataaataaatcatgagcccaatacattcttatttaatctctggcaggtactaatttttcccccctttttcgtagagataaaattgctacaactggcagccaaccaagaaacaacttcaaattaatcatgtaatcaatcttttttcttttctttcctttttttagacagggtcttgctctgtcaccc

SEQ ID NO: 151805 - DNA, 745 bp, Homo sapiens
agaagtggggtggaggggacagagctgagaggcccaggtggagttgaatcagcaggcttttccagtctctgggagtctgagatgatcttggttctgctgtggacttgcggaatgcgaggacgcagccccctgctggaaagggagctctggctgcccatggagtaacactatcgtgctaggtgtgagggctggttgcagagtgggacttctggccaggcctgggggcagcaaggaaaggaggggacagggagagcagggttgagcaggggaggcctggcagatgagcaggatagggtgcttccgggcagtcgagcttgggttgctggcttcagaggcattgaggccagggcaaagggaatgtgctggcaggatggattccagcctccagcagagcgatagaagatcggggagcagaaggaagagggaagcaagatcaagaaggaggatgtgagcaggttagtggccaaggaggggagcacattctggagaaggcctggtgcttggcactagttttcagcgggactgggctcagaacacataggaggttagcctgagagctcccgagtagcctttgtaattgggaaaggggggcctggcctgaaaggaaacatcacacctagaagcaagtctgtacccttggccccccatagtctgctgctgctgcctgggatagcagtgggagagtcccagcttcccagccaaagccttctgagctttggtcctgcctctgccactactgtctcag

SEQ ID NO: 151806 - DNA, 142 bp, Homo sapiens
taagcatggcaccgcttagcggtgacatgcttcagagggtgccgtgacttggggtgtgccagggcctcttggtccaaggcctggaagacccaagtggggatgacagtgcagttgaatatgtgagttgggatcaggagaggtc

SEQ ID NO: 151807 - DNA, 355 bp, Homo sapiens
atggtgcggaggttggggaaccctgcagcagacgccgagcacaggagaactgggaccgtgttctccgcggtctcccggcgcccagaacagtgcctggcacccgggagtctcggggaatgcaggaagaaggaatgagtaaagaactgcgcgagaacaggacggagcgagggacggactactgactggcggacggacagcgacgcggaccccgaccctgaccccgaccccgaccgtctcagccccgcccccccctccccgccccggcccgacccctcgcctcgcctcgcctcgcctcgatctccacgcgcccgatcccgccccaccgcgcggtcccgaggcgcgagccccgggtcgg

SEQ ID NO: 151808 - DNA, 542 bp, Homo sapiens
gtgatctgcctgcctcagcctcccaaagtgttgggattacaggtgtgagccaccgcgcctggcctggtgtggtattatctgaatgtgagtggtgtgtgtgtgtgtggtatggtatatgtgtgagtgtgtgtgtgtggtgtggtatatgtgtgagtgtatgtgagtggtgtatgtgtgtggtctggtatgtgtgtgtgcatgtgagtggtatgtgggtatgtgtgagggtgtgtgtgtttgagtctgtggtgtagcatatgtggtttttgcaagttaggggagaagggctcaggtacgtgtgtaacccggggaagcaggtgatggagggtgagtgttgtgggagagcaggggcaggctgcttcggtccctggaggagatcttggtgatgtctcctcccccagaggcataccagacagcaaggacagagtggttgcagcgtggataggaaggacgatgagggagcttaagctggctggcttccatgtcctcaaccatgtgggaggtgaggtcacggtgcgagcaaagggacgaagcaggtgggg

SEQ ID NO: 151809 - DNA, 261 bp, Homo sapiens
cctgcttctcctgcagcggtgaccacctgtcaggtgcctaccattgtggaagaggtccaggatggtaaggtcatctcctcccgcgagcaggtccgccagaccacccgctgagcactcagctttcctggccggccccccaggaggcagggaggcagcggtcccatctgccccgcggtctccggcctctccaccctcagccccctgcttcagtcccttccccatgcttccctgcgtgatgacaataaagctcgttgactcagc

SEQ ID NO: 151810 - DNA, 533 bp, Homo sapiens
taacaccttgtgctcgaccttagtgtctgcatccaatctatgccaacacacgtgactgtctctgtgaacctatggagaacataagacactaatacaagtagttcatctaagactgtactttgaactaatcttagataatttatctttcaggaaaatatgtacagaaaaggaactttcaggctcttattaaatgagacaatgaaaatttaattacatgggctataaacttaatctgtcactgaatgtaaacacaggatacatttcaggacaaaatgaacaatttctgttgcttttagaatgtgttgcacattcctgagtactaacaagtggcactctacgaaggcatagactttgaagctggaaaagacaaaaatttgaatcctagattcgtttgccagctagattaccttgggaaaatgatgtgatcgctccaaacttcagtttcctcatcaatactctgtgggattgctggaaagaattagcaaaataaggcttatgatggggaaactgaagtataaagcgttgaggggtac

SEQ ID NO: 151811 - DNA, 520 bp, Homo sapiens
actttccctgacacacttacagtacagtatgataggcagtacagtaggggtctcagagaaacaaagggccccaaggtcccacagacagatagagaaccaaccttgagggataagaaaggttccccacagcctcaatgtacatttgagatagcctggcaaaatatatgtgtatgatatggtagtggaaatgcatgctggtgtgtgtggggggcagaggatttccacacagaggatcaataaaggagagagcatggcatgctcaggaacctgaaacactgtagacagtggcataagttgagcaaaagtcaaaggcagagaggacagtcaaggccaaattacacagggtcatacggagtgcatgtaaggccacaaaacttaacaggcatcttggactctcttggctgccttcttctttccaaaggtaccatcttcttacaccatacttcttagatgttatgatgtgtgtctaaccaataatcagttgtctccttctttcttactgaggcaaccctgatttttt

SEQ ID NO: 151812 - DNA, 331 bp, Homo sapiens
acagcgtcagggaaacggaacacttcagttcctcaaggtagtaagagaaaaagactccttgtatgtaatagccagacattttatcgataaaacttgggagcacaattttaaaaagtcagggttggcctcactggtggaaaaaatataatgcattcattcaagcaaccaaacacaggaggcatttctgtagttatctgagggcacctctcacgtttactgagtccgcttccgggattagatacttcaggctgccagcagaaatcctatcaagtaaaagtgggcaaaatagaaaatggactttaaaattgtcgtccttccctggtgaggcaac

SEQ ID NO: 151813 - DNA, 307 bp, Homo sapiens
gatttaaaaaatacttctgcataaagtaaaaatattttagaaacagatatgcctttattttagaaattactctttaggaaaatactattttcccttaggagttagagtaaataaatggctgttatctcttttaactcttggttatgtttcagtctttaggttgaggaagggcgagggtgattgaataccagaagggggaatgctaactgagatggttttagtagagcaacaggcagctaagtttctgtcaatatgatcaattaccttgggaatcgcttcacagtctagcaactggcacccccacttg

SEQ ID NO: 151814 - DNA, 193 bp, Homo sapiens
agacaggtatgagcctctgctcctctgctccactttgtaaattatcccacctgttactttcttctcctcttgtctttgggccctacgggtgagttactctccacaggcataatttacttcaaaacttagtactccaagtcccttccccaatctcgtttttcctttatctgatatactccctctccagcatctc

SEQ ID NO: 151815 - DNA, 446 bp, Homo sapiens
agcgcctcttcttttccaaggagaatgcatcctacattgatgtaattgaagtccctccctaacttcctctggggctcttcaaaataactgtgcatcctttcagagtgatgtctgcattttctggaatgtcaatagtctgattgccaagaatggtcttcattctctcagtagatacaggaaagaattgaaataattgtttttaaatgtataatttgagcaaagactttagagaatttccttagttggatcagacacagactatgaaattgctttgtcaatgcagttacacctaagtgccagggtatgtcttggcctttaaaggattaaaagcttactcccaaagttgctgggctttggggtataaatatattttattgtttgatgtctgatagtatatttttctttttattttttgaggcaggatctcactttattgtgcaggcggg

SEQ ID NO: 151816 - DNA, 173 bp, Homo sapiens
tgcatgtgtgtgtgaataaatacatcacttgttttcaaataaagagaaacatacattatgtctccatgtcaatgccactcaactgagggcttgcatttcaatattggtagcaatgccttagatttaaaaagatcatgaaataccttattagaacactccttggaaggtgttta

SEQ ID NO: 151817 - DNA, 523 bp, Homo sapiens
tgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggcca

SEQ ID NO: 151818 - DNA, 596 bp, Homo sapiens
tacctctgccacaagccttacgtggacaatgaagagaaggctggtgctggcaatttagtgctctagtgtctaccagctctccagctgctaagctgtccctttcatcaatctaaaatgagtcatcattgtttcacccgtctaaagggcaaggcaaaaacagtgaaattaagaaactccatggaaaaaagaatggagaaaataaagccagagatgtcattaaatgtaatacaagtaagggggtaaaaacatattattcaaggaatttctagggctaatgcaaagctacttcttacggaaaacttggaaaatactaccaacgtaattttgtttcagaacacaagaattttttctaaaaagttgtgtttataagctcatgcatattcataaagtgattcatttggtaggaacatacagtcatccagatgcgatgaaaaagcaacagctttaaatgctcaatctacccatcagacttaaaggttatagtagcatttcttgaaaacacattagtcatctctgctctaactatacatctctgtagagaaaacatggaaaacagggttgactggtagtacacaagtttgtcactgctgatcgtt

SEQ ID NO: 151819 - DNA, 565 bp, Homo sapiens
ggggtcggggggcggggggcaagaattgcaaggtaaccagggaggccagtgcaatgtccaggtgggagaggatgctagctgagactagaagtgctaggaaaaggatgtgtgcagacaagaggtcactggggaggtgaaataacaaggcttggccatgagtggaacccaacacccatggtgccctcttgagagagggaagatggcacctgagatggaagatggaaagaccagggtccctgtgactgaggactgagcctctgtttgaggttttggcagaggagtaaaggcaacaaaagaggcaagagttggaagaaaggtgacaaggaacaaaagtcagctatgcctgatgctactgggtggccagcaacaatgctgacttggccaaggctctgagagctttactatgctgggactggaggtcagagttgaggctagggtaagagcaaggggctcagatggagggggaggaggacctgaacaagtccagaagggaagagatttgtccctctatccaacagagtacccagtgagcagcacagagggcacagcaagggacatcacccgg

SEQ ID NO: 151820 - DNA, 613 bp, Homo sapiens
ctcatcactaaccccttttctaacccgtccaccagcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacaggtgagaggggacctggcctggccatcccctgcaagcatggggcatttcattctcatcctcagcttcctgcttgcctctctcctcggaaagaagactcatcccccaccccatttcccaccttgcatggcgtgtctcagctcttattatgtatcagctgaaggctcccaggaagcctagaggagcccagtgtgcatgcgtagtggagaggaaacagtgattgtggccccgtgcgggtcagaaggaaacaaaggatgtttaatgacaacagagaacacttagccccctgctctgcctggtgtgtgtgcaca

SEQ ID NO: 151821 - DNA, 615 bp, Homo sapiens
ctcatcactaaccccttttctaacccgtccaccagcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacaggtgagaggggacctggcctggccatcccctgcaagcatggggcatttcattctcatcctcagcttcctgcttgcctctctcctcggaaagaagactcatcccccaccccatttcccaccttgcatggcgtgtctcagctcttattatgtatcagctgaaggctcccaggaagcctagaggagcccagtgtgcatgcgtagtggagaggaaacagtgattgtggccccgtgcgggtcagaagggggctttctatctctaaagactacagaggtttcttgtgtgaaagctctccagggtgttcccacatcac

SEQ ID NO: 151822 - DNA, 499 bp, Homo sapiens
ttttctactatttactatgagttgctctctgtttactatgtttactatgaggtactctctgttgttttaggtgatggactggacaatggagtgtctagtgccctgagctacctgtttcatggatgtgggggtacacttctgagtggagctgggtccccttgcttgcccatgaaaacccaaatggtgactgtaggtgccaaccctgacaagggtggctgtgcggagctcctggtgaaatttactgaggtgtgtgtaaggttcgagggggctgcactggcttcacgtcttaggcagaaatgtgatgtcttccctctcaaactcctgtcctagcactcataactgcctgcttagatgcacactgtagtttatttccagacatcaatgtggctgagagccatgggaaatgcctatcttgtgactctttgtgggagtggttttgaagaagaacctcctcattcggcccagtaaagatagccttatggcttccctattctccgat

SEQ ID NO: 151823 - DNA, 735 bp, Homo sapiens
acttggcagagatggtcaaaaagggtgcccacagtgtaaattgggttggaaggcttcaaactacatactactccttacgtctcttcagggcccctatgaatagctgttaagtataataccttcagggtagaacagtgaccccacccagcctgatatcacagcaatatgcccctttgacaggattattaagaaattattgaaaagtatttttaaactgttgctttaataaaagagaggtcagatccttttatatagtgtgtgggtatactttcttataaattgccatgtggcttttagcttctttatatagctcaattacaggtgcctgaatacattgtaactctgagccatgattctggggctgagctctgctctccttgacgtgtgatgaaatctgcctattgccaagatcctttgtagaaatctctcttccatttgcaccggctgacatcataagaagtttgcaaaagaaagaaatatattccacctgatgacattagagttgctcctctgtgtttacatttgacctggttggaattacttgagttttcaagttgtgaccttcccacatgttaactggcagagcttgagcagccatcttggcagacatgcagtattttctgaggcaaaagacaaagggttttttcatccattattaattgatgttactcttttcagcagaccaaacatgattctactatacagctgccaaaattgttctagacccaaaaaaga

SEQ ID NO: 151824 - DNA, 431 bp, Homo sapiens
tcaggaggaaagagacaggaaacggaggcctggctgcctgggctgtgacgttgcccctctggcatgctgtccgggcctggaaaaatgcagctggcactgccttgaggattcggagcagacaggagttatgtggttgcttggccaactcccgagtacaataaacttaatcttggaagtcttactctcgagggtgaggaaagggtgaaatgtcggtatgtagactctgtcgccaagaagcacaggagaaatgaaagaagaaacaaatcccttcagttaaaatgccagtggaaaaacacttctgaaaaacaaacaccgagaagcacaatgtgtttttatgtgcttgagattttttaaaaacgagttttggaaaatagtctcttgatgtttacatagttccccgtgaataaagggcaactgggaatttggactgg

SEQ ID NO: 151825 - DNA, 450 bp, Homo sapiens
cctacagggatcactgcctggtgatgcaagggagggatgctgagtaacagcaggtctgagtcctcccttggtggcggcaatgtagccggtgcctcaggttcagtgctcttccccatctcctggagagtcctgccttctccctttcagccagcttggcccgtttgcgttcctgtggttagtgagggctggctgtggtccttttccaaaacaggcagctgagcagaaggaaataaaatgccacctcttcactctccctttcagggtataggcgtgtaattgtacctggccaccttaaagcaccgaaagaggggccgtctcccaagcccaagcctcaacttttgggcctctcttttcctactgcccacgtcaccccattctgtccatatgccgtcacagccctcaccatgtccactgtgatgtatctgctagactgggaacccctggagggca

SEQ ID NO: 151826 - DNA, 496 bp, Homo sapiens
ggttttgtcggcataagttggttgtaaagattaaatgagaaaaggcaggtaaagcccctggcgaggggtctggtacaaaaagcaataaatgccagtttctttccccaggcttgaagactgatgcctaattctggctggttatgagacccaggaagattacttaaaatctcagatcctcagttttcacatccatggacttaccagatcgatctttccatctgtccattcaataaatttcattcaatcatcactaagttggcccagactaagtcctggaaatctttaaatccctcatttaaaaaatatggagaatttcaaatgtctgaaaaacagattatgcataaccaacccccatttacccaccactcaattcgagtaagccacctttcagctttagacttcagagggcccttgagttaggatggcatggagggtggaataaaaatatcagggggtttctgttaactccaagtttaatacgagttaccagtataat

SEQ ID NO: 151827 - DNA, 285 bp, Homo sapiens
atagggaacaaaatgggacctgggattaagaaacaaaatagaagacctgtggtctgatggtgggcagggagttgtgagtcacagaggagctcatggtaaacatgacctcatgctgaagagcagagcctggaactgctcatatttaagcctctgctactttcattcagagaattggaaaacatgcctgataccactcttccattcatccatctaatcatccatcgatccatccatctctccatctattatttcatccatccattcatccctccatccatctaccca

SEQ ID NO: 151828 - DNA, 242 bp, Homo sapiens
agaaatgatttaaattgtataggaggatgtgcacaggttatatgcaaatactacgccattttatataaaggccttcagcatccacaaattttgttacctgcaggggtcctggaaccaatcccccacggacatcaagaaatgactgtatgtatgttatatatacaatatttacatatacacaataaaatacatattatgtaaaatgtatacgtaaattaaaatatataaaatgaaatactgta

SEQ ID NO: 151829 - DNA, 589 bp, Homo sapiens
gaaggggagttccaggttttatgaatattcaacagctgagaaattcccatcagggagctgaattggtggaaggaatccaccatggcaaggaagcaggcactttccacacaccattcccatgtaacccgtgatagagctctccaaggtgtcattgttgtccccactttacagatgaggaaactgaggcatggggatgttaagtaattggcccatggtcacacagctaataagaggcagagccacaattcaaatcaggttgtccaattccaagcctgggccagcgccacactagaaacacctctgcaggagggaggaatggtccaggggccaaaaccgtatgacttggctccttcctgtttggggtgggattcggggaaggcaggtattgacagtgtaatggtcactccacagaggacaggcaaggccacctctgagtgatagtcagagggctggcccagtggcccggccagtgttcagagccacactcttgtcatgtttaatgcctcggtggcacagggggctcagcaccagacttcccctgtggctcatgtttctgaataaaggcccgtggagggctgaggcctctacc

SEQ ID NO: 151830 - DNA, 369 bp, Homo sapiens
atccaatctgaacaagtgactttcccacttaaaacccttcaactgttctcaggaaaaagactttcaaacgtggcttatacactcttctgcatctggtcaaggcttagtttttcagcttacctctcatttctcagattatttcttcccttaagcacacgacactccaaccatgtcaaagtactctctatgctgttccccaaatatgccaatgtccactagtgccccgtggtctttgcagaagctgttatctctctaggtgtccaccctttttaaccccccaacaccctgagcaccagccagccccttgcatctattctctaacttcagcagtcgtgtctggagaaaatcttcacactactgctaggcttg

SEQ ID NO: 151831 - DNA, 590 bp, Homo sapiens
gcgacggagtcttgctctgttgcccaggttggagtgcagtggtgcgatctcagctcactgcaagctccgcctcctgggttcacaccattctcctccctcagcctccagggtagctgggactacaggagcccgccaccacacccggctaatttttttgtagttttagtggaaatgcctcggcctcccaaagcgctgggattacaggtgtgagccaccgcacccggccaagaattgctatttttaatttgactgagaacacaaacgggagtgttgatgaagactaatgaaaaatgtttgggtattctggtacttaaatgcaaaactgtgtgggaaaaaaaaatcttaaaacagggcatctatattcaaattcaaaacattttatcccaataaataagctaaaaagcacatctttaaaaagatgttatgacacataaaaataattttatgtgttatgacacataaaaataatatgaacttcagccaggcgtggtggctcacacctgtaatcttgggaggccaaggcgggcagatcacgaggtcaggagatcgagaccatcctagctaacacggtgaaaccccatcactactta

SEQ ID NO: 151832 - DNA, 301 bp, Homo sapiens
gaagctactctagtccacagataatatttaataccagctttgtcagctgtgttacacagaataatgatccccccaaccaaaaaaaaaaggatgaccacaccctaatactcagaacccatgaatatgttatattatgtggcaaaagggactttgcagatatgattaaatgatgtatctagggagattatcctggattgtctgactgggctggaggcaggagggtcagagtcagagaaggagatgtgatgatggaagcagaggtcagacagagatttgaagatgctataagattggctttgaa

SEQ ID NO: 151833 - DNA, 445 bp, Homo sapiens
gcctcccaaattgctgggatgacagacgtgaaccaccgtgcctggccgacagtcacctttagaatgtgaacagtggacactgtgttggggtctcctacctgtgcctgtgatgtggactggcccatctcgtcatggacaagtagagatggggtttcaccatgttgaccagtctggtcttgaacttctgacctcgtgatccacccgcctcagccccccaaagtgctgggattacaggcgtgagccaccgcgcccggcctgagacggctttccaaggctgcagaaatgaagtctgcaatagcagatcctctttgcctgggtttgcacgtgatccagcaaaccacccaccgacccgttgcctcatgtgagacatcctcagggaacagcaagtctcgctgttcttggaagggacttccagcctggaaagaaaagggagggataagagagc

SEQ ID NO: 151834 - DNA, 693 bp, Homo sapiens
gcctcccaaattgctgggatgacagacgtgaaccaccgtgcctggccgacagtcacctttagaatgtgaacagtggacactgtgttggggtctcctacctgtgcctgtgatgtggactggcccatctcgtcatggacaagtagagatggggtttcaccatgttgaccagtctggtcttgaacttctgacctcgtgatccacccgcctcagccccccaaagtgctgggattacaggcgtgagccaccgcgcccggcctgagacggctttccaaggctgcagaaatgaagtctgcaatagcagatcctctttgcctgggtttgcacgtgatccagcaaaccacccaccgacccgttgcctcatgtgagacatcctcagggaacagcaagaattttgaaggtccctgataagacatctttgaggtcaggcataaatcatcacttcacatcttgacggcaatgcaacgaagacaagtatctgtctctttgggtctgtctaacaaggagcaaagcctggcctcccaccagcatccagacaatagtggattccctctccatagatgtcaaaaaagaaacagatgctcccgcaggtgaaatgagctctggtccacaatgcaacgcaggctgtgcagaaaatcaaagaggaaccaacccagaagtatcccccaggacaaatcattaagggggaaaaggcaa

SEQ ID NO: 151835 - DNA, 848 bp, Homo sapiens
ttgaatcaatttttattcatttaacattacaagaatttaacccaagtattgtgttaagtgtatatgacagtgtgcttaaacattcccttatttgcttaaaatttggattgtttccacttgttttccatgataaaaatgctatgaagaaaagctttacatatagaggtaaagacaaattttcatatgtggaattattggatcaaagaggacacttttaaatggtcaatattatcaatatattaattgcagttgctttccaaaggagtagtaccattttatactccttctctcattgtgtgataataagtttctccttactatcttcatcagcattggattttcgtttggacattttttgcttatgcaacaggcaaagttcttttgaaaaaaaaatgtaacacccactatctattgaattcacccaataatcttatgaagtcaacagtttacagatgaatagatactgagatgattaattgatttgctcaagttcatataactattatcagagctggaccttgatcttgcttcttctgaatccggccctgttgtgtgtttccactctaccacagctgtccactacataacaggaagggcagaggctaatgagcccttcaagataagcttgaagaagctcagtggttggtgtgtatcaaggtggaatagatgagcaggactggagagtaaaatgtccaaatggctttgtttcttaaaaaccaaacatttcctcaaaaagagtgaataattttgattaatttatacatgctgtttcactcatccacatgtacattaaaaaggtttaaaaagaaaaaaaagtatgttatttaatggtggcttggtgttggaat

SEQ ID NO: 151836 - DNA, 302 bp, Homo sapiens
agagaagtacaatttgtttataccacagatctgaaccatgtccaaattgaatattttgcaagaaaataatgtttactaaagtattaccattaagaaataaaaaattctacacatctctaagatggaggcaatccagttattaaatttcctccaaataataaaaacaaagcaactaggttagcaaaaccatggacaacaaatacaacaagaacaggcgacaaaatatctccttcattcacaaaacacagtcaggtaaagcaaaatcaccaccagctacaaaatgggcttgaaaagaaggggct

SEQ ID NO: 151837 - DNA, 522 bp, Homo sapiens
gcatctctggtttccggtatcccttgcctttctctttcccagtttaccctcttgtttgggagcacagcttctatccttcctaaagaaaaagagggagaaaattccatggcaccttgcacacctggcagtgtcgtcgttgattgtttgactgggcatggcattttaggggtcagtgtattcctccagagctttgtgtgtgaggcttctttgtcttcttgttctcagtattgctgttgagatgcctgcacattttgattcctgactctttgtatgtgacctgatttcttttggaagcctggtttctcttggaagcctcctctttcccccagagttgagaggctttagtgatctctttgggatttgggtctgtttccacccctacgtggggcactgagtggggccttttagtttggggagtcacatccttcagttttctgcagtgtagtcaccgaccatgtgggctagcagggaataggggaggttggatggcaaggtgagcatccagaaggcacgatcctagcg

SEQ ID NO: 151838 - DNA, 890 bp, Homo sapiens
ttaaagatgcacacgtggatgacaaaactatcaagaaaatgaaggaaatgattgccataaaaaacagaatagtgactattcttagaaccaaaagagagttgcaactggataggggacaaagagggctcccaggtgcctgataaggttctacttcctgataacttttgctacataacaaattatccccaaatgtagcagcttaagataactgtaatcatttgttatctcacagtttctatgggtcaggaatttgttagcagcttagcttagtttagcatggactttcttaagaagttgcagtgaagatgccagcccaggctgagtcatttgaaggcctgactggagcaagagaatccatttccaaggtagctcactcctgtggctcatgagtttgtgctggcttttaataggaggactcagttccgatcgtgtgaccttctccatagagcttcttgagtatccttattatgtgaccactgacttccttcaagtgagtcatctaacttcaaagttagaatgacctaagagctgcagttatgaccaaaaaatcaactccatcatctccacaaaatcctgttggttacacaggttaatcctgttcactgtggaaggagactacactaaggatgtagaaaaccacacagcaagaatgactgggagtcattttggagggtaccacatggttacaagaatgtttgactcacagaaatgtattaagctgtacatttgttttatgtgttttctgtacgtatttaaaaagtgtttaaaaatgacttgttgacataggaaaaagttataaaattacaaatattaaagaccctttttatcctcattgttgctaaacaattattaagcatttgtgtttgggatgcagtggtaggtagggagga

SEQ ID NO: 151839 - DNA, 664 bp, Homo sapiens
atgattacagttatcttaagctgctacatttggggataatttgttatgtagcaaaagttatcaggaagttgcagtgaagatgccagcccaggctgagtcatttgaaggcctgactggagcaagagaatccatttccaaggtagctcactcctgtggctcatgagtttgtgctggcttttaataggaggactcagttccgatcgtgtgaccttctccatagagcttcttgagtatccttattatgtgaccactgacttccttcaagtgagtcatctaacttcaaagttagaatgacctaagagctgcagttatgaccaaaaaatcaactccatcatctccacaaaatcctgttggttacacaggttaatcctgttcactgtggaaggagactacactaaggatgtagaaaaccacacagcaagaatgactgggagtcattttggagggtaccacatggttacaagaatgtttgactcacagaaatgtattaagctgtacatttgttttatgtgttttctgtacgtatttaaaaagtgtttaaaaatgacttgttgacataggaaaaagttataaaattacaaatattaaagaccctttttatcctcattgttgctaaacaattattaagcatttgtgtttgggatgcagtggtaggtagggagga

SEQ ID NO: 151840 - DNA, 183 bp, Homo sapiens
ctttagcatcctgatttattattcagtagttaataaacagactttaaacttccgcctggctggcttttgaaataggaacctgagagaccccaaactcagccactcttgtagcttccatctccagttcttttaatcctggccaagatggcgggcgtggagactttcttccggtcatagtccaga

SEQ ID NO: 151841 - DNA, 347 bp, Homo sapiens
cacaggctctgtcagccagggatgtgtaggtacctttggtcctctttggtgtctagtatacatacacacagcctctggctaacccaggatatgtgaggaatctcctgtggcttaaattttaccttttaaaacttcctgataaatcccctctagtccatcagtcctttgcttagctgaaacagaactgcaacctcagattgatggagccactggtccttcctgtttgcttgccattgagatcacttatctgacagtactctaaaccaagtgtgtcctttccattatcagtggcaaagctgctggttgtcatggtgctggaaggagctggggttagggacatggggtgt

SEQ ID NO: 151842 - DNA, 330 bp, Homo sapiens
cctttctgggaaaaaaattactggcaaaaaaaacaaaccaaaccaaaacaaacgccaagaaaccccacaacaacacagctgctgtgatttctgtgggtcccaaagaaaagaggagctaactgctgcttcagcctgtgtaatagccaggtcctgggacagaattagctacagttagaaaataaagtcaacaaggtgagtacagctggagatggaacatttactgctacccatctactagcttggaatcagggaagtaattagtccagtgtggatcagcattggtcatggactagaggaggacatctacccttgcccaatcctgaagcccct

SEQ ID NO: 151843 - DNA, 1032 bp, Homo sapiens
gcgaccgcgaaggccagcttcttcgaaaggcccatttttctccgtggctgagcgaatgctcctagaataccacgtttataataaatcatgtagggtggaattcctgctggatgtatacacctttctgcatcagagctcttcaaacccagaatggtgaatagctacccctgggcttacccttttataattttcaacaaacctgcgtttagccccggctaggtgccagcaagttgctagggactgaggaggctctgcagaggacccgagctgaggccctaatcctcaaggccaatggcaggggtcaccgcccaggcacccccagagaacgcggtgtgaaggaaaagacaccaaactcggtgttcaaatgtgtgggatctattctagttctgattctgacacttgcaagtcatgcatcctccgagcctcggctttctcacctataaaatcttcaacgtgacctataaaaatccataaaatcacccctgcttcattgtttcccagggctcatagaaacatcatacaaggtggagaagagtacccaagaaggacaagcttggaatggggccccctccccaggctggagatcagacattgttggagaaggtatcattgcagccccctacatagcagagagatttgctgagttgcatagtctagagctggttgcaattattggacaagcaggaaacaaacctccacagcccatgcgagccacactgctgggttgagtgtatgagcatgtagaatgattgggtctccagtgcggacagaaggcatggatcgcgtggtgcctgtgttgggaggatactaagagggcgatcaccatgccaggacaagactagttgcctgggatcttctgggcacgtgactggagcagagtaccactggatctcctcacaccagccagacccaggaagagaagctcctttcacctgcactgttctctcagcaccctccacggagaaagcttcatgttatgcttagtgtacaggagaaatgctcatgggaatcctgtccattatcacagagcag

SEQ ID NO: 151844 - DNA, 266 bp, Homo sapiens
ttgcttaacttctcagagccttagtttcttcatctgtaaaatggattactacccaatttgaaggactattgtatacattagaaataactatatatgccttgtcatgtagtagatgcttatagcagttcttataataataaagcgaagtccccgtggtgtattgtaaatgtgaaccacactcctcagcagtgatccttgtgtgctaagctagtggaccagagtttccagctgaagtagatctggaaccgagtcttgaaaaatgtgtg

SEQ ID NO: 151845 - DNA, 230 bp, Homo sapiens
aacacccaagatgagctggaacacccaagatggggcactcacatgcctgccagttgatgttgactattggctgggatttcaactggggctgtcaactgtagcaactacccatagcctctgcatgtggcttgagcttccgcagcatggtggctgggttctcagggacagtgtcccaacagcaagtgttctaagagtcagtaagcagaagctgccagtcttcttgaagtcta

SEQ ID NO: 151846 - DNA, 435 bp, Homo sapiens
ctagaatacaaaaataatttgtatttttaacattactctttagtctaacctttctgccttataatgaaaaccctagaaaataaagatcctgtctgaatacattgctaaaatgtccttgatcaaagcgctatctgcatttttgacattcaatgcatttaaacttatacataaacatgtgataagttctttgagggaagatgttctgttattggaatcgttatcactttcatggtactgaatatggtgcttttacctggcaggtacattgaaatttttggtggataatgaatgaatctattttctatgtttagttaattaacagtgtcccattttgataggtttacttgttttctctttttcatggctaaatgtactatttttaggacaattaattttggaataaaaataaaatttgttcaaaagagattgtctcag

SEQ ID NO: 151847 - DNA, 345 bp, Homo sapiens
gtgagccaggggaagctggaggctgctccacagccctttctaccgcagtccagctgtgccaaggtgaccaaggggggaggggaacacaggcactgccaggccctgggatggaaagttactcatgacatctccgtaagaatcactggagggccatggttttgggtgtggacatcctggagggctgttttagtgcccacaccaatgccctagttaaagaaccaccctgtccccttagccttctgcaggacaggtgggaaagggccgggtgtctggtcctgctgccaggggacagtgcaggtgtgaccgtccgggcagagatgagtcaccctccacactgtcttgctg

SEQ ID NO: 151848 - DNA, 231 bp, Homo sapiens
cacccctccccattcttatagtccctcccagaggtcacttacctcatcaccatacccccaatgactcgagttgccaatctccagttgcacttccacatcagttgatagagtgactggacactgtatgactcaacaaagagggcaaaacccacctccaatggcgtggcattgagagccctctgtgtctgtgccccacctgtttctgtctctttttttttttgagatggaggt

SEQ ID NO: 151849 - DNA, 311 bp, Homo sapiens
tgcgtacttgtagtctcagctgcttgggaggctgaggcgggaggatgacttgagcttggaaaattgagggtacagtgaacaatgatcacatcactgcactccagcctggatgacagagtgagacccgtttgtcacatttgagcacatgaggcctttcaaatattcttggggaatttgttgcataagcgaaccctgtgagaaaagttaaactttttgaagaaagttcttcaattgttggcttgcttttttttttttttttttcttcttaagatgggatgtgcctatatattaagtggtgacttaaaaatact

SEQ ID NO: 151850 - DNA, 550 bp, Homo sapiens
gaaatatatgcagctggaaacaatcttggatcctagggtttacagcaggcaatggcctaaaatccttaagaatttcacacccaggtgcagtggctcacacctgtaatcccagcactttgggaggccaagggggggcggatcacaaggtcaggagatcgagagcatcctggctaacacggtgaaacactgtctctactaaaaatacaaaaaattagccgggcgtggtggcacacgcctgtagtcccagctactcgggaggctgaggcaggagaatggcgtgaacccaggaggcggagcttgcagcgagctgagatcacgccactgcactccagcctgggtgacagagcaagactccgtctcaaaaaaaaaaaaaaaaaaagaatttctcagcaggcctggcacagtggctcacgcctgtaatcctagcactttgggaggccaaggtaggtggactgccctgagctcaggagcttaagaccagcctggacaacatgataaaaccctgtctctactaaaatacaaaaaattagccaggtgtggtggcacgcac

SEQ ID NO: 151851 - DNA, 216 bp, Homo sapiens
cttgggtcatggaaaaactgaagatgcattagatcatcaaagaaaatggcacaaacaaccctgcaaaagaaaggatcttcttccagattaaatctcttataatataactcctctattggatggttaattctaactatccaatgtctccctttttttttctttaatttaccatgttggtcaggctggtctcgaactcctgacctcgtgatccacctg

SEQ ID NO: 151852 - DNA, 742 bp, Homo sapiens
aggaattttgtgtgaagtgatagtggagccaggacagcagtgtggcagaaaccagtgagtgacacttcaaggaggccagatggccaagcagcatctggaatcgctttgcctgcagttaacagcatattttatctctgctacacgagccaaccttcaactatccatgtaaatggaagacaaaactactgaagataaaattgatacccccaagaaaattccaaatctacactgaaatcaactactttcattccctaagtatttttcatagaaattccaagttatgtgtgagtagtatttccataatttaaccaacttcctgtagtcatccttcttttgttgaaaagacctaatctaaaattgaagtgactgtggagagaaaacccaagttcactgaccatgtaaattctataatttgccttgcataagtaggaatttatgatattaacaatcaggagcctagaaaacattccaggagaaattgagttaaaattaaatcagtaaggccaggcacggtggctcatgcctgtaatcccagcactttgggaggccgcgggaggtggatcatgaggtcaggagatcgagaccatcctggctaacacggtgaaaccccatctctactaaaaatacaaaaaattagccaggcgtggtggcagatgcctgtagtcccagctactcgggagggtgaggcaggagaatggcctgaacccgggaggcagagcttgcagtgaacagagatggcgcc

SEQ ID NO: 151853 - DNA, 134 bp, Homo sapiens
ccctccccccgccaaaaatgcctaggataatagccagcacacagtaagcattaacacatgattgttgatcattattaatattattaattaattaaaataatataactattgttgatattgtaacttaaacattt

SEQ ID NO: 151854 - DNA, 359 bp, Homo sapiens
ggtcggccttgtcctagctgggtgacataagccaaaccccttgccgactcttcagggtcattttgatcttcccgccacccagatgtcccctggttcactgatgaccccgataactaatgtgtcattttcctctatgtgcttttcttttagagacaacgtctccttctgttgcccaggctggagtgcagtggtgcagtcatggcttactgcagccttgaactcctggcctcgagtgatcctcccttctcaacctcccaaagcactgggattacaggcatgtgccattgtgcctggccttgttttggcaaaaccatatggatgtcccatctaacactccagcctctcatttcaagggccct

SEQ ID NO: 151855 - DNA, 153 bp, Homo sapiens
cccatttcccccatgggcctgatcctagggtagcagcttcccattcctctgcagtggtgcctgcagccacagatttaatttaaaaatttctagtagccgctgtgcagtacagtctcaaactcctaggttcaagtgacctccctgccttagcct

SEQ ID NO: 151856 - DNA, 144 bp, Homo sapiens
agttgaaggataaattcctagaaacagaattgtgtttctatgggcagatgtcacagcctcccatcccgggtttgtatctctgtcctcatcgcttgaatttctgtctcacaaaaggcacctgagtggagccagtgaagagagaat

SEQ ID NO: 151857 - DNA, 244 bp, Homo sapiens
ctgacttcaagtgatccacctctctcagcctccgaaagtgctgggattataggcgtcagccagcacacctgatgcttagttgtacattcttccaagcctaatggtatgtgctaaaagtgccttaccaattgccaaggataatttttaatccacatgaactgtcttattatcgtttatctttccttgtggctgtcctatcaggagaaagagatcagcaactccctccccattagatttttctttt

SEQ ID NO: 151858 - DNA, 308 bp, Homo sapiens
ctgagtgcagggtttgcaaaatatctcaagcactgatcttaagttttacaataatgacgctatccctaggagcaatctggggaggttcagactcttggagtcaggggctgcatgacccctaaaccataatttccaatcttgtagacaatttgttagtcctacaaaggcagactggtcaccaggcaagaaggaggtcttttcaggaaacggctattatcaattttgtttcagagtcaaactgtaaactaaattccttcccaaggttatttcggcctatgcccaggaatgaataaggatagctttaagat

SEQ ID NO: 151859 - DNA, 520 bp, Homo sapiens
cacctgtagtctcagctattcagggggctaaagcaggaagattacttgagtatttagaaggatccaggaggtcccagctggaatgactgatcaagaatctaagaaaggctgggtgcagtggctcatgcctataatcccagcattttgggaggccaaggaaggtggataccctgaggtcaggagttcgagaccagcctggccaacatggtgaaaccccgtctctactaaggatgttgaggctacagtgagctatgatcatgccactgcactccagcctgggtcctgggtgacagagtgagactctgtcttaaaaaaaaaataaaaaggctgggagtggtggctcacgcctgtaatcccgacactttcggaggccaaggtgggtggatcacttgaggtcaggagttccagaccagactggccaacgtggtgaaaccccatctctaccaaaaacataaaaaattagctgggtgtggtggcgcgtgcctgtaatcctagctactcgagaggctgaggcaggaga

SEQ ID NO: 151860 - DNA, 313 bp, Homo sapiens
gccgggggcaggtcagagctgtctaaatggccagatgactgtggttcatggcccacggccctgctctgcgaaatgctacctttagttcagtaaatgccagcatctttaggagagtctgagtgcagaggaaggtgcggtgaggccagtgagaaacgcagcccatgctctgagcactcagagttttccccagcacaatttttagtttgcttcagctttttcaattaaaacaaatctaggccaggcacagtggcttatgcctgtaatcccaacactttgggaggctaaggcaggcggattaccttaggtcagtcag

SEQ ID NO: 151861 - DNA, 724 bp, Homo sapiens
cataattatacacatttatggggtacatatgatgttttgatacatgtatacagtgaataatgatcaaatcagggtaattgggatatccaccacctcaaatgtttaccatttctttgggttagaaacatttcaaaccttctcttctagctattttgaaatatacaacaaaatattcctattttgctattgaaccctagaacttattccttctatctaatggtatttttgtacccgttaaccagtctctctccatctcccctccccactgccttcccaacctctcactttttaaaaagtagatttctgaccaaatcatagagcactctattctctgatatgtttaaaagatacaataaagtatcttataaatgtcaaaacataaagatgaaaagccagataaaggtaagcaaggtatttatattagaccagagaaattcagtcaacaaaaatgttaagtgaggtgaacacagtctcattgtgaatacacatgaagatgaagcagttatgaatatctacaggttaaatagcatggcatcaataattggaaagacaatgcacgtaccattgaaaatagtcagaaacactgaatacaggttcagctgcttgctgtttgcaaaaccaaattacaaggacaaagttcagtggaagaaaagtgactttatttccaaagtagcattggggaaatggtctagacttcctgccttaaagaaaccatttcaaattt

SEQ ID NO: 151862 - DNA, 507 bp, Homo sapiens
acacgcaactgtatactaaagttcaccatcatttaaaaaaaaaaaaaaaatcctcctctctctatccatccctgcaccgccaacccccaccctcccaaaaaatcagaatttttttcctcatgttttccactagaactggcataattacaacaacttaaagatatcaacaaacaaattaggtaaataaccatgtcttttttcagtgaacaagccaggctcattctttataattgctgtatactggagtccaatgtatcaggctaggcaattaactgaaatactgaattacaacttcaaatgaataaatcctgtttttaactgtaactttcattgcttctgaaaaccagtctggcaacattttaacagctattatgccactttgtctttaagtctcgggggcactaaaatataaaagttatttaaacgtgttttctcaaacaatgacctgtcaactctatatactacagataaacaaggctattctccaccacgagttgacacgttgcc

SEQ ID NO: 151863 - DNA, 823 bp, Homo sapiens
attctgtcccctctgtaggaaacccttgctacaactccagatgacaatgggtttgatgttgcattcccccacaccaacacctagagtgcaaaatgtccttctgccttattaacaacaggcctcatcctccattcccatgcccttagacaacctagtggggcagacatccacatgcagaaaccaggaagtcctgcaaagcctgcatctgggcaaacaattccaccctttcttccaacaaggcaggcagggccatggatctccttggaaaatctcatcgaatctgctttaatccaggccatcatggccccaagtagcacatttcatgtcgtttagccaaaagaatttgggtctggaattttttaaggcaggtaaaaccaatgtctgccttggctatgaatagctttcaataaaagcacccagagagcatagcacaccaagtaaggccacttcctcatgtaggaaagggacttttcagacttgcttttctcatttcagagtctgagaagacactggttagggtcaatagggcaatccccaacacagccaagcaaataaccacaaactgactttccaaataggtcaacccttgaccacactctctctggccatggcctggaatgaccatgacagaatgtgagagaacaagctctggggcatttactcgtgcagtaggaagaataatgacctctcaaagatgtccatgtactagttcacagcatctgtgaatgcattaccttgcatggcaaaaatgactttgcaaatgatatcaaggttatggattttgacatggggagattatcctggattattaggcaaacccaat

SEQ ID NO: 151864 - DNA, 331 bp, Homo sapiens
agttctctctttaaacatacaaagagggttctgctctacatattgttctgcagcgtcaggcttctattaaatctctttaggaacttgacctcaactgtagcatacaccattttgttttgttttattatatgcctggaaatcagtggtaccacatttttaactatatgatcaaataatgagaaaaagagatgtacgtgaaaatgatattaatactttgatatgtaatgcctactatttacagcatttcttaaaacttgatcattaattttcagattaaattaatctgacagtaatgttgttttccaaggagatttctttcccagactgaaaa

SEQ ID NO: 151865 - DNA, 523 bp, Homo sapiens
agtgcagctgtgcccctcctcaacacctcagggctggttggagcctgagatctctacaggccttcccctccacgtccaggagcccaggagcggctgtcctgccctgaggcccaggattgtgggctttcagatggccccgtgggagatgcctatgcccagcctgtgtgggcctggaggcagtcaaggagtgggcctcgtcctgaggacagtgggcatcacagagggttctgggagcgctggggaccgaatggagttttaggaagaccacactggctgctctgtggaagatggaaagagcagatggggtgggtgtgggaggtgggaagtcgtttctgtaggaggtggcctcaggcggcttcctggccagaggcgctggaggccagagagagccagagagagccagagcttggtggcaagaggtgaggatggagacttacattcagcagctcccacaaggcagggtgtggagggagtgggaaggagcaggggctggacactggaggagggcaggcttgtggtgaag

SEQ ID NO: 151866 - DNA, 402 bp, Homo sapiens
tcatgaatggtttagtaccatccccttgatgctgtcctcgagacggtgagcgacttctcgcgagatctggctgttttaaaagtgtggcacctcacactctctcttgctcagtcctcatcatgtgatgtgcctgttccccctttgccttctgccatgattggaagcttcctgaggccttcctggaagcaggtgccactatgcctcctgtacagcctgcagaactgtaagccaattaaatctcttttcttttaagtattccttcatagcaatgcaggaacagcctagtacaccactttacacaataaaatagtaacaaatgtattttgcaagtttaatcactcagtatactaaccgtagttgcatgggtgttacattttgtaactgtggtcctctgaaatacca

SEQ ID NO: 151867 - DNA, 245 bp, Homo sapiens
tcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggcc

SEQ ID NO: 151868 - DNA, 393 bp, Homo sapiens
cccacctcagcctcccgagtagctgggactacaggcacacaccaccacaccaggctaatttttataatttttgatagagacagggtttcgttatgttgcccaggctggtctcaaacttggctctagcaatccacctgcctcagcctcctaaagtgctagaattacagatgtgagccaccgtgcccggcctttattctctatttattcaagtttttttatttttttagattccatatataacagatcaaatagtagtcgtcttctttctatctggcttatttcacttaacatattctggatgaacccatccagattcatacatgttgtgacaaatagcaggatctcccttttttttaaggctgaatagtatttctggaggtgtgcgtcaatgtg

SEQ ID NO: 151869 - DNA, 369 bp, Homo sapiens
cccaaagtgctgggattacaggtgtgggccactgtgcctggcctaatttatatatttctaaaactttgatggttttctttatggaaagatggagtgccctaggacaaatgtctccaagggggaaaagaacagaactgataagattaaatgataggtttggctatatgcagaattgttctgaagcgcaacagttttaaatggtgatgaagtccagtttatctataagaattgcttctgctttttggtctcatatggaagaaaccattggaaaaatccaaggtcacaaaaatttacgtctcttttctactaagagttttgtagttttaggtcttacactttgagttgatttttgtatgtggtgtgatgtgg

SEQ ID NO: 151870 - DNA, 288 bp, Homo sapiens
cttagagtttctgaattaatttagcaagatttcccacattatagaaatcaggcagattaccttaaatcagatcttttaagagtataaatactttctctctagttgtctttatcaactctcttacttgctatcttcttcaacttgcgttactcataccacattttgtgatcatttatttctacattgagtttttcatagaaaatgattcctggaagccaggccacctcactgttgtctttgaatgacacatttccgtgctttggctctgatgtgccagagaaccccttg

SEQ ID NO: 151871 - DNA, 703 bp, Homo sapiens
gctagtctcctgcctcagcctcctgagtagctgggactacaggcgcccaccaccacgcctggctaatttttgtatttttagtagagacgggtttcaccacattggtcaggctggtcttgaacttctgacctctggtgatgtgcccgcctcagcctcccaaaatgctgggatgacaggtgtgagtcaccgcacctggcctctttgcttttcttaagtgactccatgggggacccatgcagccagcagcatctcggctttttctccctggaaggtgtctgcaggaaaccagcatcccagttaacttcagacgcgagagtgttgattatacactcaaggccccacattagggaagtttgtgagtcacagccccacactgggtctcccagggatcaacaagatccacaaaccagcatggttaggacaagtggttttacagtccttttttttttttttttttgtgagatggagtcttgctctgtcgcccaggctggagtgcagtggcgcgatctcggctcactgcaacctccacctcctgggttcatgccattctcctgcctcagcctcctgaatagctgggactacaggctcccaccaccacgcccgcctaatgtttttttgtattttagcagagacagggtttcactgtgttagtcaggatggtctcgatctcctgacctcatgatctgcccgcctcggcctccca

SEQ ID NO: 151872 - DNA, 546 bp, Homo sapiens
gcttgaattaatataaaacgaaagaacccagccaataaaggactgcctaactatagctgagaacatccatgtgatcaaatgatacagagatgcaagatggagatcttaggagaataagggtaactgcaggtgctggccaggccgtgcatcacatgctgttaggtaaaagatgacgctgaggagcagccaataatgtgatcccattttttaaggaacaaaggtctaggtgttggtatgaacatgaacaaatccctgaagaaattcttctgaacccatttactgggtatctgatgggaggggagaaatgccaaggactttcaccttctactgaaacatttcctaatgttcatttttttctttttttctttttttttttttagatggagttttgctcgttggccaggctgaaggtgaaagaacgggaagggaagtaccacacccgtgtcgcacagttgcaatttgcaggcaggatgggagcccagggtcctctgcctgtttcgcagttcctcggctctcccctaaggagtaggaccagggttgggaggg

SEQ ID NO: 151873 - DNA, 394 bp, Homo sapiens
gaacttgctgaatggcaaagcaaagtgctttgaggctctagtttaaaaaagtcctgggagtgcagaaattcattcccatctttaattcctaagcaatcagccagccctgtagcatggaatccacccactcatgtagttaaatgtgtttcagtgtagaacacacacacacacacacacacacacacacacacacacgtgtgaggaagggcctgccatcatctaccctttctgggttgttaggttctgacagttaacctgaaaggctatactgtgacagccaaagcatgaaatgataaagactgtggggcaaagactaattgtcaagccctcctccagctcagaaggttcatggctttggaggaaattcacatatatgtgagtaattggtggtagg

SEQ ID NO: 151874 - DNA, 239 bp, Homo sapiens
gtagagaatgctgggggttgcatgtgggttacaggggtggacctggagtccttatgaatgaggtgagttaatgtgtgaaaagcactaagacatggacaggccagcagaggcagaggctgggacacacacgagctgtgtgtgttcacccagcaatgtaggcagggtcgtgaccagatcacagaagccataggtcatgatcaaggtcagagtttcggctttgtcccagtaagatggaaaag

SEQ ID NO: 151875 - DNA, 798 bp, Homo sapiens
  misc_feature (19)..(19): n is a, c, g, or t
ctttaggagataacaaagnccagttggttgtgaaaatgtcctcatcttctctgggacaggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaa

SEQ ID NO: 151876 - DNA, 633 bp, Homo sapiens
caatgattttaagtttcttgaggcctccccagcaatgcagaactgtgagtcaattaaacctctttcctttagaaattgctcagccttggtcagttctttatagtagcatgagaatggactaatgcatcaaccctccctgcttgtctagttctcaattctggtatcatgtcacctgaattctgttcctgttctcatttatacagaaccacctactatgggcaagtcagtggcttgtttctgtttcatggaatcttctagctatggagagctcaggtatcagacttcagaagtagagcttggcttgccttgtgcatggagactttagtctatggccaccactagttaagagcagattaactctgcaaggctggctccatagacacctcactttttcctgagtggtgctgtcctcagtgtcttaacacttaaacacaccatgatattctgatatgcttgatcaaaggaaaatgttatattctttattcaagtaaaaataattgttgggacaatggatagttgagaaatgagtgagatcctttgtatagaattaaaaattatagtaatacactaagaggatgtaaaatgagagttgtccgatgaaaaagctatggacattgaatggtgcctaaagat

SEQ ID NO: 151877 - DNA, 294 bp, Homo sapiens
gagagagaggatcaagagaaaagggggtagtggtggagaggtttgcgggaagaattcagtttactcctattgggtttgaggagaggtagactagtggaaatctagcaaaaatacaggtctcagaaacataatcactttgaacccctttagttctttatttgcatgagttttagtttaaggagatttctggtagagggagaacctggagcagagggagaaggaagggtgatggaaggaatgccttagtgtcccagcccagtccctaaatgtgatggtgaaaaggcttaaggagag

SEQ ID NO: 151878 - DNA, 274 bp, Homo sapiens
tggcaggaatagggaaagcgcaggtgggatttgggaactatcagctggtccagtataactagagtagagcataaatgaaaggagacaaaactgaaagtttgattagaacttctttagtcagacgtgttgtgggcttgggtgaagggctgaggtggctccttgagccagcataaccatttaaggttttcatggaggggaacagtgtgatcagttgtttagattgagatacaaattttggtctgttatactaatttttctcaagtcagttttggtt

SEQ ID NO: 151879 - DNA, 421 bp, Homo sapiens
taggagtcaaccccgggtgctgcatcacctttccccctcttcttggacaggttcagcttgttctggtctacctatactcaacctgcttccccattagcttctggccagacttctttccatggctgcggaattgcaagaaataccatacttagactactgccagagaataatgacatttaccccttgtctgtgctttgtgtgagggctgtctgggttccatatatgaaggagcgtcactgggtggtcacgcaattgaatcacgcaattttatcttcttcccataacatatagtttctctcaagaggaattaccttcatgattacttcccatctttccccaaacttgatgggccatggtcaagatcttctgcaaatgtcctctctcaaatttgccttcatctgatctttttataatgtatctg

SEQ ID NO: 151880 - DNA, 195 bp, Homo sapiens
acaaacaaagagaagggggtgataaatgtgtctttgatgcccagggcccagcatcattctagggcacaaagaccatcgatcctttttattccttctcctactcattctagactctaaatccaaacacctttctgatcttaaaatcatttcctgaattattgtctcttggtgcagcatcacacagcaatatcttga

SEQ ID NO: 151881 - DNA, 364 bp, Homo sapiens
ggcagggctggggttgatagattgcgcagaccctaacagaggcttatatgatttatagatgaacagtattacctcttcctccctcctgtttattcaggtggttttcacaatcagttccttgggcttgaggctactatgtaaagcaatcttagcccttggtgagtcagcctggcaccttggttctgattagctaatacttcctatagcaaaatcagttccgagtttcagctacttgtaataaggatggctaaaacatcaaacctctactagactcccctgccccaagtcacaggacactcctacttcagaatatcattaactgagactgctttgtgcatttctgcagcatcaacaaacagaagat

SEQ ID NO: 151882 - DNA, 861 bp, Homo sapiens
ttctatactcccagttatagataaccacgtcccacccggcctcaggcgattctacggcagcgtcgtggtgccagtttgcaaagatatgcatttacttctctggctacaaaaaagaatagaaatgcacaaagcagagcagtgtgaagaagaagaggcgatgacccctagaccgaccaaagcccgtgctccactgcccagtgcctatgtcccaccactgtcgctgccaccctgcccgagagaaaggctgaaggggatgctaaaggagataaaaccaaggttaagtaggaactgcagagaagatccacaaggttgtctgctaaacctgctcctccaaagccacagccgaagcccagaaaggcctctgcaaagaagagagagaaggtacctacagagaagaagggaaaagctgatgctggcaaggaggggaataaccctgcagaaaatggagatgccaaaacagactaggcacagaaagctaaaggtgctggagatgccaagtgaagtgtgtgcatttttgataactgtgtacttctggtgactgtacagtttgaaatactattttttaatcaagttttataaaaatgcagattttgtttagctttttttttttttttttaagctatgttagtacacagaatacttcattgttgttttggggagaagggccatatgtcactaatagaaagcccctgaagctggactgatgtggggaaaacaccttttccttctggttttgagagacttcctcttgggtcccaggaagagggattccctgactttgatacacatggccaccttggtataaaagccttgtggtatggaaaaacaaattcgttttttatgtcctcttctctgtttcta

SEQ ID NO: 151883 - DNA, 827 bp, Homo sapiens
tttagtgcacttgattttgcagatgagtctggaagtgttagttgcaaagatatgcatttacttctctggctacaaaaaagaatagaaatgcacaaagcagagcagtgtgaagaagaagaggcgatgacccctagaccgaccaaagcccgtgctccactgcccagtgcctatgtcccaccactgtcgctgccaccctgcccgagagaaaggctgaaggggatgctaaaggagataaaaccaaggttaagtaggaactgcagagaagatccacaaggttgtctgctaaacctgctcctccaaagccacagccgaagcccagaaaggcctctgcaaagaagagagagaaggtacctacagagaagaagggaaaagctgatgctggcaaggaggggaataaccctgcagaaaatggagatgccaaaacagactaggcacagaaagctaaaggtgctggagatgccaagtgaagtgtgtgcatttttgataactgtgtacttctggtgactgtacagtttgaaatactattttttaatcaagttttataaaaatgcagattttgtttagctttttttttttttttttaagctatgttagtacacagaatacttcattgttgttttggggagaagggccatatgtcactaatagaaagcccctgaagctggactgatgtggggaaaacaccttttccttctggttttgagagacttcctcttgggtcccaggaagagggattccctgactttgatacacatggccaccttggtataaaagccttgtggtatggaaaaacaaattcgttttttatgtcctcttctctgtttcta

SEQ ID NO: 151884 - DNA, 421 bp, Homo sapiens
ggactccaggcttgtgtcaccacatttagctagtatttgtattttttgtagagacggggtcttgctgtgttcagagctggtcttgaactcctaggctcaagcagtcttcccgcctttggcctcccagagtgctaggattataggtgtgagccaccacgcctggcctgaccttaatatttttaaaattctttgcctctttcaggagtcactatctgtgcgcccatagtaaacagattctgtaggggtgcatagataagtctcttgaaattctaggcaaatgtctgtatttttctggggaaagagagagttgtgactttgatcagattattatggtgcagtggtccgtgacctcagaagtggttaagagccccgctgtagttcatccgtcatctgtctgggcaaaactgacaggatgaccttt

SEQ ID NO: 151885 - DNA, 234 bp, Homo sapiens
cattgggtagatacactcgtttcaaatgggagaaattggccaaagcgaaagagctacaggccccatgcaagtccaaaacccagcaggcaaatgtctgtatttttctggggaaagagagagttgtgactttgatcagattattatggtgcagtggtccgtgacctcagaagtggttaagagccccgctgtagttcatccgtcatctgtctgggcaaaactgacaggatgaccttt

SEQ ID NO: 151886 - DNA, 499 bp, Homo sapiens
ttctttcttcccgcggtgaaagctgcctcccaggccagcaagagcagcccagaagaagtgccccactctcccagggatcaggtactgggggcagcgggcaggacaaggtatggggtggggctgactgctccaggccaacagaccaagcaataaggttggaaccacaagtcccctgggtaaactgaactttattccttcctcacggctctcactctccagaactgccccgccagctcttctccaggggctggctgctgattaaatggcacttccccacccctcagatctgaccccgcaaacaataaggacttgaggggaggcggcaggctatcagctcaataatgcaaaaccctgttgctcctcgtccacaacagctgacttcaagtggatgggaggctgcgcttattaacaaaatgagaaatctgatctacggaaagaaaacactacgtgaggattaatccgcgactgcagcttgtggagaaggctgggctgctggcca

SEQ ID NO: 151887 - DNA, 396 bp, Homo sapiens
tgtgtcctatttttgcaacttttaaaaagtaaaaattcaccttcagtgacacactacttttaggttaaaccagtttatctgggattcataaacgctactttattttcatgttataacacttaacaccgtaccttgtatatgataggtgctctatcaatgtttgtttgcttttattaatgatttgtaatgtgtctcaataactctttgttctactatggtgcttcttactttttgttttgtccttttgtctttcttctcattttctgtgagctcttccatagcagacactgtcattttattcacaaaaccttattaaattaaacccacacatatttagagttactaataatttgggtatgatatgcctgtgtcttactgaatgcagatgatgatgct

SEQ ID NO: 151888 - DNA, 688 bp, Homo sapiens
aatgctctgaacgagggctgggagatgcccttagaggaaatggtatgtagactgaaaaatgagaatatgaaatatcatgggaacaagattcaaagccagtgtgatagccctgagacaggaatgagcttcacatattaaagtgaagggatgccagggagccacagatcaagtctcccctggagcattagaagtgtgtgggggcacgtgatagcaagggggtgttgctggtattttgtgaacaggggcaagggatgctaaatatctagcagtatttgaaaaagctccagaaggaattttcccaaccaaaataccagcacctccgtcaagcagccctgacagagaatagtgagtatagagaaattgatagacaggaggtcagagagctagacaggagacacattagatagggcttcagggccacagtaaaagtttagatcgttatcagaagtgtgacagaaatcattaaatgcctagtaagcacagaaatgtttttgtaagttctggggacagaaacataatgccttcatacagcattctattccaccttggcctaagttcagagccaggcatggcgctgaacttaggacacacacgcacacatggggcgtaaggaaccgtgcctggacacacacagcacacatggggcgtaaggaaacacgcctggccaacactcaagccacacacaaat

SEQ ID NO: 151889 - DNA, 369 bp, Homo sapiens
tgataacttgagtttgcaatgatgggagccaacataaagcaagcaggttctcatcacagaaccaggggaagttttaaaaattgggggaatcaagatagggatgagggaagggctggcacggggatggcagaccagaagcctgtgagggagactgcagaatcctagaatctctgtgcacccaggcaactccctctggcccaccctggcagaaggcatgagcttaacaagaaaccctggacttgaggccccgcggcacacttgatagagggggcgaaggccagtgcagcaggtccatgaataacatcgtcgtttcattatgacgttgacgagaaaaaatattgccccgtgtccggggccactctctgggtg

SEQ ID NO: 151890 - DNA, 946 bp, Homo sapiens
ttcagctgccatggctcccagttcgacatcatgtcaccggagcctgcacagatgaaccaagcttgcaacacgggaggaacctaagcgctggactgaggagcgggactgaaataagaagcgcacaccacatggcaagatccaggatccaatcagatagagccctggtgtcatctaattgcaagatccaatcagaacacacctcattaccttatggtaataagcttatgcttataaaacccgacccagccgccagcttggggagacaggtttgacctttcctcctgtctcgtcgcagtgcagtccactctctccagcaaaaaccctgcgctttggtgtttggctttccctggtgcacaggcaggcgggtccactttggtttggtgacactctaggccatgctcacacactcaccaggcctaccaggacacattcaccaggccctccaaaccatgctcacaggaaccaccaggctgcacacaagggccctccacacaccacacttggccacacccccggggccgcaccttgaggttctccagaatccgcagggacctcggtgccagccaggccacaccacccagcactccaagctacactcactagacccacccggaaaaacaggccacacctctgagtgctccagatagcgcttgccagacccctccagaccacactggccaggctgcacctcggagccctctaggccacgctctcaagggtaccaccatgccaggctgcaccaggccctcacgtgctgctcagtcaggccaccagtcgcattctgcaggcccccaggtcgcacctccaagcccaagcagcccatggtgatttggcctccttgaagcccaaagcttggtgatctgacttcacaggcagccctcctgcctaccgcagcggccaagaattattttattggcatggcaattagaacctacaaggcaaacag

SEQ ID NO: 151891 - DNA, 342 bp, Homo sapiens
gctagaggatcccgggaatcctcctgcgcttcccatggattggttaatttgtgacttcattctcttatttctgtggtggccaggagagtagggatggggggagagtctaagaacgtgcagcattgaatatcagatctttttctatgacactaaagaggtatgctagctttcacactctgtcctacataggtaagtaattaccctctgccactcactgacttcctttggagcctccatgacatttagcaatcatcatattctgactctattaaatagtgtatacaagaaatatgaataggtcaggtatttaaattgtagccagtcttatacagctaaggcata

SEQ ID NO: 151892 - DNA, 420 bp, Homo sapiens
gtcacaatcactccagtgaaaagagttcaaacatgagagaagagtcacaccacataggtgctgcatattttgcaatacagaatatatgcagagcccagaaaggagaggacagtcacatcacctaggtgctgtgcccagcaataaattgcaatctcttttagggcaaagcccaagcagtagaggtaatccttgctgctggacccaaaaatatggcacaatacaccctgaaaaaagagcccaggaagaagagttacgtcatctggggagggttccaaaaatatgtaaacatgccttctgtgggtaagcctcaggatgaagaaaagagaaaaataacctaggggctggggccagctgcagttacaacctcagtgagcagggcccaggcatgagaggagagtcacataacacagatgctgtgcc

SEQ ID NO: 151893 - DNA, 398 bp, Homo sapiens
gagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaa

SEQ ID NO: 151894 - DNA, 814 bp, Homo sapiens
caacatcggggggttccctggggggtgggtggttaggtaacagcagcccctccacatagtgggggttccctggggcgggtggttaggtaacagcagcctctcaacatagtgggggttccctggggggcagacagttaggtaacagcagcccctcaacatcagggggttccctgggggacagttaggtaacagcagcccctcaacatagtgggggttccctgggggtcaggtggttaggtaacagcagcccctcaacacagtgggggttccctggggcgggtggttaggtaacagcagcctctcaacatagtgggggttccctggggggcagacagttaggtaacagcagcccctcaacatgaggttccagtgcagatgaagcagagcaggcatcggggaggaagaaacagggaccctcgcgtgcacacgcactgctgttttaagggctcctggagaccgggtgacgtggaatcacctgcagtcacacagtcagggaccctcgccgcacacacgcactgctgttttaacagctcttatagacagggtgacatggagtcacctgcagtcacacagtcaccttcagcaccttccacactccctgagcgctctagaggctccagcctctatggccgacactgtcattaatttcccacttaatcccaactgtaatcctggaaaactggcattaactttgttttacagagggggaaactgaggcatgagggggtaagtgatcagcaagaagttggtggggaccaccgtgccagctccggctcggccctccacaccctcccagcacatacccaccctgtca

SEQ ID NO: 151895 - DNA, 279 bp, Homo sapiens
tatagaggatcccagttacagcgtcaggcacaggtaggagagatccagcggtttgcccaagattatgcataaatgaatggctgaatggatgaatggctgaacgaggtgacgctgaagctgggaatgggaaccgagacgtgagcggaggtgagccatgggggttgcaaaggagaggaagagaggggcgggttcttgggatgccttcttgttccttcccgcatgaatttactgactcacagaccctgatgaagcactgactaggtacaaccccgcgtcatc

SEQ ID NO: 151896 - DNA, 452 bp, Homo sapiens
tagctgggattacaggcatgcagccattgggcccagctaattttgtagttttagtagagacggggtttctctatgttggtcaggctggtcgcgaactcccaacctcaggtgatccgcccacctctgcttcccaaagtgctgggattacaggtgtgagccactgcacccggttgcattatcacctttcattctcactagtttataaggaagaccagactccctcagcttccctccctaacacttggcagactcatctgtatcagttccacccgtatctcctttcttttctcagaggaggaactgtcctcttcctgttcgaaggtctgtccctccatgttcttactctcatctcttctcttttgagatcttgggatctcactttattgattgatctgttcatttacagtctctctttgtttctttcatcttcaacctctcacttaacacttggt

SEQ ID NO: 151897 - DNA, 424 bp, Homo sapiens
acaggatgaactttattctgcatgtaacctgtgccatttgagaccaaagcctcattttctccacattagttagctagcaaagggtggtaaccccaagaatgaacacaaatctggactgtaataaagacgccttccagttaaaggttaaacaaatgccttctggggaagagccagcagcctgagctcacatgtgcaattcaccactcttctgtctaaaacctctccattaatttccaccctaacccctatgttcctagaaatataaaaacctttccataaccagtccggggattttctcggggagaagttgaattaaatttctttagcaatcttgctgtaagtgacaagcacacatgatttaaatacctctaaattgagaatttccatatggacttggccttataaatatcagacgctgataaaa

SEQ ID NO: 151898 - DNA, 566 bp, Homo sapiens
taccaactactggctataaggtaggagagaaaaggaaagagaatcagggacagaaaacagttgcctggagcctctatctgcaggaaagctgttccttaggaagggaaaagataggcaaagggagaaaaggagagggaagtgggaccacagcaggtgaagactctggtctcttactagtgcagtagcaaagaaggaagagagaatcgcacctttctctatgacctttgtatgctcagtgttccaactgctggtaactctggcagaattggtgtcctggaatataaccaagcagattagaactcccttcaccagttgagtagtgaagataggagtctgtaaagaggcagatgaggccttggtatgcagattagatgttgtgggcttaactattttcttatatcatttatcagtgtctttaatgtagacaaaagtacaaactgaaagaaaattggcttataatcatagctgagataaactttttgaggtcaacgaacatgttcctctgtggagtctacttcttgtccaagggtttgctgtggttatctgttctttcttctgcaacattt

SEQ ID NO: 151899 - DNA, 230 bp, Homo sapiens
cgcgaaaattcggccagggttctcgctcttgttgcgtgtgttcaaacaaccggcacggtctgatccggaaatatggcctcaatatgtgccgccagtgtttccgtcagtacgcgaaggatatcggtttcattaagttggactaaatgatcttccttcaaaggattatccaaggcatatactcaatgaaaaaccatgatagttctttgtacataaaataaacatttgaaaaa

SEQ ID NO: 151900 - DNA, 355 bp, Homo sapiens
ccagagtcttacagtaaacctgattatacaggaactacattttttttgtctttcatggtattcctttggatgcaggtttgggcttcaaaacacatgtcaagatagtgaatatggtggcaatttttggggtcaacgcttggggtagagtgaggtaggtttgttatatagggagggtatctgggcctccaacagaagaagaaaagcagaaatggactgctttgttcttggatggaaatgtggtagaaagttggggtgaattaagtttggacctgggagttagattagattctggaggataatggtagagaaggagaatgttcataacttgggcatttttgtcaggaattgtgggaac

SEQ ID NO: 151901 - DNA, 506 bp, Homo sapiens
aagcaacaagcaaatatgtaatcacacatctcttcaattcacagctctgagcatcataaccaggattgggaaccagcccttgtgttgcagggacatggcttccacactgcccttgtcattctttttggtactgtcccttacagcatgctgtagtttgatccagggctgagcattcctacaggtgctccccagcgttcctcatttcaggcctagtcaggacctctagagcccatctgctgtgagcaaaagagggtgctaaatagtgaaatacagcttgaagcaagccaaaacctgtttcacataaaatctcacatggatgtcctgtatatatagaaacctggtgaaagcacagggcatgctgtcatggagcctcccatttctccccactccagttcaaggcagctttcaggagatggagaggaaaaagcttaatcataagaagaactgggtagacctgagttctctttcggattctaccagtactatatggccttgcttaatcattc

SEQ ID NO: 151902 - DNA, 159 bp, Homo sapiens
aatcccctcatgtttcctgcccccctcccccaaatcatgaccagaaggatccgctgaccaaggctgtcccttaaatatatgacttccttgagaataatttgacacggcttaaactaatttagcttttctcaatccctgtcttaactctcaacatgacta

SEQ ID NO: 151903 - DNA, 350 bp, Homo sapiens
ttgtattcttggtagatgaattgtgattcattattccataatcattagcccccccacccaaaaaaaaatcactatttttctgatagttttgatggttttagcaaatttttatattagttttggaaactttacttttttataaaaatcatcgtttttacattacatatttgtttcatgttgcagtgtgcttccgattacttttagggctcggtgaaaaaactgcttctttaaaagcctgttgcagtggagatgtgggggaggaggatccaggcagtggtaaggaagggggctctgtgtcctggggagaaatagagaaagtcttggaaagtaagttcatgtcaccttacagg

SEQ ID NO: 151904 - DNA, 561 bp, Homo sapiens
atgctgcgtgtcgatctagaggatccggtgggttcttgcacatgacacctgaggatatgtaataacaggcggcggacaatcgtgcctgacatgttagtgtatgggtagcatacaccgcgaaccacaccgaattgagaaggaatggtcacacccgtctcgatgtccggatccagccatctgggctccactaagtgctgatgttcctggcttgaccaccacgcccagccaacattttcatatatatatttacttcatcctcccaacaaccctgtgaggcaaatatccccattgtacagatgaggaagcaaacccgaaaaggtgaagtggcttgctttccagtacacagagctgataataagaaaagctgggaattgctgcctgttttctgattctaagtttagagccctttttatgtcctcataagatattgttagggcttcagtttgggatgacagtcaccccttatttcaggctgctggccaatagaggatacacacaaggaagatagtcctacacagtgagtagaatctctgctctgtcatagcagcccagtaactctgc

SEQ ID NO: 151905 - DNA, 551 bp, Homo sapiens
tataaccagttatgcaggcggagacacagtgtgcttcctacgtgtgagcatctgccgttggtcagtgggggccttccaaaggctgaagtgattatgatacttgaaaacatgttgggttcaaggatttataatctatttttaaaagacagtaaattcaaggtaaaatagagtacactggtgtgtaccttagatattagttctttaagtctttctccaaatggtagtttctctaaaatttgagacatgaacactaggtaatttagtattaggcaaatatttaaacagtttaaatgagtttattgcatcctggctctattacttactagctgtgtaagtaaccttaggcaaattatttgaattttttgcgacttaattttcttgtctataaaagatatttaacaatggtttctacctcttagggtttttgtgaatattaaatgagttaacatatgcgaagtacttagaatcgtttctagcatatagtaacaccgtacatgtgttagctgttatgatggtggtaatgatgttctcctcctcctcctctttctcct

SEQ ID NO: 151906 - DNA, 281 bp, Homo sapiens
tttacccaacaatcacaagacagacattcttcctaagtgtacacagaacatttaccgaggccaaccatattctgggccatataacataaagggattcaagttatacacaaaaatcttcgaaaaatgcctcaacacttggaaactaaacagatatctaaataagctggacaaacaggtagaaggagaaatcaaaagggcaattacaaagtactttgaattgaatgaaaaagaaaatgctacaaatcaaaatttgggggatgccatgaaagcaatacttgtca

SEQ ID NO: 151907 - DNA, 366 bp, Homo sapiens
cctcattctccttgacccttctacagcatctgacaatacaacataaaaccctttgacttcgcttctgcaacactgcactggcatgattttccactgacctctcagaacatctcttctcagtacctttcacttaccattcatgtatctaaatgattctcaagtttgcattcacttcatgcagatctgcccctctgtacaaatcctggggataccgttcacacaaaagacaatgtgatcagtacccactggagctgagcaatggagtgtccctgtccttggatgtccctgtcctcaggccttaccacatgcttcttcctcctagacagtagccttcattcccacaccttgcactacaatacacacaca

SEQ ID NO: 151908 - DNA, 272 bp, Homo sapiens
ttgacacagggtcttgctctgtcgcgcgggctgagtgcagcggtgccatcttgtctcattgcaacctctggctcctaggatcaaaagatcctcttatctcagccccccaagtagcggggactacaggcacatgccaccacaccccactaatttgtgtgtattttctagagatggggtttagccatgttgcccaaactggtctggaactcctgagctcaagcaatccaccctccttggactcccgaagtgcgggattaaacgcatgagccaca

SEQ ID NO: 151909 - DNA, 146 bp, Homo sapiens
accatgccctctggaactccacatcatcttctgtgaaatttttgccttctcactctggaacctaaccttgtcctgaagccatcattttcccaaggtccttgcaagagacatctgttttctctcttacagccctactatcactaggc

SEQ ID NO: 151910 - DNA, 442 bp, Homo sapiens
cttttttgttgttgtaagtgaattaaaaagtttattagccatagaaaaaaactgactcctctaaatcaattattgataaatcccctgtaaaacagcaagcttacagaaaatttctctcatgaacggatagtcactatacttttggtccaagaaatgatgggttttttcctccttcttcagatgacagatggatgtaactgaatctacaaacgagtgtacttgccccaaatgtgcaacataaatacagaagagatgaacagaaggctcataaccaatactggaacaggaccaactttgagcccaggtgaatcttctgtgtagaatcgccacatccgccatgtgcctgccgaggtcgtgcggcctgcgctccttgtcccacagctggcatttttcctctgccggacagtggatcttgctgcccgggcggccacggctttgctgg

SEQ ID NO: 151911 - DNA, 530 bp, Homo sapiens
ctctccatactggctctctctccacactggcattccctattgggccttttcttgtcaatttcaagtccagccatagggaatttaaataacttctgttcgatttcccaaatgcattttactctgctgtggaaaatctcacatggtaagaccagatttcccttttagtttgcaggcgagagtctaggttgtgttctcacaagtagaacctaccctatgtttgtgttctgaattccctgcactttccatcagggctcccaagccccctgctctgtctagacctcccacctcagaaaaccctcccagccacaggtgggacatgtcagtagtccccagggtcagggcttgtcttgaggctgagcaggaaattctcttgggtaactgctttttattctttctctctcaggaagtgcttcccgtaagcattaccaaaacggttctgtcctctttccctcacaaactccaggaaccctagaatggtggctcctatctctgatcctcaccaaaagtccctttgaagaccaggtgtggtg

SEQ ID NO: 151912 - DNA, 626 bp, Homo sapiens
acatgctaaatcttggttaagtctgaacaaagccagtgctagaaagaagcccatgaagcaaagtataccatccactttcttaaacaaagccaagctaagccatctgttcccgtatcatcagttgttcttagcgtatcacttagtgaatcatttcagaaacaggagctaactgaaagataattaaaggttccagtggttcttagtgtcgaagcactagaggcattcagtaacatgagagaccatttttggtgtttcatgcctggggagtcggggatactactggcatttcatggagagaggccaggggtgatgtggtggactgaaaaacgtcctccaaaagactactcgaaccttcatttcagacttccggcctccagaaccatcacagaataaatctgtgttaaaccactcaatttgcggtaatttgtcagcagtcaaaggcaactaaaagtattaaacttctggaatggatagaacagtcctactgtaattgccaataacactaccactgagctacacagaggaatatgaagaagtgaaggttaactgaaagggaagaggaaaagtaaggagggctaaatgatgtaagtgagggaacagtgataaacaagtttagtgaagttaca

SEQ ID NO: 151913 - DNA, 198 bp, Homo sapiens
tctgtcatggcatgggagaggggtatgggggaaggaggaggtgataagaacgttgggcaagggggaaggcaggagagttttgaaagagaaagtgaaggaatgagtaaaaaaactctgcctaactagtagctttattaagtgcagctcccactcccaggactgaatcaccttgtgtataagcacggtgcgttggcccaa

SEQ ID NO: 151914 - DNA, 128 bp, Homo sapiens
ttctcccactcagcatggttttcctggtctggtcacgttgatacatttaggtttacttcattttcacagcttatgtattagtctaaagtaagcataactaccatgactatttatttgttcattttcct

SEQ ID NO: 151915 - DNA, 194 bp, Homo sapiens
tgcccctttcatgctctttgattaccacaatgtgtaaattatttggcttgatggtgtcccctaagtccctaaggctctgtttatttttttgtgatcaatgtaaaagttacgtattatatgtaaacattttaacaagttatggaaacaaaagttatgaggttcatttaactcatttaatatttggtttataacat

SEQ ID NO: 151916 - DNA, 904 bp, Homo sapiens
cggaaaccagctatttttggcccatgaggcctacaccaggtaatgttaacccagtccgggtgtttgcacaacatttatgatttaagttcaatgacttttttaattaccaccgcaacagatcatctctgagggaaaccagctgccatgttgtgaagacactcaagcaagccatgtgtgtgaactaccatgttgaaaatggaccctccaaatccaatcaagccttcaagagattattgatgtcatggccaacatcctgactacaacctcatgaaaaaacctcagcaaatgcttcctaaccaagcttcttctgaactccagacctatagaaaatgtgtgagataattgttcttcagcccagtcaagaccctaagaagatgggggtggaattctgcctcctctacacaaattcttgccacgacttagtgacacctttaatgaaccgagcactgggttaaagttttctctaattcttaaataactctgctagcactattcacaatagcaaagacatggaatcaacctaaatgcctatcaatgatagactggataaagaaaatgttatacatatacaccatgaaatattatacagccataaaaaagaacaagatcatgttctttgcagggacgtggatggagctggagagtatcatccttagcaaactaacacaggaacagtaaaccaaatactgcatgttctcatttataagtgtgacctaaatgatgataacacatgggcacatagaggagaacaatacacattggggtcttttcgagggtggagggtaagaggaggaagaggatcaggaaaaataacgaatggatagtaggcttaatacctgtgtgatgaaatactgtgtacaatgaaccccgagacacaagtttacccatgtaacaaaactgcaat

SEQ ID NO: 151917 - DNA, 1328 bp, Homo sapiens
aattgacataatgatgaagaggatatgatttttttcggcccatctaccctgaaatggctccatcattcatctctttctccatcccacttactcaagtgattctttcaacgatagtgccctgtccctaacctcagggtttagaaacatggccccaagactaacagattgcagtaacttagtccaaaggaggacatatgagccacaccaggtcagagaagttctgagagatttggtgttcagatgctgagagttgctttcttttcccctcatttgcaagctgagatgtctgcaatgagttgccaatagcctttgtttccccagaacaaagaaatcatattgtagcctgagaaaatgaagctgttctagccacttctaagattgttcctactgaacctcacctcttggtattcatgctgtcatatagtccccttccataataaacagggctaacatatgtaaccaatagcacacattgcaaaaatgatggtgtgtgactcctcaggctagttcacaagacttctgccttacactgtttgtcttagatcatctctgagggaaaccagctgccatgttgtgaagacactcaagcaagccatgtgtgtgaactaccatgttgaaaatggaccctccaaatccaatcaagccttcaagagattattgatgtcatggccaacatcctgactacaacctcatgaaaaaacctcagcaaatgcttcctaaccaagcttcttctgaactccagacctatagaaaatgtgtgagataattgttcttcagcccagtcaagaccctaagaagatgggggtggaattctgcctcctctacacaaattcttgccacgacttagtgacacctttaatgaaccgagcactgggttaaagttttctctaattcttaaataactctgctagcactattcacaatagcaaagacatggaatcaacctaaatgcctatcaatgatagactggataaagaaaatgttatacatatacaccatgaaatattatacagccataaaaaagaacaagatcatgttctttgcagggacgtggatggagctggagagtatcatccttagcaaactaacacaggaacagtaaaccaaatactgcatgttctcatttataagtgtgacctaaatgatgataacacatgggcacatagaggagaacaatacacattggggtcttttcgagggtggagggtaagaggaggaagaggatcaggaaaaataacgaatggatagtaggcttaatacctgtgtgatgaaatactgtgtacaatgaaccccgagacacaagtttacccatgtaacaaaactgcaat

SEQ ID NO: 151918 - DNA, 839 bp, Homo sapiens
ccaagactaacagattgcagtaacttagtccaaaggaggacatatgagccacaccaggtcagagaagttctgagagatttggtgttcagatgctgagagttgctttcttttcccctcatttgcaagctgagatgtctgcaatgagttgccaatagcctttgtttccccagaacaaagaaatcatattgtagcctgagaaaatgaagctgttctagccacttctaagattgttcctactgaacctcacctcttggtattcatgctgtcatatagtccccttccataataaacagggctaacatatgtaaccaatagcacacattgcaaaaatgatggtgtgtgactcctcaggctagttcacaagacttctgccttacactgtttgtcttagatcatctctgagggaaaccagctgccatgttgtgaagacactcaagcaagccatgtgtgtgaactaccatgttgaaaatggaccctccaaatccaatcaagccttcaagagattattgatgtcatggccaacatcctgactacaacctcatgaaaaaacctcagcaaatgcttcctaaccaagcttcttctgaactccagacctatagaaaatgtgtgagataattgttcttcagcccagtcaagaccctaagaagatgggggtggaattctgcctcctctacacaaattcttgccacgacttagtgacacctttaatgaaccgagcactgggttaaagttttctctaattcttaaataactctgctaggtaagttgccattattatgatcaaaccatactgaatgtttgagtaccttgactaagaaataaaactgggtttttgacaa

SEQ ID NO: 151919 - DNA, 351 bp, Homo sapiens
acaggatcttaggctactccacaaacagaggctactccactaacactccctacataaagaggcagggtgggcagtgaacacatatgccagccagctcagtcctcatctgacatgccatcaccttttgttggtaatttctaccctgcaaatctagaagttatgatgtgccatagcctttatctttttggaagggctgtccctgaacgcacatgaaaagtttcgaccgttttcccttgaactgccctctgattctgtttgacagtgtttgtggaggctagcatctgttgacttctgtggtcctcagtgcctgagcaggaaaggctggctctggctgtttgtggaggtagcact

SEQ ID NO: 151920 - DNA, 611 bp, Homo sapiens
tctaatcctggcatttctgcattttatgtactttccccaccttttgtttgtttagctattgacttaggtaatagtactaacagtaatggcccaagattctgtttgttgttgtttgtttgttggtttgtttgtcactaagttggttacagacctagaactagtccctggcaactcggaagctgttttttcctgggtcaccttggggaagtgtcttgggtgggaagaggacagagggaaggacagggagagcccaggttactgatatgctggacttcatcctcataattgcctttgtgccactaacactccctacataaagaggcagggtgggcagtgaacacatatgccagccagctcagtcctcatctgacatgccatcaccttttgttggtaatttctaccctgcaaatctagaagttatgatgtgccatagcctttatctttttggaagggctgtccctgaacgcacatgaaaagtttcgaccgttttcccttgaactgccctctgattctgtttgacagtgtttgtggaggctagcatctgttgacttctgtggtcctcagtgcctgagcaggaaaggctggctctggctgtttgtggaggtagcact

SEQ ID NO: 151921 - DNA, 176 bp, Homo sapiens
tggtacagaagagggaagaggaggaaggggaagggaaaatgtttgacaggtttgtgtttgaaatcctgagatcaatgtgtgtgtaaatggatctatggtttagaaaagaaatcttagagacacaaagttgggtgttatcagaatactggaaatagataaagccacatatacaataa

SEQ ID NO: 151922 - DNA, 870 bp, Homo sapiens
atctaggctgggggctcagggacgtaccccatcctttttcaacctgcagagcctggtcccatatacaagacaacacacccactgaccatcagggtcctgtgctgacctctgtatgtttctggtcacagacatcactcctcttcctccacccactggtcccatcaaattctccccttactcctacagttggcaagacctggagctgggacagtcagacacttccccagcatccccaaccactgtaacgccagctcctgccagacaacaccagtggctggcatttatggagcgcttactacgggctcagtaactctgccctgcaaccccacatcactcctatgagcgaggtgtacattagccccattttacagataaggagactgacacttagacagattcaataacttggccaagatctcatggctgacagcggtcagggcctgtatccacgcagccctgaggctgtgttctcaactccttttagtcaggctgcctgttgggcatctgattcctctattttctctcccaggccagcttgtgttctagatctacatgtcttctggtatttgcaagaggctccatttcccttctaatttcctagaaagtagatagtgaataaaataatcccaggagaaggaaaatggaaattatcttgctctgaggtccctgtgatattgtgagatgtgtatttggtcttcccggcatacactcctaaaattcttggaatgttcaaagtgaaaagtgtctttttgtatgctaatgagttgattgatggtgagcagcccctagtagcttcaggctggggcttggtcaccagagggaccaaggcaggattagagggttaggactttcagccccaacctccagcaa

SEQ ID NO: 151923 - DNA, 196 bp, Homo sapiens
attgcctaaaagaagagaggaaacacgaggcgactggggtgcaactttgtttgtttgtttgtttgtttgttcctttatagcgggcttaggggctgctcaaggggtggtgagatgaagccgtgagtcaagctggtgggtttgctctccccgctaccatcacactcggaaaactttggaaaactttgtccagagggag

SEQ ID NO: 151924 - DNA, 473 bp, Homo sapiens
gacagctctaatgcaatcagcagaccttatcatattgctttaacattcatctgcaaatgagattctgtagtcacttcccagtttcagtgtctgttcttagattggcccgctgcactttgtagttgagaaactgtgggcagtgttgtagttctccaatttgcagagctgtcagaaaccagctgccttccttctacttcctcccacagatactgaaactatgtggttcagtggtttgtcctcacttagttgtattttgaagttcatagagataccttgtcatctagcgttgtaatagtgtctgtggctatcctagttgctctgtattcttatggggagattagaaaacaacactgttgtcatcattttccctgaggttaaactgttaagacctctttctgttgtagaagagaggttttaattacaaaaataattttatgatcattataaagaacctataatttgaaatttgctgt

SEQ ID NO: 151925 - DNA, 598 bp, Homo sapiens
ttcagggtcaggttgttttgattttgaatcttgttattactcattagccacgtgactttagcaagctttttagctttcagagtcttggtttcctcatctgcaaaataggactaatattatctacatcacagaaagggatgcaaaacacatattataatagataatacttagtacctttgcaataagttgtaatatttccaattatcaatgtaggtcaacagcaacccggcaccataaaatgttttatatcttaatggagatctagcataattctggtttgtgctttttaccccttagaaaaaaatgtaactgctgacagcaaggtgaagacttaatctttagagccttgctaaaaatacattttaaaattctttagaagcaaggcttacctcactgggcacttaagaaatgttgattatagagaatcatcgtgatcagaagactgttatgttagaacaacaaacataactaaggatgagaaaacgttctctgctattcagacactaagctctagcataataagcaggctgagcataacttcatgtcaagagagaacaaggcttttcttacatactttttcaggctcttcagagagtag

SEQ ID NO: 151926 - DNA, 342 bp, Homo sapiens
tatttttaatagagacggggtttcaccatgtttcccaggccggtcttgaactcctgggctcaagccaatctcctgcctcggcctcccaaagtgctgggattacaggcgtgagccactgcacctggcctctccagccacttgactccatggagagggacttccccaccctgcacttcgtcctcccaggcagagggtgacacatctgctccatgggtctgggagaagaaactatggtcagccatcctctctctgcacactgggtaagaggcgtgggctctgtcctcattgtggagaggggcctgtgttttcctattcctgcaagggactcaatagatacttttt

SEQ ID NO: 151927 - DNA, 133 bp, Homo sapiens
tccaagagagatcttcaataaaaataattactcgtgtctgtttatttatatctgtctgtctagctagctagctagctatctttttatttatgtgtctataattctatcagtcatctatgtatcatttagaact

SEQ ID NO: 151928 - DNA, 339 bp, Homo sapiens
aataacagaagccctgagaagctaagggcattcccgccagcttcaaggctaatgtgtagacccacagggcttcccttgccctagtctagaactctctcccctgtgccatgttggtcctgtgggttcctgccctttgtaaccggtcatttaaggccctgcccagtctcccccaccccatccagccctcctcacagacatcaatgtctaccttttccatgaatcaggacctgagaggccagaatctactcggcagaatacaccgtgctcagtcctcctctgcacctctcctgcccttcctatgtggaggggtctcccagtccctccataccctgaattgtg

SEQ ID NO: 151929 - DNA, 458 bp, Homo sapiens
acaaccggggcgcagcgggaggcatggaggaaacgctccagcagcccaacctcgccagggcaccgcgcaggagaggcgcggcctcaggcaggcctgggtccagcccgggctcacccctcatcggctgtgagatcctgccccttcccctctctggcgtccaccctcttatctggaataccgggacagcgaccctcccacagaggaaaacgccgcgtgctggccgggaggacagggcccatctttggcagctctgatcgcccacgccaggagctcctcaggcaccagctgcctggtgctcacaggcgggcatcaagagaggaccatcattccccattttacagatggacaaaccaaggccaccttctccttcatcacctcagtctcggcacagttccagggatgccagggagaaaggcagctgtagcccagggcgaggctgagatggagcaagaaggcag

SEQ ID NO: 151930 - DNA, 384 bp, Homo sapiens
  misc_feature (128)..(128): n is a, c, g, or t
tctagatatgctgatctcattcttcagctgaattctttaaagcttttcactaaaagccggtataacacgtcttacttctgggaaggaagctcacagaaattaaactttaaaaatatttctactatggncggatgcagtccctggcaccacaaaggttggggaccgctgttccaccacggaaattcattgtataaagtttactcctccccacatctctgtaaaaaactatattcagagataaaatttggaaaagcagagttctcactgccacgttagttagaagaacaacattcccccatttattggcctggcactgcaaaataaaagtggcaaagtgacttgttttgaacttgtaatataaacacttcaaaaagctcctctcac

SEQ ID NO: 151931 - DNA, 132 bp, Homo sapiens
caagagaataaagcaggacggtgtcccgggctgttgaaagagcagagcgctccgcaggagaagctcctttcatgctgcttctggggttctggggtttggtggcttttctgtttgaattcgaagtgatggtga

SEQ ID NO: 151932 - DNA, 407 bp, Homo sapiens
attgatatttatcatctctacaattcttataattatatcatagattattaagtattagcactcaagtatggttcacattagatagtcaagaaatgtaaataagaagctgaacacttaaaaaaaactgagaactccctcataagacagttttaaaatacatggagcaaacactgacaaaactgcaaggaaaatagacaaagccacaattatggctttcggtacccttctctgaataattgataaaacaagtagatacaaaatcaggatacagaagattcaaagtactaatcaccttgatggtgacagccacttatagaacagtctattcaacaacagcagaacacacgtttttctcaagtgcacccagaacatttattaagatagactctattcctggcattaatcaa

SEQ ID NO: 151933 - DNA, 211 bp, Homo sapiens
ctaaactctccggagcaaaccctccttaacaccagatccgactggcatgagtctcctgccaggtaagagccctaccaaagagggaaatgctatttgggcaactccccttcatattccagtggccagaccacgtcatccccttctgactgccaccaaaagaaatcacatgccgtgtagcctcacagaaggcacaaaggccttgagattcatc

SEQ ID NO: 151934 - DNA, 194 bp, Homo sapiens
atgacagaagggatctcattataggtcttacagactttaagaagaaaataagtgggtattatcaaccattttatgctaatgaattttccagttcagaggaaatagacaatttctaagatacaatttaacaaaactgatatgtaaagaatctgaaaattcctataatctactagaggaatcacatttttaataat

SEQ ID NO: 151935 - DNA, 579 bp, Homo sapiens
ggccaacccccaggctctcatcgtggctgctgccccagcatccgtggcagcccatcgctacagcattggtggggacatctgcaggctctgccggcctggagccctgccctgcagctggtgaggcacccccacaaggtgccagagaccacctggtccaaccatcacttcccacacaaacaaaccaagatgcaggtgtttagttaggcatcaactagcttgggttagtatccgttgcctccggcagctcttcctttcctggtctgaggggctccagtgagggctccaaacagcccagagtcttattgcttgtatttgaaaacaaatgcacaaagccgcgggaagggcaaagccctcccagcactggctgtgcctagtccctgcaatctgacctcactgctccaatgccattagctccagaacaactcctcttctccagcagcaaggacttcaggactcccgggcagacccacgcagggcagcacccctgcagatccaagcctcatgcactctcttccacacctgggcccctgaggctcctccacggactgctgcatttcctatttcttccaagacaaaatg

SEQ ID NO: 151936 - DNA, 243 bp, Homo sapiens
ctcacgcccacctcaggagcttgcactgtgttcccttgcctggaattcttctccaccagatgacaagatccctcactctcttccacccttagctcttttgcgcaggtgtctccgtccccatgaggcatccctgaccgcctatcaaatcttaccacttcctgctcgctcccctgacatttcctctgcatttctctgccttgttttctacccagcacttgatactgacttgaatactgcatgttt

SEQ ID NO: 151937 - DNA, 569 bp, Homo sapiens
ctcaaatattagaggctactttttgaaaaaatgaacccggccaggcgcagtggctcatgcctgtaatcccagcacttggggaggctgaggtgggtggatcacaaggtcaggagttggagaccagctgggtcttgaactcctaggctcaagcaatctgctgcttcggcctcccaaagtactgggattacaggtgtgagctactgcccccagccaaaaggccataatttttaaatcctgaaattttaattgctggggacaaatttcagagctaccttattttttggtttctttggacttatttcactatagctcagaggtttaaaattatacttgaatttttttgttatcccagtagtaatttgagatcttcaaaaaaggatatttctcctacttttattgatttggaccagagcttaggttggaacagagaaggaaagatggataatgaactgaactgaaaattccaagatcaccataaacctaaatcacatcttagaaatctgggagacactactgcttcttagggcatgcttggttttcttgttgacaacttttcccccctcatgcct

SEQ ID NO: 151938 - DNA, 805 bp, Homo sapiens
tcctcgcctcccgccgctccatctgcatgcaccccacaagtgtcaggtgaggacacagcgttcccccctctggagatgctgcaataaggcgccattttggaagcagagagcagccctcaccagacaactgagcctgctggcactttgttcttggacttccggccttcagaggttcctcagctgctggattgcactctcaaggcacgactttactccctcactctacagctcaaacaccttcagtggctcccactgcccacagaaccaagtacaaactccttggtaaggtcatcagatggtcttactccttggtaagatcagatggtctctctgaacaacaggcagtgtaccctttagattctcctcccattatcccagcctggagtccatgcgcaagcagagaggacaggcaggcagtgctgaatgcactaagcccagtcagcacatgcccttccactgaaatgatctatcactctcattttgaatgtggcctcctatatgaaatctcattctcccaggccttttctctatttctgcatctctgactctcctttcagtgttcatcataagagtctccatgggaaggctaattgagtttcaacccctttccccaagatgcctaaactcatgcccctttctcctgactggacaacatcaagcctccagagagaataatctgccaaatggaggcactggtaagcaagacccagcatcccgtgtgaaagggtagacacaagcccagagaaacaagggttttagaagaaaagtagctagttatcctaaaatttatcatcattcaatggcc

SEQ ID NO: 151939 - DNA, 204 bp, Homo sapiens
tcctcgcctcccgccgctccatctgcatgcaccccacaagtgtcaggtgaggacacagcgttcccccctctggagatgctgcaataaggcgccattttggaagcagagagcagccctcaccagacaactgagcctgctggcactttgttcttggacttccggccttcagaggtgtgagaaataaatttctattgttgataagtt

SEQ ID NO: 151940 - DNA, 310 bp, Homo sapiens
gatggctagaccagctttgggccttctcaggggagacagggagagagtgagggaaataaagcacccttcctttccaaaaaagcaggatccagctgccctctgacaagggattgtgtggggtggggtggggggacccgctgaggcccttgaggtggatgggaggtgccacagtgagacctgggtctgacaccaccaacttgcctcagtttacccatctggaaccaaaggggacaggtgatgtacccataatgtgcttgctcaaagtctgtggttggacgtgagcaccatgggcaggccagagggcatttat

SEQ ID NO: 151941 - DNA, 362 bp, Homo sapiens
acagtgaaccatggttgcgccactgcactccaacctaggcaacagagcatgcccatgtctcaaaaaaccagaaaacagaaaaggaaactgaacaatatagatgacagttatggcctatataaggaagaagcaaaactctaaaatctagaatttgctctatgtcattaagttagagaatgactatatacttcctatatatgttttaagttaaagtatttgaagagagagacaggtgtatgtgtgtgtttctctcctttaacaaacttatttaaatgttcaactataaatcctcattgtgtttattaaagagtggttctactctatttaaagatattgatgatttttgggaagtaacctcttgg

SEQ ID NO: 151942 - DNA, 630 bp, Homo sapiens
cagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacacatcaccaagatagcctagttaatattcttctctttctgaagtagttgaattgggatagacagcttgccaggcctgctgccacttgtcagcatcgcatccctacattcaaccacacttgcatctaacgaccgtctctttcattaaatttcttttgcaccttttcttcctgaatgagtgcatgatagttaattttcctgtgcacttgcatgtctcaagaaggttttaattctttttgtattgcattaatatttaagttaagtttataattgcaaaatgatttatactcac

SEQ ID NO: 151943 - DNA, 689 bp, Homo sapiens
taaaatactttgtgaagtatagattatagatcatactattacctaagtattcacttataattagtatctattcttgttagtttcctgttgcttaggtaaccagttaccacaaatctagtagcttaaaacaacatgtatttattattttacagttctagaggtcagaaaaccaaaatccacccaactgggctaaagttaaggtgtcagcagggctgactccttctgtaggctcttgggggaatccaccttcttgacttttctggctttttttttttttaaattatactttaagttctagggtacatgtgcacaacgtgcgggtttgttacatatgtatacatgtgccatgttggtttgctgcacccattaactcgtcatttacattaggtatttctcctaatgttatccctccctcttccccccactccacgacagaccctggtgtgtgatgttccctgccctgtgtccaggtgttctcatggttcagttcccacctatgagtgagaacatgcggtatttggttttctgtccttgtgaactgtcaccttttccggcttttaaaggccatcctcagtccttggatcacagccatgcatcatgttgccttttctctctccttcatcttttgtcacattgccttctctttgacctttgcttctttcttataaggatccttatgattgtatcaa

SEQ ID NO: 151944 - DNA, 156 bp, Homo sapiens
ctcatcaggtgggcactatgtgttgcgcgtgtaacaaattcccaaactctcagaaggtgggacgccagaaattttcatattttttccataaagagtttaggcaccgagctactcttacataggtcattgggctccttccccaaatccgtttcccag

SEQ ID NO: 151945 - DNA, 115 bp, Homo sapiens
agtctgggaagtcaaggttgcagtgggccactgtaggtcgtgttaagaattttcattttcttaacagcaatgagcagccatagaagggttttaaggaagtggaagacatgttcag

SEQ ID NO: 151946 - DNA, 183 bp, Homo sapiens
agcagtgactcccaaatgcttcatgcctacagccaccactgagccaaatggtgggtcgctggatgcatgttcccatagggacaagggcacaaagtgatgaggaaactagtccagtccacaagcccctaaagatgacatgattatgttttgtgggttaagaagttacataacacacaggccggg

SEQ ID NO: 151947 - DNA, 615 bp, Homo sapiens
caccatcttctcagctctcactttgtacagtgacgatatcacgctaaaatgtctaatgaagaagtctgtggctgagactccattcctaagtcttccacaaagatcagaagaataactctagaagaaggccaccttgtccatactattcagctccagctcagtaataaagtggttctactcaggcaggagagtgaagacgtgagaactcttggcccctttctcctcaggctgggtgacttaaattattctgtcttcaagtttactgattcttctgtcagctcaaatctgctgttgaagtcctctagtaaatttttcttttcagttattgcactttcgagctcaataatttatggctggtaccttatcatttctgtctttttattgatatccgcgttttgttttttcttgcttccttttgttatttgtccaagttttattttagttctctgagcatatttaagacagttattttaaagtatttgcctagtaaatccagtgtctggacttcttcagagatagatgttttggtttttttaataagccttttgattttttggttgttgaaactaggcatttgaatattttaatgtagtaactgaaatcagagttttctcc

SEQ ID NO: 151948 - DNA, 267 bp, Homo sapiens
caagccccacatggagaaagcgacccctgtgaggcccccactggggttcagaaagcaataccccaaagtctggcactttgatatgcggagaggacttagaagctgcccaagaatcaaggtccctgtaaccttaccttgtcctcttccccctacctacatcaagtgcagagaagagctctctgaaatttccttatctggccaataaagcttctttccaaaggatatgaaattgttttaagacctcctgcctagggatcccatcaagta

SEQ ID NO: 151949 - DNA, 466 bp, Homo sapiens
tgaggaggagacactgaggcaggcaaggcattctgcaagcttttgcagagttttcatggacacattctgattcccactgtgtccaggtgggagttctgtacacatcacagatggaaaaaagaaactctctgtggatttggcagcaccctggattggatgtttgaagaaagctattgcatctgccccgtatcttctgtgaatcgggtacctttatgcttctgggaggtcaagaagaacccagaaccctccagtgacttccctttgggtcttggcattatgagaagatggttaacctcctttatagaactctccttcacatccaatccttcagaaagcctaattgatcccatcttcttaacccaacccctcccctggacatcgttcctaagccccatctctcttatttcgctttctcatggttctagaggccagaagtgtgaaatcaaagtgtccgtggagccacgta

SEQ ID NO: 151950 - DNA, 283 bp, Homo sapiens
actaccaaatgttctcagagaacagtgtcaatgccacagcattccactgacaagctgatgagtgaccttcaactaaatatcaagtatggggaactgatgaaagaaaaccattgcttcaaacttagtggtttcaaggttgtaatgaacattatgaaattcaatcttgagagtttcagaagccaaaggctaaaaaagcagagctcataaagactgtaattccaagtcaaagtttagaaaaagtatgattgtggaagatgaaatttcaactgatctctaatttctg

SEQ ID NO: 151951 - DNA, 136 bp, Homo sapiens
tgccaggtcatgttccaggtaccagaaacaatagcagtaaacaaaacaaagaccttgctctcacagaacttacatactagtaggagaagaaagaaaagaaatataaacaggtaaatacatagcttgtcacataaat

SEQ ID NO: 151952 - DNA, 108 bp, Homo sapiens
agttgttagtggtgctggtgttgatggtggtgctggtagaatcgatgggtgccatattggggttgacagagttggttgctggtgggattggagagtttggtggtggtg

SEQ ID NO: 151953 - DNA, 211 bp, Homo sapiens
aagtagagaagctctgcctctgtcatttagtagattgtgctttttgggtgagatttcatttgagtgagggggatctctgactttacaaatagctgtcattcacttgctccatctaagggcccgcttctcacccggcaccacctatgagcctgcctcattcccccttgctgagcctgagaagaaatctactcagctgtgctacctcaggtca

SEQ ID NO: 151954 - DNA, 144 bp, Homo sapiens
actcacagttccgtgtggctggggaggcctcataatcatggcaggaggcaaggaggagcaagtcacatcttacatggatgacagcaggcaaagaaagagcagcaagtacacaggccctgagtagggagtggcctggctggtgag

SEQ ID NO: 151955 - DNA, 157 bp, Homo sapiens
aatcttgtttcatctatatatacccccacccagattattttaaggctaattcccaaagccaataaatttttcccataaatatttatgtatttatgtctaaaagaaaagaatcctttaaaaagtatatctgcaatgccattatcacacctaaaagaaa

SEQ ID NO: 151956 - DNA, 254 bp, Homo sapiens
atgcagttaggtccggtgttaccaagtcagcccagaaggcagcgagaccatatggatgtgagccctggaaagcagtaggcacatccgggctcaggtaggggctggcctggcgtctgctttgtggggaggaggggttctgttgagaggccccattgttgacatgttttctcatccagacgctggacacccgggtttttgcagcctcttcttacctgttgatagtcaattaaagatggaatcagtgcgtggctggc

SEQ ID NO: 151957 - DNA, 294 bp, Homo sapiens
gtctcttaataaatagcctcctgaggcagaacagtgaactgggtgactttgtgaacagggtttctgagtgtgggcacatcagtctcaagccccgttttggctcttaggaaccaccctattaacaagcgagttcctgctgggtttcgctcatgcctctgttgcccgtgggattaaaatgaaaatttagcctggaacgtgctctgcctcgcagttcagcccgcagagctctagtgacttttctgcttaatggttgggttagttcaggaaactacaaagtctgtgttgttaatttaa

SEQ ID NO: 151958 - DNA, 390 bp, Homo sapiens
aggcatgaactggaaatgcaaaagctggaagtgcccaagagagaggtgtaggtgcccagggagatcttggctcctggtgctgagaggatggtgaccaagggccctcgacctccctggctctgcagtagcccgtgtcctcctgccatgatcaatcaatccagaactcaatgagaggtgggccacgtgcccctgaaatatgatgagtgagggctctggaggggaacttgcaggaacagtgaaggatactaaggatctccagtcagaggtgcaggcagttggtgtgaccccccgacccatggcggggggatgctgctggggcacagaacatcctgctggctcaaggccatggatgctcatccctgctcctctggctacaatttggggccatgt

SEQ ID NO: 151959 - DNA, 346 bp, Homo sapiens
caccgtcttcagtgctttactgtgaatgaggtgctactactgttgtcatttcgtagataaggaaactgaggcatagagaactgaggtcacttgcccaaggctgcaccatggtaagggatgtggcagggattccacccctggaagccagagtctgcctgcccacttcacctctgctacactgtgtgtcctccctctgcccgtcctgccacccctgcctcccagtctccaccctgagctgttgggatgctcatttgaggccatgactatgatgctgttgtaggaacagctgctcccttgactgctgagggtcgtgacagtggcctcacaacctctccctttctggcaa

SEQ ID NO: 151960 - DNA, 203 bp, Homo sapiens
tggaatgtgctggtgcttcaaagtgtgccatgtcagactctctccagttggtggccagtggagagacgttaggaagggcctggggcctgggtgggatagccaggaagagtttcttggtgttctctatcttcccctccctggtggggtcttcccttccacccagctgcagagatctggacaggcacagtttggaagcagtcact

SEQ ID NO: 151961 - DNA, 255 bp, Homo sapiens
gaacccaggaggcggaggttatggtgagccgagatcacaccatcgcactccaccctggatgacaggagcgaaactccgtctcaaaaaaaagaaaaaaaaaaaaatacacacacacacacatatatacaggtagcacatcaaacacatgattttataggttttaattgcttataagtttcccttatacataaatttcttgaagctaaaaaaaaaacaggaagaagccgagcataacctatgcctacagtttcagct

SEQ ID NO: 151962 - DNA, 378 bp, Homo sapiens
tgttatctggaagttggcccacaaagtaaagaaaattgtgctctgcctctaattcttacttcacacagcattcaatacaggatcttgcacacactgtagtatcaattcaacctatgcctgtggattgaattaagttcatgaagggaactaagcgaacgttattgcctgtagaatttagacatgctctctttgggaagaggattttctagatctacttctataaggccctctgctagacactgtgggctgtggggactgcctactctgccttgctaatagaacactgcttttttttaagtctcgttctgtcacccaggctggagtgcagtggcgctatctcggctcactgcaacctctgccttctggagaactttgctt

SEQ ID NO: 151963 - DNA, 345 bp, Homo sapiens
aactccctcccttctctctctttccctttccctattttggaccctcattgaagagtgtctaagcacagagacaattgcaggtttctggccacgactatactctgggactgaatggtgggactgaagggtccccatgtggaagcaactgattgctgctgcctggttcgggtgagtgacctgaatccttttctcttttcagtctttcagtggccatttactagtatctctttgacaattgagggtaactggccagggccactctccggagttgtctgaaggccaaaaagtgaacaaggatagccgctctgcccagaacgagggaaggctctctcctctcttttctgg

SEQ ID NO: 151964 - DNA, 321 bp, Homo sapiens
ctactactcattatttttactactgtagatccatggacacattagatccattggggatgagcgattctccttttatatatttacttccagtgaatatggtactgattttctgtttcctgctaaaatatacatttatggtgaatcccttgaaagccactttgagatgatcataattcttattcaaataagaattgaggtgtgtttgtgagagaattgggatagaaatgggggttaatgcattcattttggaatagcacatgtaagtgttcatctctttggaggaaaagtgaagctgaaacaaattttcatgggaataatgga

SEQ ID NO: 151965 - DNA, 121 bp, Homo sapiens
ggaaacaggtaattttgaaatttttggaggatctgtggttaatatctgaaccttatttacaatttctacttatttataaatttgattaaaaattagcatatcttaattaaatgttgtttat

SEQ ID NO: 151966 - DNA, 319 bp, Homo sapiens
tagctgggactacatgcgcccgccaccacgcctggctaattttttgtattggtagagacggggtttcaccgttctgtgggtattttaaagtaaactctaggacatttttaagtagttggatttttaaaaattgtcccacatactaagttacattttttacacagttgcagcacagtacttacctttgatcctcgtttgagcctctggctttctttagcctgcttaagctctgtcctctctctctttactcttctattcaaagagtagtatgtattttgtaaagattttgtaatcttgcctactaataaagtttacattc

SEQ ID NO: 151967 - DNA, 270 bp, Homo sapiens
gagtattgaaatactcctaccttcacaaaacaatcagatttatggttacttttaaattgatgagacttgtgggcatgtggtgagataaatttatgaccagcatgaatttcacttttaagctagcaacttaagatcaactagtgaaaagaacttggcttggccctaagcaagagaagcagagaatctcagtttcccttttgtacattcccacttgcccatggtgccacgatcacctcacccaaagctgggtctctatcttgtatctcattc

SEQ ID NO: 151968 - DNA, 313 bp, Homo sapiens
ggacgccaggggacagggtcagaaagaggcagccacaagctgagcacagctgcagaggttttagcttgcttactacatttgaattaattgccaaacttttaaactcaggggaattccacaaaaatctaggtaccagcttttcttgaagacaacggaagctcaggccaccctgaggccatcacctctggcagtcacctgccaagcacgtggctccagcttagcccgagcgcctccacctgccccgtcaaggcccagatgcagtggcccttacccatcacacttgcgctgttctgaccacagactcacagtcatg

SEQ ID NO: 151969 - DNA, 285 bp, Homo sapiens
ttttgtatttttagtagagatggggtttcgccatgttagccaggccgatcttgagctcctgacctcaggtgatccgcccgcctcggcctctcaaagtgctgggatacaggtgtgaggcactgtgcccggccaaggcctgcttttcttcaagctttttcacttttccaggctctggcatctgctttgaggttcaccctaagtgtcatttaaggggagaaggaaaggagagagagaaagagagagaaaaaaaagcataaggcctgcaggcaatttttgctactctga

SEQ ID NO: 151970 - DNA, 138 bp, Homo sapiens
gagagagacgaatatccgattcagtaaatacgaaccttcagcggacgcctgaggagagcaaggtgcgttggcccggcaaaggctctgagaaggtctgcattgagagcttgtgaggcattgcttaacctgatgtctctg

SEQ ID NO: 151971 - DNA, 303 bp, Homo sapiens
aggtctccatgacaactgccaacgtgtcctgggaaccaggctatgatggaggctacgagcagacattctcagtttggatgaagcgggcacagtttgggccccatgactggctgtccttgccagtgccgccaggacccagctggctgctggtggacaccctggagcctgagacagcgtaccagttcagcgtcctggcccagaacaagctgggaaccagcgccttcagtgaggtggtcactgtgaacactttagcattccctattacaactccagaaatgctggtgctggtctcccccacgaggt

SEQ ID NO: 151972 - DNA, 337 bp, Homo sapiens
cccagggctgatgccgtgaaggatgagggcatcccggcacttgtgagaggttaaaatgcttcatgtggagagcggaagtacccaggacgaaaggatgcactgtcatcctgctagaaggacggcagcatgggtgccggcctgttgaggcatccgctctgcaggcccctctgctttccacagactgacccaggctgcccagctgttcgggctgtctcccagggatctgaaagaggctttgtgtgaggggtgggctcacagcttcctttccagctcagtcagacaggccaaggctgtgagtcgcacatctttcaccagggttgagagcatcagccaaaat

SEQ ID NO: 151973 - DNA, 361 bp, Homo sapiens
cagggtgtggtggggacaaggaaggtgtgattatgagcttgcagaagtcaaggaggagggacatgggagcctcactttgaagaatcactaacagtaataataatagctaacattcattgagggtttaccgcctgcctaattctgtcctaagtgctttatgttcattcattccattagtcattcagccagtatttattaagcacctacattgtactagtttttttgtttgtttcttttgttttgtttttgttgttgttttttgttgttgttgttgttttctgagacagagtctcgctctgtctcccaggctgaagtgcagtggcatgatcccggctcacggcaacctccgcctctgcctcct

SEQ ID NO: 151974 - DNA, 362 bp, Homo sapiens
tgcaggaacctggatctaaactctagccaggcctggctcattttatacccacatatttctacctccttaggtagtagcatctttgagagggccacagaaaaagcacaagccctcacagaaagaaccagacagctgattgtctaccactagggcaatttgtaaggattgtctgccaaagaagtcctgggaagtccaggaacctccacacatacctgcagagacagaggtcactgttaccatatctggatgtcaaaaaggtcttttggaaaccaaggttttatcctttttttgttcttcccctcatctcctcacccccaacaccaagggttaaattcaacatcagtagctgtggcacaagtcct

SEQ ID NO: 151975 - DNA, 112 bp, Homo sapiens
tccctcaaattcctctcctcactgaatcttacttatatccaattcatctgcattcacgctcattaaagtgctctctcttctgtttaaggttaattcatctacttgagccagt

SEQ ID NO: 151976 - DNA, 287 bp, Homo sapiens
agtaaaagtccatatggtgggctgagatgaatcagctcaaggcaaactgccctgggatttttgtgttcttttaaaacattaactggaatcacgtttcatttcacccgttttgaggcttgtaagctactcatttgactattctcaatgaaacttcccttcctgttttcctgttttattgctattgttaattgcttaaaattctgctgacactaaggaaatagctgttcatatatacccaagagaatcctgctatttcaggcccaggagtcctacagtgaggacttgtc

SEQ ID NO: 151977 - DNA, 325 bp, Homo sapiens
aaatttagaaaaagaataattttaacagcttaaatttttcctgaagagtttaaatttaaccgcctgggttggtcaaattttgtttgtttgtttctttgtaattgtagaattcaatagctatgatttaaaatggacatttttttctcctgtgtttaaaacagtgtttctcaaattatgagccatgaactttggagttaaacagggcaggcttgagagagtaagagaaactaaagctaaattgaccaatatcctccttatttggtttcttcaatttctagtcacttctcattaggaaatcacagggctattgtttaaataaaaccaa

SEQ ID NO: 151978 - DNA, 500 bp, Homo sapiens
cccgagtagctgggactacagttgcccaccaccacacctggctaattttttgtatttttagtagagacggggtttcatcatgttagccaggatggtctcgatctcctgacctcgtgatccgcccgcctctgcctcccaaagtgctgggattacaggcgtgagccactgtgcccggccaatgccatgtaatgattagcttatagaatgtgacagaaagtttgaaatgatagaatgatatggtatttaaagagttctaaaaattgtttgaatttagtagactatctagtcctccttagatgaaaagtcagattcagtgtcattttactaaagtccatactttatcctcctagaggagttcctgggtgcaaaattgtgtgagtatatgtactcttacgtgcatttgggagtgggggtggataggttctatagatttttttttcaaaaggttccttgatccacacctcatgatttgaagatattttgctgttgtgataagtgat

SEQ ID NO: 151979 - DNA, 402 bp, Homo sapiens
tcctgcaaaagtctatagaccaaatgttaaaaaaagactcctttttaaaaacattaaaaatatttctatgatcaatagtgcaaacaatgactcctttcaaaacattagtttttaaaattcacgtctttattgtagacaccatttcccattccatgcccttaaatatactgtttatattaatcttggctgccccactctttgagtagttagcaaattctacccgtttctgtgtactatgtacagccagcacctggttgtaatacaagacttagtttctgctctacagcggtttactattgagtagaggagataatgcagtaaacaagaagtgaaatcttatgtggtaggtgttctaataaaggtatggaagggttttgtaaaataagtaattcttaagagaat

SEQ ID NO: 151980 - DNA, 383 bp, Homo sapiens
gtcagagtttcatgctgctgataagacatcccaacactgagcaatttacaaaagaaagaggtttatggacttacaattccacatgctgggaggcctcacaagcatggtggctcatgcctgtaatcccagcttctcaggaggctgaggctggaggattgcttgagaccaagagtttgaggtcatagtgagctatgattgtgccactgcactccagcctgagcgacagagcagaaccccatctctacaaaagaaaacagggctggaaaggtgcattggcatcacattgtaagggttgttgtgtcatgctaaagaatctggactttaagactggcaatgaggaaccagaagatcggcttcacagtcaatccacttaggctaaaata

SEQ ID NO: 151981 - DNA, 300 bp, Homo sapiens
ctccccagaacaatactcaaataaatacttgagtgttggctgtgtatgaatgcaccactgctgccttcctgatctcccatcatacagattttatccctttaaatctgcttcacatcaaaacaccagtcaggtggtcaattcctttactgttagttctcaaaactgacttcttaattattttaatcatgaataccaacttgaagaattggagcatttcaaacgtcttccttcactgcatctgtaaataagtccttaatctgttccataccatgagtctcctttcctcctcttccttgacat

SEQ ID NO: 151982 - DNA, 258 bp, Homo sapiens
  misc_feature (235)..(235): n is a, c, g, or t
aaaaaggttattcaatcatttgttcattcagtcaacaaatatttactaagtatatgctatatgcaccagtcagtattctagcactgaggatttagccattaacaaaaacccctgctcttatggaactaacagggagtgggggtgcaaggtgaaaggcctgaccaataaatatgccagatggtgataaatgctgtaatgaaaaatagagaaaggggttgcagtgtgtggtgggggnagggattgctatttttaaataga

SEQ ID NO: 151983 - DNA, 287 bp, Homo sapiens
tcacaatgtatcaggcaatcaaatagccaataacctattctcctgctaaattccataaactggatggggagggtagataatgttcatttttgttacttaccagggaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattc

SEQ ID NO: 151984 - DNA, 474 bp, Homo sapiens
ccattatcactgtaatctagtaaacagtcttttaatgaggagcacggccagacattagatatctgctgataagatacacattgcctcctttgatatattgagacaaaactgtttaccaccttttaaaatattgccatattatttgataagcccataggacgagatcactggggtggccactaaagcactgggtttgtacacaaaaaccaactgcaaaactggattagatatgttaactcactgaactcaatacctgcctttaggatggttcctgttatctcctaggatcactgtggcccattcatcccccttgtcagaaaaagagacctttagataacttaattcaaagaggagagaaactggacctgagtttgtgtcaaaaaacttcagtcaggctgggtgcagtggctcacgcctgtaatcccagcactttgggaaaccagtgggcagatcatgaagtcaggagttcaagac

SEQ ID NO: 151985 - DNA, 562 bp, Homo sapiens
ggaaaatatacttcaaaaaattcttactagtcttaggtaagggaaaatattgttttcattgagggggatgaaaagggggtgtgtgcaggagaacaaacaggatgctctaaaaaaaattaaattcggtagattaaagtacgatagcagaaataaataattcaataaaaagattaaaattaaatttgaagaaatctctcaaaaaataaacaaaaaggacaaaaacagaaaattagaaaaactgtgccccggaggtctaacatatcaataatagagccccaaaaagaaagaataaaaggaaaaaagaaaattcaggaaataattccaaaaatattcccagaaaagaaggctatgacttggtagtttgaagggtcctacaacagatatgtaattctagaaataaggcaacagaacaatgttttcaaaattctgaaggaaaattatttccaacctaaaattatatatccagtcaagcgatctattaggaggctagaataaaggtattttctgatacgcaaagtctccaaagaaaattatctcccaaataactttcctgaagaaaaat

SEQ ID NO: 151986 - DNA, 332 bp, Homo sapiens
atatataaagaactctcaaagctcaacagtaagaaaataagtattccaacaaaataatgggcaaaatatttgaacagatatttttatcaaagaagatatatgaacagggaaataagcacatgaaagatgctgcaaactattaatcattaggaaaataaaaagtaaaacataaaataccagtatatgcccactaaagtgactaaaattaaaagatcagctataccaagtgctgtcaaggatatggagcaatcagtaccctcagacattgttgttgcaaatataaaatggtacaaccattttggagtatcatttgacagttttttttttttctt

SEQ ID NO: 151987 - DNA, 369 bp, Homo sapiens
acctatgccagctggggccaagggaattggagcaggatgtatgtaggcattttgtgaggatgtaagcaaactaagaaaatgtcagatatgtccagctactagtctaaagtgttgaccccagtgtggggggcagagagggagcatgtaagttgtcctcatctctagagcagcttcacagaaatccagaggttcttttagctctgacactctctaactctgggaatcactaagtcaatggagttcagagggtcatagttgagcaaagcctcaggaaacagccttttcaaaggacacgcacaagtccccaacacagaactgaaggctgctgtctctctttctggcaatgggtatttgtccctggagtatgcg

SEQ ID NO: 151988 - DNA, 502 bp, Homo sapiens
gcattggaaggctgaggcaggaggattgctggagcctgtgattgagacactgtactccagtctgggccacagagtgagatcctgtctcaaagcaacaacaaagtggagatgatgggtatatagttggttgtaaagcaactctagtttgctgtagtgtgaacttaattgatttcttcatgctaaaatgtgaaattttacatttttatttttctgtttctacacattttctaccatgatttttgtcatcacttgcattaacttctttcccagattttaaatatattgcctcaaaaattatgagcaaaattgtttaaaatttatatcaatgtattctggcacgaattgtatcttttagagcactttttttttctgtaacaaatacaatgctttaaaaataaattttcatgtgaaagcatatgttgatgtctaaaagtcagctagcactaaaagatttatgatgaaagaaataatgttccctattttctcccatccccttgctttc

SEQ ID NO: 151989 - DNA, 273 bp, Homo sapiens
gcagcagaaaaggagatgacttcagttgtggcagagtttggcactggcttggtaggcagcttggagctggaagaagagcagccagaactgaagatgtgtggctttatattcaggagtcctctaaataaagataatagctgcagctgcaggaatggatgagctcatcagattaaagtgtgcaccgagagaagagggtcaaaggtagaacactgggaaacacctacttttatttagggtggcaggagggcaaagagccagagaaggagctgtctg

SEQ ID NO: 151990 - DNA, 321 bp, Homo sapiens
ggggaggggaattacttagggccacacaatttgtatgtgaccagccagatctgctaagtccatgctctttgaaaagtggttcaataaattatttctaaatttgacaatgccgagtccacgtatttgtatactttttcattatttcacatactcctgagggaaggtaaggctgatagaaaatcaccaattttggttgattttattcagtaataccagaggggataatttagacttaagaacattgtctgttatgagtagtagtgttctgagttttaatttccttgctttgggactttgccatagagactagaagatgtcata

SEQ ID NO: 151991 - DNA, 342 bp, Homo sapiens
tatgccctccagtcagcccatcagtgctctcctcctgcacataagatattcatttactgaagcttgtgatgagagtagcaggcccagtggtctccaaaatgacttcagggttattctttccttgtcttggtgaacagcacctggcttctgcccatccataccaatctccttataacatgtgaacattcatttagccatacccttggtgctctctcccaaacacactttttcattgtttaaaacatggccagggtgacaattttccaaatctttaaaagttctgctcctcttttgattataaattccatctttaatttgtttctttttgcattttactataag

SEQ ID NO: 151992 - DNA, 391 bp, Homo sapiens
aggatccccatcagggtcctggagaaggggaatcagaactgaagaaagttaagacaggagctatcatgaaatggtcgagaggccttgggggttgagagccagtatgaaactttgttcaacgaagtctcatctaatagggttctttcctactggaattacaatgctttattgattcaatatatcttttcaaaaggataaaaatccataaaatagacgtctgacaaactgaggggatatagctttaaataaataaaaacaaaacacagaatatacaacccaaagaggttggggactggcagcggggagagagcacctaaggcagttaagctttgcaaaggtggtgctcacaacactactgggtgtggcaggggtcatgctccccattttgcag

SEQ ID NO: 151993 - DNA, 277 bp, Homo sapiens
ggtgatgtgtcttcaggagtcccaatctatcttttcctggtcctgggtttcagaaccgcctggggctgaaccaaaatgcccacagctcccatctctcctggcctactgaatatcagcccctgtgtcagtcctcccagaggatagcctgaggcagggtgtgggatctcccaaaggagcaactgaatttcccaaatgggaggagactcctggtacactcttcatctagatagccaaccccttgggatgctcagtttttctcccccagtcccagcttcca

SEQ ID NO: 151994 - DNA, 208 bp, Homo sapiens
ttacctgaccaccccagatggggtcatttctgttactttctctcccttttggatccatttatcacgagttctgttttgtttgattacttttttggggctgtgttcaataaaatgtaagccttatgaggcaagaactgtgtctagcttgtttactacgacagtgtgtcatcagtgcttatgagtagtacttagtaggtggtgaataaat

SEQ ID NO: 151995 - DNA, 225 bp, Homo sapiens
taggagatgggtgtgtggagggcagtgctattttccacagggtagccagggaaggcatttgaacagaaacatgaagtgagagagccagccttaagaagatttgtaggaagatggtccaggcagggggaaaaaaaaaaaaaaagaaaaaaaaaaagcaataactgtaaaacgtgaggcaggaaggaatttggtggtccaaggatttttttttttaagtttgtatgg

SEQ ID NO: 151996 - DNA, 610 bp, Homo sapiens
agaattacaaaactgtgacacagagacataaagtgagcacatgctattggaaaaatgccgccgataggcttgctcaatgcaggataacaacaaaactttaatttgtaataaatgcagtatctgcaaagcacattaaagcaaagtatagtcaaacaaggtaaagcctgtatctgaattgttctccattgtttgtcttcaatcaatagcctgtgtgcatgtctttttgtatttttgtcaatgagtctttagaataaatttctagcagtggttactggaccaaaaattacatgcatgtttaatgttagctgatgtcgtcaaattcccatccatagggactgtggtattatgcattactgtagcagtttatgagtgtatatcctccctcacaagcttgccaactgagtgttctcaggctcttggatttgtgccaatctgataggtgaacaatagtatcacaatgtaattcttaatgtcattcatgattttatgacttatgaatgaagttgaacatctttttatatggttaaaaatcattttcatttctttctgtgagtaagtttataaaactgtatttattattttaaatgtctcactatttcagtagctggga

SEQ ID NO: 151997 - DNA, 395 bp, Homo sapiens
ttttctttccaagggcatgtctccacaaaactgttacctcgcagcaggtaactggtgtgaagccacaaacagcataaaacccaagcttctatggacatccatgcagtaaaagcctggtggaaccctggttctctttaacatgaagcaacactcgaagaaccagcaaagaagtaactggtttagatggcaggaagctcatgtttattccacatgcagcagcagcctggttccttccagaggcagaaaatggagcatgaaggaagagtcactaccgttgtgaggctgcagtttggaggacagctgcaggctcacgaggctccctttcttctcagcgtagcctttttttttgccttctgattctgccttgggcagcactctgggacaacagctagctt

SEQ ID NO: 151998 - DNA, 531 bp, Homo sapiens
ggtccagtgggcagatccctcatgaacagataaatattgtcttgtgggagtggatgacttctgtcttgcaggactggatgaattaccacaagaatgagttgttgtgaagcttctcctcatgttttgctgtgtttgcacgctgtctcttgacatttttcttctttgctatgttgtaaggcagcacataaccctctgcaagctgagcagatgccagtgccatgctcttggattttctagccactagagttgtgagccaaataacattttttttctttataaattacccagatcaggtattctgttagagcaacactaaagggactaagacactcttattctcaccaaatctttattttggtaatgatttctcacacctattcatttgctccagaaaaggtagttattctccatagtctatcttcatcttccacttcatgcttattcaatccattaccaattcctgtcaatatatcttcctaaatatctctttcaaccaccaacttttctatcctcactattactatcctttta

SEQ ID NO: 151999 - DNA, 428 bp, Homo sapiens
  misc_feature (150)..(150): n is a, c, g, or t
  misc_feature (275)..(275): n is a, c, g, or t
  misc_feature (390)..(390): n is a, c, g, or t
  misc_feature (419)..(419): n is a, c, g, or t
tgcattctttggcatggctagttgtgtcccaggatctgcattccagaacttccattctgacacaagatagagtgttgcctagcaaatgtatacacaaagtcccgctgttctagaaatttcacctggcttgatattctgtcaatccctggnctcaaattccagctccatcttatcaaacaataacagaattccctaatcagtactaagctccgcatgcagtctcttttccagaacattctttgcctaatgttccttagtgtggctctctctttagntggggcctccttccttagtacatgcataccttactattctgtggaattgcaagccatgcatcttttagagccacactagtcaaattgattggcatttccatttattttccattgntcccttgtttctcctggacttcctctcgnttctctttt

SEQ ID NO: 152000 - DNA, 185 bp, Homo sapiens
gtgaggccttctgccctggccttggggagaaggagtgcatgtgtgaggctgggatacagtggccctggagtggggctagggctcatcgccagcaccaggcgcggggaggatttaaaaccagagtcctgtctctgagccaccccacagggacgcttgatccaagcctgttaaggccgtggaactcg

SEQ ID NO: 152001 - DNA, 472 bp, Homo sapiens
agatacttgctcctgcttcaccttcccataaaagttcctcaagccttccccaaaagaaaagcagatgctggtgctatgctttctatatggtctgcagatggtgagccaattcaccttcttttctttataaattacccagtctcagatatttctttatagcaatgcaagaactatctaatacagggttccttgagatttcatattaattttagaatagatttttctatttctgcccccccaaaattgggagtgctatacttattgtattatattttgtcttctgtctattgtccattcctatgttttgccattttcttttctttttttcttattgtagctcaactattttgcttaataaccttttgttacacatattacaaatattatttacagtgtttaaaggtttcctgaatgctagattggttgcctctgctggaagattggggtgtttttagatgttttcattgaagag

SEQ ID NO: 152002 - DNA, 449 bp, Homo sapiens
atcctggtcctgctcagctgatgaagtgatgcacttctctgattgcaaaatacaaaatggcacatcaggtatttgtttcatctacaccggagaaggcagaccaagtggtgaagcatttgttgaacttgaatctgcagatgaagcgaaattggctttaaagacagagaaaccatgggacacagatacgttgaagtattcaagtctaatagtgttgaaatggattgggtatcgaagcacacaggtctgaatagtcctgatactgccaacgatggcttcgtctggcttagaggacttccatttggctgtccaaggaagagattgttcatttcttttcagggttggaaattgtgccaaatgggataacactgtgagtggactttcagggcagaagcacaggggaagcctttgtgcagttggcttcgcaggagatagctgagacggcattgaag

SEQ ID NO: 152003 - DNA, 275 bp, Homo sapiens
cagttcacattactgagcttggcccagctgtatacttaatagctcccagatgctctctctctctctttttcaacagctttatagagatacaattccagaacatatcattcacctgtttgaagtatccacacacttggcttttagtatatccatagaattttgcatccattactgcaatcaactttagaacattttcgttatccagaaagaaaccctgaattccttaggcatctactcctgaatcctaccgttgctccagtcctaggcaaccccta

SEQ ID NO: 152004 - DNA, 201 bp, Homo sapiens
taattaaggttactaatcagttggccttaaaatggggagatatctggttgggcccattgtaattctataagtccctaaaatcagaagagaaggacagaagctgtcagggacatatggagaaagagaaagtaggagagatgaggcagaagaggagttcagagagattcaaagtgtcagagcaacctaacccaccattgctag

SEQ ID NO: 152005 - DNA, 260 bp, Homo sapiens
aaagtgctgggattacaggtgtgagccaccacacctggccttattttatttttaatttctgttcttgtattgctataatttactgatgatttcttacccaaagatcctcggcctgtccccacccaaggggactgccttccaccggggacccctcataagagttactcattaggatggtgttccctggggttcctgtgtgtatgacgccagggcctgtgcaccgcctccatggcccatctccatcagacagagctgggcag

SEQ ID NO: 152006 - DNA, 153 bp, Homo sapiens
caggctggtctcgaactctcgacctcaggtgatctgcccacctcggcctcccaaagtgctggaactacaggcatgagccactgttcctggccttttcataaacttttaaacagtgtttattagaattttcttttccaatcatgacagtgggaa

SEQ ID NO: 152007 - DNA, 196 bp, Homo sapiens
tgagtagcttccaggggtcagctctgcaaagcaggaaagagcaaggaatccactggaagcaagaaggcccaaaagtaccttgggaggtacgccgctttttcagctcactcactgcctgtaaactgtcagggaccctaggatcattaaaaaatattttgagggccgggcgtggtggctcacgcctgtaatcccagca

SEQ ID NO: 152008 - DNA, 262 bp, Homo sapiens
tacgcctggtcgcagtcccagtgaagagaacaaagaaaaagaaacaaaagaagaaaagggcaagaaggaaaagagaaccatagagagacaaaacaacaaaacaaatccaggtgtgtgttcaccatcccaaggcatggacgaaaggagttaaagcttcgtggctttgggggaccgtttctcacaaatctgaggataccagtatgactctgctggcccttgttcccgcaggaaaactgggaggcagtatctccccctcagccct

SEQ ID NO: 152009 - DNA, 278 bp, Homo sapiens
tactctctctcatactgaattatatatacaggtcagctcaataactaatatgaagccactttctatatatctaatagaatgaaaaatctgtcaccccaaagagagatactcaataatctttgctggccaaatggccaagaactgtgcatgggagacgtaagacgataaaagagattttagcagaagtaactgtatgaaaaacatacatttcttagaaatagttttgcatagtttattctaccacctaaaatattcctaaatccagagagaaaataccc

SEQ ID NO: 152010 - DNA, 490 bp, Homo sapiens
gctggattgaaggccaggtgggggaggggtgctaggctgtggggtcaggccctgggcatgctggacctgttaggtcactgaacatctgactgggcacctgcccagatttgtcccttcagttgaggtgggattggcagcactccccagaaggcgtgcagtgccgggagagtggaggagggtctgacgtttgctatcctgtggtaggttttagagctaactagatgcttgtggagagctaatgacatgggaagaaggcagcccaccttgatggaccggagggttagagcctgcgatgtgagaagcgggtgtgtggaggtggcctgtctacaagagggcaagtttaaggcccattgcagtggcactatctcagctcactgcagctggtggctgccaggccatccctctccagagcagggaggccctcagccttatgtataattgaatgccttttgggatgcttggatagtcctttatgtcttggaaattcaga

SEQ ID NO: 152011 - DNA, 271 bp, Homo sapiens
cttggttcagatcctttaatttgttcctgtattactggtacggacaaagtatagtacaacattcagagccctggggatggagacacctctgagaaagggcattggtatgagctaggcaaaacactacagaaagcgtttgagacaaagcagcatgtatccacttttggttgagaaaggatttcaagagaggataattttaggattccttatgatcattgggtattgaatgggagacttgattcccagctttgtattagaacatccagagtat

SEQ ID NO: 152012 - DNA, 408 bp, Homo sapiens
ccccgaccgcctgattcaggtgattggagggaggggactgagaaccccttggaatcagccagaggtctcgtgccttggcctgtctttagtcatcttcagaggtgtggggtgttatcaaggaaccggctaacagggcccttcctcaggcctctggcacgtgggaaaccatcactggattctctgtaaggatgatcaccactccgtgaagatcatgttcatgggagatatgagttttggttttttttgtattttctctctgaacttttctttctttcaaggaactgtttgggagagttctgcatgggaacatgtgggtgcccttgctctgggtgggagaaaacctcagcacctcggttccagctggccaagcccaggatggacttggccatgaacccagcatgtggatca

SEQ ID NO: 152013 - DNA, 240 bp, Homo sapiens
acaactccctcaaaaatgattctgttaactaaaatatgaaaatgccatgaaggccaccaattatcaatcaatattttaaaattcagtgataaaaaatgcatccttatagaacccataattattctccaaaacttattggtacacagtttgtgaatgccttaaatttgttttgacagtaagaagccttaagaatttaacattcaaggccggatgccgtggctcacgcctgtaatcccagca

SEQ ID NO: 152014 - DNA, 476 bp, Homo sapiens
cattgcaactaacctttaagaaactatcgcttgtccaggccaggcgcggtggctcacacctgtaatcccagcactttggggaggccgaggcaggtggatcacttgaggccaggaattcaagaccagcctggccaagatggcaaaaccccgtctctactaaaaatacaaaattagccgggcatgatggcgcatgcctgtaattccagctactcgggaggctgaaataggagaattgcttgaaatcgggaggcagaggttgcagtgagccaatatcatgccactgcactccagcctgggctacacagatagtatctcaaaaaaaataaataaataaatacaaaaattagctgggcatggtgggcaggcctgtagtcccagctacttgggaggctgaggcatgagaatcacttgaacccgagacgcggaggttgcagtgagctgagactgtgccactaagcctgggcaaccgagcaaaa

SEQ ID NO: 152015 - DNA, 465 bp, Homo sapiens
cctgcctcagcctcccgagtagctgggactacaggcgcctgccaccacgcctggctaatttttgtatttttagtagagacggggtttcaccacattggccaggctggtctcgatctcttgacctcgtgatccgccagcctcagcctcccaaagtgctgggattacaggcgtgacccactgcacctggcctgtttttcattatctagcatgagcatttgtctctgcaaattttcttaaaacatagtttccctgttgtctcacttatccagtagctgaaatgatttccttagacttgtccaggcggcttcatacctaggagcttaagctgaatattggatccaggctcaaggtcatggatgagataggattcaaattatgcagggaggacataattagggatggtttgaattaattgcagactcatggaagtaggattatgtttagcctggtggtttctggaaagtg

SEQ ID NO: 152016 - DNA, 363 bp, Homo sapiens
agctaaacattgtccatttctacactgagaaaagcaatcaagatgttaacattttcaaagtttctattgatccattttcagtctttaaacccatagtcaggaattatttataagtcaaattatatgttgtaaactatagcacagtggaatgaaattggatagaaatgaagtctgggccagtaatagaattgtaaatccaggcttggtccaaaaatgaatgctcatagaaggatgcctccaaagataacatctaatgcctagaggcaaagccaaatcaggaatccaaggaacagacaaaagagaaagccactgatcacagcaaacatgggaaatcaagcaaatcaaataggcacgtttgcttag

SEQ ID NO: 152017 - DNA, 130 bp, Homo sapiens
tccttttaataattggggtttgaggactgacttcaaggtagaatactgaaattttatcagtattaatcaagtctcagaaaacactcctgatttttagaggaaattataatattcctaatcattatatcat

SEQ ID NO: 152018 - DNA, 440 bp, Homo sapiens
gaaccaagacacactcttcaacaggtcgcatacttaaacacgatgtgttccataatgtcatttcttaccaacaacatattttgagcttagctgttaaggaaccaatgcctctacaatgaatcttgctggactgaggctctgaatgattttaaaaggactaaaagtagtgtacgtttgaagtctcttaacagtgaagaaagagaaatgtgctctcattccttctgatgctctgtcagttgcaaatccagtcaagtttctaacattactccaatgccttttgtactttatgtttgattaacatggtattttgggatttttttttttaatgcagtgatttttatctttgttacaaccataagttcattccccaaaaagagctgtgtggtgctgctagagtgaaacggcaacggttcccttgtccccctcgcagggcatgtgat

SEQ ID NO: 152019 - DNA, 251 bp, Homo sapiens
tacacgcccccagtgatattgtttctcatttcaacgtgggagaggaggatatgacaccaaatatcgcagggagtagaaatactcctgggatactgttcttaatatttagggagggagagtatgatattactgccaaaactacaaagggtgtacacccgtctgtgaaatagttcataatttccagagggggagatgatattactcgaaatatcgttaacaggcaatgagtccaccgtggatcgtaatagcca

SEQ ID NO: 152020 - DNA, 297 bp, Homo sapiens
atttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatggtaagatgagaagatgaggttcttaaccaaatagggaagagataaaatactggaatgctcttaaaggtttaataaaatcttatatatggcatactgcaaaattgtagcactatgactcagaggagt

SEQ ID NO: 152021 - DNA, 113 bp, Homo sapiens
cagccacacctgcccctgcctgagagctcagccccgagccctggaacgccttcccttctccatcccagctcgcccttgccaactgctcagtgggatggactcacactcccttc

SEQ ID NO: 152022 - DNA, 593 bp, Homo sapiens
atgttttgtttttttttcttagcatcattaatgctaaaaatgaataactcatttttaaaatattttacaaaaacgtgagttaatgagtttactcacatgcagtggatgggcgaaagtacaggaagactgaaggacatccatcccccttgactgctcctcaatgctggctcctcctccttcttcagagctccttatccctagctcttcggagccctctcccagcctcaacctgcctccagacaaactcttccctccccctcctacctcggagggaatttactccctgcagcccaccacctttgccatcgtccaagtcctccacacacccttgctgactctgcccagatccaggtctatctggggaaatggaggcagattctcccagcaccttgtgaattccagacagaaaaagactcttccacttctcgacaaatattctatcctctgagcctcaccaagtctgctctgctaccctatgtcatccttgctgcttgagcaactgactttcgggcctgtgatacctgcctggatcaggttgtcctccccaggcctgcctgtgtccctgcaaatgacctaatccatatcccaagttt

SEQ ID NO: 152023 - DNA, 127 bp, Homo sapiens
cattcttcacagctacctaattacagtccaaaaaaagcaagctagtttcacttaagaatattcctggccaggagtggtggctcatgcctgtgggaggccgaggcagatggatcacttgaggtcaaga

SEQ ID NO: 152024 - DNA, 186 bp, Homo sapiens
ttttttttttccaggaaattaaagaagccaagagttgtatgttttaagtggatgagtatgtgaattagagttccctaaagctgttattggaaaaaaaacctttgatgaggtaaacattaatgaaaaatattttctttttaaaatttcacatatatatacacatacacacatacatatatatacaca

SEQ ID NO: 152025 - DNA, 397 bp, Homo sapiens
acctgctagtcaatgccagaaactgttatcatttatggagtacttcttgcgcaaaacactttcatccttgtaacacacctctgtgggatatactacagttgtccctcagtattcatgagggaatggttccagaacccacctccccgttctgcggatgatggatgctcaagtccctgatgtaaaatggtacagtatttgcatataacctacacacatcctcccggagactttaaatcatctctagattatgtataaaacttaatacaatgtaagcgctacgtaaatagttgttatcttgtatttttaaaaaatttgtatgattttttattttgttaatttttatttttttccaaatatttttgatctgcggttggctgaatctgcagatgtggaaccc

SEQ ID NO: 152026 - DNA, 263 bp, Homo sapiens
caacctcaggtgatccacccgcctcggcctcccaaaatgctgggattacaggcgtgaccacagcgcccggccggactagtcacattttaagtgctcaatatccacacgtggcaagtggccactatactggacagtgcaggtccacaggaactaaagtaggtatccccattttacacatagaaactgaggccataaaaagtgtttaagattgctgagtgcggtggtttacacctgtaatcccagcaatttggaaggttgaggtg

SEQ ID NO: 152027 - DNA, 268 bp, Homo sapiens
aatgtaaattaaaactgtaatgaaatacaactacatgccaactggaatgggtaaacataagactggccatgtcaagtgttggtgagaaaatggagcaagtagaattctcatacactgctggtgggaatgtataatgatgcaaccactttggaaattagtttgtcattttctttttttttttttttgagacagagtcttgctctgttgaccaggctggagtgcagtggcacaatctcggctcactgcaacctccacttcccaggctcaa

SEQ ID NO: 152028 - DNA, 344 bp, Homo sapiens
tgtttacagcaagctcagggcatataacaattatcttctcaccatggtcatgcttacgctataaatgtagctttggctaataacagagagtcataccagtctgggtgttataaggaaaaaaagagaatggtttggttgataaaataatatcaaaatctaatgtccctgaggagaacagtaagaaaaacaatctctgaggttgaaaatattcactctctatgatacttcaatgttttccagctctgatgctggcaggccctactttgaaatacaacagctgcatttatacatagcaacatcagatctcagaaataatcactagatggatgcctgtaatcccagca

SEQ ID NO: 152029 - DNA, 354 bp, Homo sapiens
ccgagatcgtgccaccgcactccagcctaggggacagagcgagactctctctcaaaaaaaaccaaaaacaacaaaaaaaattatttccagcctatgaatgtaattttatatgataagttctaatcaatgtattagtaacattaaaacaacaatgcaaaatgaattcagagaaactttggctatttctcctgagatccatggaagtgatctagaaattttcctccatttagagattaggaagcatgccatagcattcccagagattctgtaagaaggctggggtcaaaggaatgtgtagacattaccacatggcctagtctcatgttagcagcagcttctctttcttcagggaca

SEQ ID NO: 152030 - DNA, 158 bp, Homo sapiens
ccagcccatttctggagagggagttttaggagccccacaaatgttcattcagaaaactccctggaagatcccaaggatttgaagactggacttctggaagtttatggggacttagcagcaaattgcttacaatgaaacaaatgaactcttatttgggg

SEQ ID NO: 152031 - DNA, 436 bp, Homo sapiens
aatcacccagactgctgtgtggacaagcatccttgtggattctaatgcaagtctgtgatcggactttgagaaatactaatttagtccttaagtcagtatcctgagatagctgatttcaaaagagctctctcagggcttctgaccaaaagtgacagattggctacacctgtacatctcttcttatttcctaatccctgcctaaatggaagaaagaaatcagagactgggagaggttacaacaggagacagaagctgctatacctctttcaaataagcagatggacaggtagtgactgactttgcagaggaatcacacagtacctgtaagtgcacaaaaatacctgtaagaaatgcagtactgtgtttgtccgaagctcccaagagtctcagcatttggaggcaccagatactaaggaagataggggtcagaaatgga

SEQ ID NO: 152032 - DNA, 179 bp, Homo sapiens
tggtaaatccaggccttctcccttagccatgtcttgcaggcgcctgacacactggccacagctgacacaaatgtgtcacggacccccaagaaaacaccacatgcagtccttcctcaggccgtgctgcccacaaggggctcaaaatgatttgttgactgaattcccattttacagcaggt

SEQ ID NO: 152033 - DNA, 539 bp, Homo sapiens
aaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaa

SEQ ID NO: 152034 - DNA, 801 bp, Homo sapiens
caccgacgtccagctcagagctcatccttctcaccattctcctgccagcatcgcaaacttcctccctcatcttccttccacagtgctttcctggcttctctgtgtctgcctctggctgctgagagccagaggcattggcagtctgtggcaggttgatgccatgccatgttcatggctgctgacctcagcaggccctcggctatgcctggccttcccgtttgcttgtaagcttgctactcccagcaacagcagctcaaaccttccctgctctcccacactccaagctccagcactgagaaagtgagacatcagctggcacatcccaaattgtgctgtcctcaactccccgagcccagctgactgcccccagcttcttgtatttggtgcctacctccctgcttggaggcctcaggctgtggcatctgcctctcctgcaggccaggccttctctgccctcctggtttgccaccttggacaaaccctcccttgccctcatatcctcctccagcgcttgccctgctctaagcttcccaagggacttgcccaggctcatggctgctcattccctgcctgctccagcctggcttctgccaccaccactcactcagggatctgtctccacacactccaggaccctttcttgctttatgagaccttttagactcatgacactgctggcccccagcccccgtgaagcgttctccgcctggcatcaccgatggctgggaccttggtgcgttcaccttcctttgtggttgccctttctcatcttttatctgatccccaagaaccgatttcccc

SEQ ID NO: 152035 - DNA, 305 bp, Homo sapiens
ggggacagtggagggacaaaatgaacacactggaggacttggaaatggccacgatgaggggcacatgggagagggtgaggctgtgtagttcccaccagagagcataggctttcatttcgcagacctggaggctttcatgtttataggcccaggaggtgggtatcactaaccagtatcagaagaggctcagggaaggccagtaactttatcagggtcacacatctagtaagttctaggggagggatccacccctgcgtctgtttgactgtggagttcatgctcttccaaaagcctcagttctggga

SEQ ID NO: 152036 - DNA, 304 bp, Homo sapiens
gctggcaaagaggggtcctgtgtgaccatggtgactctttccgacatgtggcagagctcattcatcactcacagcgctacttcctgctgaactcaggtggatttttagttcccctaataatcaatgagagaatacagtctgaaatctatttgccctctctgttccaggaaaggggtcccaggaggaagggagttgcctgatgacagggagcgctgaaaatgtcactaaagctattggagtgggaaaagccaggtgggagaccaggtaccgttgggaagccaacgggagagtaggtagggaagag

SEQ ID NO: 152037 - DNA, 537 bp, Homo sapiens
tgagtcattagagttggaaaggatgttagagatagagtggcctccatggtaaactgaagaaaagcattttcaactccctgcccactggcgggagccaagatccttctgtccagccttgccctgggcagggctctcgggtaatggcagtatccccactgccctcccagtgccacccgcaccgtgaggcaggcggaggccagctcctccgagcttagctgtgcctgaagacctctcacacgccagctctgctcctgcccgtgacatggaaggaaacacacgcagacctttgacagccacaggcacctcctgatcctctcgactctccctgcatgtcacatcactcccaccgcccaggcctcagaaaggactaagtggggaaggaagctgaatttgtctcccacacgtgactgcctttgctcatgttctggggaagactatcggccttctagagggcacctgtctagtcagtattcctcaagcgtaagggcattgggaaagttctgccacttcacaaattaccaacggtctccactccca

SEQ ID NO: 152038 - DNA, 260 bp, Homo sapiens
cctcatggaggtagcctttacctggcaggcacctcagaggctggtcctatatgtcacatcattgagataaaaagaaatccaaggctggaagcagtgacaaatggtgtggacttggtggaagttgcccagggagatggatgagaatggtgacatcacacatagcacggctttttctccaaaatcccaggacttaccacagtggccacactctgtctctcacctgttcactttcttctgctcgctcgctctctctcagcctc

SEQ ID NO: 152039 - DNA, 570 bp, Homo sapiens
agcaagtcgggactggccaaaagatgcgtccttgcactttcttctccccgctccgcctttgcttggcttgactgctcaaacctgcagtagttaagaaagttccacggtttaagagggttcccaggtcatcagccactgggagttttctctgactcagctctgcacttccacttgctccagaacagggagtgaggaggagatgggggtggccttcgaaatggccatagggtggtgggaccccaaggtggggaacagcctcaggtggacgaggggatgcttttcagggcccatttgccgggacttgttgtgaccacttggatgtatgtgtcataactgtccaccttccacccttcaggctcccagcaacttcaagatacctggagagattctcagaccctcccctctaataggcagagaggaaattaatgctggcgtggggaggggagagtgggagaggatgtgacgcacaggcccagagcttagggactctgaattctttaatctgggtctattggtgccccttcatatgcagtaaggtcacctattaactctgtgtttatggagctgtat

SEQ ID NO: 152040 - DNA, 103 bp, Homo sapiens
tgtggatctttcagtcttctcccttcagtgaaggcagggcagaaaggctggaaaaagggagtttctaaccaccaaagagcatcagttattgataaacaagtac

SEQ ID NO: 152041 - DNA, 372 bp, Homo sapiens
cagggtaacgggtgtatagatttatcaggttttcaaagttaggagcagagaccatgtctgttttttgcttactattaaatccatagaagctagcataatgccaggcaagaggaggtgcccaataactgtttcccagctggttccctaaaagatttcaggcacgagagctaacttaacccagtggagctaaactaaagaaacagctttcctccagattttaagaatggctggacacaaacaaaagctaggttcctataacatggaagttttaagcctcaacaaaaggcattattgggccagagatggagggtgccagactgcctggagtctcctgtagaaatgaagatgattcttgaagaacgccctgttgaa

SEQ ID NO: 152042 - DNA, 715 bp, Homo sapiens
cggggtttcaccttgttagccaggatggtcttgatctcctgacctcgtgatccgcctgcctcggcctcccaaagtctgggattacaggcgtaagccaccatgcccggcctaatttttgtatttttagtagagatggggtttcaccgtgttggccaggatggtctcgatctcttgacctcgtgatccacccgcctcggcctcccagggtgctgggattacaggcgtgagccactgcgcctggcttagtccacctatttctaatgtgactgggtcattcatcaacctctgtgatatggtttagctgtgtccccacccaaatttttttgactgtagctcccataattcccacgttgtgggagggacccagtgggagataactgaatcatgggggcgttttcccccatgctgttctcatggtaataagtctcacatgatctgatgattttataaggggtttcccctttcacttggttttcattctctctggcctgccaccatgagacatgcctttcaccttctgctgtgattataaggcctccccggccacatggaactgtgtgagtctattaaacctctttttctttgtaaattacccagtcttgggtatgtctttatcaacagtgtgaaaatggactaagacaccctgtcaacatcatctctctgctccagtgctgcatcttcaggagcccaggttccagataaatgaactgtagtg

SEQ ID NO: 152043 - DNA, 151 bp, Homo sapiens
tcatgtagcgatcatagagtacccaggctcagatgctggatggtaggtagaggtggcggagcctggggaagttctgatattcttactgaaatcagaagcaaagttatcaggtgagtagggcagggaggtgtcaggggtgaggtgatcggag

SEQ ID NO: 152044 - DNA, 146 bp, Homo sapiens
tctatttcttgcagtaagtttatccatgaaactcattagcccaattttacatttgatttaggtgatcttaagtctgtgttatttgaaatccaggatgtggtaactaataaatgacacaaatgactgcatattgttgaagtattttg

SEQ ID NO: 152045 - DNA, 939 bp, Homo sapiens
  misc_feature (566)..(566): n is a, c, g, or t
  misc_feature (635)..(635): n is a, c, g, or t
ggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaacacactgagagtgggaaaccattatgacttcaacnttcatcaacatcagagaatccatactaaagagcatctataataatcatatgtgatagagatcttccacnggccaaaagtctcactaggcctccaaaacttttttgatgaaaccatacaagtatcgtgcatgctaagctttaccaggcatcaaacggacattccggttctcgggagtacctcccaagaaagttatagcctcagggaatccgattgcgggaaacctcaaaaacagcagtaaaaaaaaaggggggcaaaaccccagggcaatacgcccctgttaggccataagagaaaagagagggaaacagggagcaggcgggaacaccgggagaccacaacagaaaaattgagcctgcaaggtatacgggccta

SEQ ID NO: 152046 - DNA, 133 bp, Homo sapiens
tccaaccttggcctcccaaagtgttgggattatgggaaaatatttattttaaagtgattttgggctgggcatggtggctcagtcctgtaataccagtactttgggaagctgaggtgggaggattgcttgaact

SEQ ID NO: 152047 - DNA, 1069 bp, Homo sapiens
gtcagaacctctgaccaggcaaggctttattttccaggattatattttgtctctcaaatctgtaatgcaaaagcatcacttctgctttcccttgttttctatcactaactataatattacaaaaactttttttttcttagaatctcagttcttgcatatttcctgcttctccctattcctaccttttcatagaggaagcaattctgacttcctttgtcttcgtcataagcatcccgtaaacacaagttcacagggaactgtgaaagttcaaagtgggaaaattatatttatcactatgtgtggtgatagtaggcataaccaaattggtctttccccgcttatcataacgtattaaaccgggaatttctcagtccctaatacttgcagagtcatgttatgaggtcattatagattttaggagcctcaatgcttttcatatcattttcagaattcttcaaaattcccatttataggccctaattgatttcagcagcccatatgcagtagagcagttcttccactaacaatttttttaaagacagagctaaaaatatatatatttgatgaagtatattaagtagaaaaaaatgttagaaatatcagaaaaaaattaagaaataaaagtatgttcagtacaatttaatttgaataattttaatctctaaaaataaccatattgtaaaaaaatacaatttcttctagtaaataaagaacaaatgagattttgtactacaaacatgcaagacatgttttgcaaaaatcacaacttcaatgttaagttccgcatttcatgaggcacaattatggaaatttatcaatgagaggctattaaaagagagcctcttgcccctctcagtattcaaactagatagaatttcatgatgactgaccaatgctgctagttctgagtctccgtggacactagtttataaatactccaaccttctcccttttttatacaataaagagaaatgctagccttgtgttttgaaagtcctttaaagagttcatgttaaatacctttgggattatgtacacaattgtcttttaatcttttttaaaaatatta

SEQ ID NO: 152048 - DNA, 377 bp, Homo sapiens
ggaggtgcccgagttaagggtgtggagagttgggatttcgccgccgtgaggccggcatcggtgactacgagttatgagggttgggggcgggagttctgtgagcaggggtcttgcagctgccggggtcggggaggttccctggttacacggtccggattcctgggccactgcggtcgctgctgcccgcggtgttgttgatagctggttgcctgacgacgcttcctagtcagccacctccagggcccgggggcgagcggttccttggttcccatgcgccttctctccccaacggccaggccccccctgctccgtcaagcctccccgagcgcctttcttgcccctcggtgcttgttattgttaacgtgggagcgcttgtg

SEQ ID NO: 152049 - DNA, 313 bp, Homo sapiens
tgtaaaaagagaatcaagacaagtttgctgtaaagtttataatgacacagttcatgctccatttttgatggggagcttccatcaagaaataaagccagaattcgttttcacgaacgaatagcagccagaaagccaatagccctgaccttaccctgcagcaggcctgctttgtaaagctgacagcagtgttcaagggtgaaaggttggtgttggtctggaacagattggaaggggaggtgtgggcccatcaggctcagctgaccattacctccgatcatttatcactgtcagagaggagagggtgcggggtggg

SEQ ID NO: 152050 - DNA, 204 bp, Homo sapiens
cacctcgaaaagatcatctgaactcccatgttcactgcagcataattcataacagctaagatatagaaacaacctgcatctgttgatggatgaatggatagaaagaatgtgatgtatgtgtacatatacacacttatatacacacacccaatggaatattaggcagccttaaaaaagaaggagatcatgcctgtaatcccagca

SEQ ID NO: 152051 - DNA, 404 bp, Homo sapiens
ggcactgtgaacaccctttgggggttctatgactgaaggagaaggaagcagattttagggctatcctcaggctagggcctggccatgtggggagccctacctggagaaaaacaccctgcaggagggcctggaggcttggccatgcagcggcagggagcagtgactacccaaggacaatggagagtgagggtccaatgtgaagagaggcaggggatccctggagaagaagggaaagtgggtgctgtttgaaaacagaggaggtactctgagtgcccctccaaagagtgcctcatgcatatgcaagtggatgggatgccttcaggacctgtatcttttacttgaggtgatcttccaagagattacattaaccagaggtggtgctgggacaggacttacaagaaatg

SEQ ID NO: 152052 - DNA, 103 bp, Homo sapiens
atagcaatggaacacagtgactgcatgtttatgtattaattcctgctaacaagcccttgtaaacaaatgcatactgttaacaaagtcaaaattcccaagaaag

SEQ ID NO: 152053 - DNA, 573 bp, Homo sapiens
ccccgcacccccagccccaaacaccaaccacacttttttggaacaaaaagcccggaccttgttcccgcactgtaaaacacggagttgctaccacttcaatactgctactgtaccagggaggtggtgtgataaaggcacagatctatcgccagagaattgttcttcaagatgaccagcttgacctctgagtaatccttcattttcagaaagaaatgacccatgtttccagatgaatagtagctttcttaacctgttttttaactacgaaagtactgaagaaaaatataggtgacagtgggaggaaatgggcgtaaatattcattccatcaatttcatgaatacatcaatatgtattcattccatcaatttcgagagttgaattttcaaataaaatattatgaagaaaaatataaacagcaggataaaataaatgtggaaattgctaaaagaagatataaagataagttatatttagcaaaaataaattcattttataaatcaaattataaacctaaaataatgttcttgtaagcagagactcttattattgcacttcatcaagtgctgaagatg

SEQ ID NO: 152054 - DNA, 260 bp, Homo sapiens
tgctaggattacaggtgtgagccactacacctggcctctttttttaattagatgagttaattctaaaattcacatataagaggggagaaatcaagcaggaaaattctgaaaaagcaaagtaatgaagagagattccactttaaagagcactttaaaatagattataaagtgatcataattaaagcagagtggtagtggtgcataaatagaaaaatgaatgaaaaagaaaagaaaatccagatacagtcacagatgtctct

SEQ ID NO: 152055 - DNA, 398 bp, Homo sapiens
cctgacggttgctctactgttgcctctactactgcctcttgcctctactcctctactgtttttcactgttcttagcaggcgtccctctcctcataacaccctattaattctggcttctccttttacctttcctgttgctagttcccccatctggaatgattcttggcccattcctagttcagtttctaaccatcttcccaggtctgggtcggcctagaaccttctccatccagttatcctcaactattccagcccttgggagtttctcccttctctgaactccaatagctcaattgctgaattgtagaggcaaccggcagtagtagaggcaaacggcagtaatagaggcaaccggcagtaagtagaggcaacggcagtaatagaggcaaccggcagta

SEQ ID NO: 152056 - DNA, 568 bp, Homo sapiens
atgatgtgatagttgatatgtctggcaagcccatgtgtgttgagagcttctcagactatccacctttgggtcgctttgctggttcgtgatatgagacagacagttgcggtgggtgtcatcaaagcagtggacaagaaggctgctggagctggcaagggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatacatcatgaacaatcacatcatgcatgatatgattgttccgcagggatgtttcagtaagataaaaaatgcaaaaggtccatctggtgacatcgatgaaattagtttcacttgactggtgagaataatccctagattagaaggtgttcgggagttaatcagaagaaagaaaacagagaatgattagggataattccaaagtttgatgtgaacaagaaggaaaagcgagggcagttacccaaggagaagatagaa

SEQ ID NO: 152057 - DNA, 732 bp, Homo sapiens
tgaaagtaaaagtactatccccagtgctttatatacatttatatacataattatatttaatcctcatggattaaacacttataaaataagtgttactgttctctttttacagatgaagaaactggggtacagagaggctaaagagatttttcataatcacatggtcagagtgtggaagattcaagaaagtggtttatttctgtatgactgaaaaccttatgcaattcatgatgctcagagcagtgagcagtagaaataagatttagtgtaatattttgcaagggctgaaggtagagaaggaaacaaaggtgaaaatattaacagaagcaataacaataaaaataaccactagaatattgccatttaggacagttatgggccaagaatcaaatagggactttacataaagtatatttatcttcctaaccatcctaaggaatggtattattatgccattctaagacctcacaattaaagtcaggaaaattaggtatctctattaaagtcatacaactagtacgtttcaaatacaggagtccagctgtgctccaaaatctatacttaatcttctgccccattgtcagctatacttctgtacttgtgatttttatcttagaaaattatcctcatggaatattttttttaaatcctcatttaacatgacatttatataacacaatcattggaggtatcattatacctacagacctatttatttcattctttgcagtt

SEQ ID NO: 152058 - DNA, 622 bp, Homo sapiens
ggagaactgcttgagcccaggaggttgaggttgcagtaagccaagatcacaccactgcacttcagcctgggcaacagagtgagactctgtttcaaaactaaaaataaaaaaatgacaacacagtcgacctgagctataagaagtgctaaagaaagttctttaggctgaaggaaaatgataatggagggaaaaccaatcttcagtaacaaatgaagagtatcagaaatggtacatatttgggtaaaactaaatgactacttttttcctctttctttacaatacccacaatggattaatacaaaaattgtaacagtcttatggagtttctaatgtatttagatgtatgaaattcacatgacggctataacataagacatgctggctgcaagggtgggtggacaaatggacctacatggttgcaagttttctatattttacatgagataatacaatactaacctcaagtagactatgaaaagttaaagctgtacatgatatttcctaaagcaacctctaaacaatcattaaaagaggtatgattaaaataataaaaggccaatagacagaattcaaaaaaacattcaaacaattcaaaagaaagcaggaaacaaaacatgggata

SEQ ID NO: 152059 - DNA, 240 bp, Homo sapiens
atcaagacttggatgacaactttgagtgactttgctattatgcaaggagtgaggcaggggtcagggaaacaacaagcacagggtagaacctgtcacaggaataaaggtgcattccaaggatccaaagaagaaccttagccttgagaggaaaagctcagcaagtggtatgagaaatggagaactgctaggtgaaggccaacagggcaggaagccgggcagagccagcatgaaggtgcctct

SEQ ID NO: 152060 - DNA, 460 bp, Homo sapiens
cattctataaacaattacattcacatacacactaatcttcactacatttttgagaagggcaacaattaaaggtgtatctattatggtacagccagaattagatttcttgggaccctgccaagcaaagtcatagcgtcttggttgaaaagacaggagcaagcactgataagaaactgcagggaaccacctaacttactaataatgtcttagggtttatcatctataaaattggtatgatttaactgccaggtctatctcacaggttgctgtgaaaataggactaaataaaggcactcagacaataatgttactaagtttctcaactaaccttgaagcttccactccacttctctgctcttcataaagtgcaactccctaagaatgccttcgcttcctctccctgtctcttcaaagcaccgtaatcacacttcaccctcaccactcttggaaatcgctcttt

SEQ ID NO: 152061 - DNA, 366 bp, Homo sapiens
gaaaaacaacagaaacactagaacaaaaaccaattatgctcattatctctatgatcttggacctcattattatgttttaaatcatattactagaataaaagttctcttttttattttttggttttatcattatttttaattggcacaaaataattgtacgtattattggggaacagtgggatatttcaatacatgtgtacaatgtgtaactatcaaatcagagttattagcatatccggcacttcaaacacctattttttgccttgggaacatcaaaatcctttcttctagctatttgagaatatacaataaattgttaattatagttaccctatagtactataaaacattggaacttattctttt

SEQ ID NO: 152062 - DNA, 358 bp, Homo sapiens
ttctcttgcttggccttaaaagagcaacaacacagcaacaaccctatcaccactgtggtcacaccctgcgaacatgacctcctgcagagaacttctatgtttcccaaagtgacctaaaagggcatttgtatcccaaagggggagaggctctaaaacaagcccaggagaaaaatccactgaagtgctgagtacagggcatgagtacagaaatcattgcccatcactctgatttaatggctagaagctcaacagctctaacaggagagcaatgggcaaagttgcagtgaagctacttattcctgtgtctcatctttctcacttattttaaatttattttatcttgttctgttgtttgcaa

SEQ ID NO: 152063 - DNA, 181 bp, Homo sapiens
tataactgcattctctgctctttaacacagactgtcaaatttggagtcatgcaggggctagggttacctaagggaattcatcttgtaaatgcagtttaagaaagcaagctgttaatcagcactttctctagttagtatcctggtaaccttgtgcattacaagttattcatgcctcatcatt

SEQ ID NO: 152064 - DNA, 378 bp, Homo sapiens
agcttgaaacaacaaggagggacaggagtctgagaaatagtttataacatcaagagctgaccttgatttcttgcggatggagtgttggacactcaaagggcacgtgaagccctgtgcgtggctcacctcattgtatccttgcaacgtcctggaaaatgtgcacaacaatgtgacttaattttcagacagggtaaccgaggcttggagaggcagagtagtttgtccagggccacactagtgaaggcaaagcagggtggagctgtcaatctgggtcagcccagctcagtctttgcacgtcactgccgttcctccttaggtgcagtgttttagttacagtaactttttaagaagaaccatcttcatgcttctggagatgat

SEQ ID NO: 152065 - DNA, 152 bp, Homo sapiens
ttttatcgcagtcactgcaggctgtggcataaactgaaaaaggttgagaaagtactgctttaaccttttcactagtgacataaaaaactccagcccccagcattgttacctacttttgttatcagtaggtatcctcttttggaggcgaagtg

SEQ ID NO: 152066 - DNA, 229 bp, Homo sapiens
aaggcacctgaatgcctataaaggcatctattaagacaataaaggcaaaagaagagtattttcccctaagaaagaagagttttctatggcttgtggagagcatttcaaaaatttaagacaaagcacatactccaaaaaatattgtctaatttctccaaatccctggtctgaattaaatgctctttctacatcaccaaaggagagagaacataaaatgaagttgtgagta

SEQ ID NO: 152067 - DNA, 567 bp, Homo sapiens
tcttctccaagcacgctgggcccatctgtcctgtccctgaggactccctggcacacatgacacttcagagcttttgccaactccactccctgcctgaaatgcccatctccttcagagagcttctatgtatccttggaggtccagtcctaatgtccctgcctccgataagacctctccccatcttcctctcgccctgctcctgtccccgccaggcatgacaaatctcttcccacagtgggcccaacagggaggcagatggtagaacaggttttgggccaggtgccaggtgcacgtggctcttcatcctggttccccaccgcacacctggagagctgagtgcttttcctgaggtcacgcagaaggtgaccagcctggctctggagctgtctctttgccacatcgtggggtgtctttaaggtgaccttgaatgtgcttgaagctgttttatgtcctatttgcagacctaggggaggacaatgccagggctttttgccttcccaaggtcacagcctgaagacactcagaaagatgtagttggctcatttatcattttttagaaaaaaagaa

SEQ ID NO: 152068 - DNA, 954 bp, Homo sapiens
taggcgacaggcacataggggttcattatattattccctctactttcatttatgtttgaaattttccacaatacatactttttaaaagagtaatgcatgagccaggcatggtggctcatgcctgtaagcctagcactttaggagaccgaagcaggcgaactgcctgagctcaggaattcgagaccatcctggccaacatggcgaaaccccatctctacaaaaaatacaaaaattggccgggcatggtggcatgtgcctatagtcccagctactcaggaggcagaggttgcagtgagccgagatcatgccactgcacttccagcctgggcgacagagcaagactccgtctacataaaaaagaaaaaccaaaaaaagattaatgcatgaatatatatttctgattttcctgctttatcagtttttcccctcaattaactaagcacatcataaccaaaacttactgtataggagggcttctattggagataaaagaaaagcagttaccaccaaatgtccaaaacacagataattccacagtcataaccccacaacatactaagcacaatatcctatatggcccaattacccttgaaaatctcttaacccataaagtacaatgcacacagcaaatttaaacatgataggactgctgcattaccatatttattcatataactttctccttcacaatctccttgactatcttttcaccattaaaacgagggaggagcaatttacaacttttattaatctctgaaattctcacgctggtttaccaaaaaatagttatttaaaaatcaatggtaggctgggtgcagtggctcacgcctataatcccagcactctgggaggccgaggcgagtggatcacgaggtaggagttcaagaccaccctggccagcatggtgaaaccccgtctctactaaaaatacaaaaaaattagccgggtgtggtg

SEQ ID NO: 152069 - DNA, 493 bp, Homo sapiens
caaaaaaaatcctacaaacaggtttcctcttaaggagttgaaagggtaagctagtaggtgttctaagcaagttatgatcctgagccactctacccagaagggaactccatcacttctgtaccaaagcccttaatccaagacgcctcatcacagttattttcagaaaacatgtcttacattagcacttctcgcagtagtacaaaatgatttgacaagtaggttatttttagcaaccaacattatgaaggtgacaaaatgagagaaatagccttccttgtctgctttctatgcttcatttttcttcaaaccgtatataaatttttactaaaagctgtaatatttgactaaaacataaatgctgagaaacacccacaccaacagggaagggactctgcgatgtgtttggtttgacttgcctaaaattaattattgaaaacacagaaaattggcctggtgcagtggctcacgcctgtaatcccagcactttgggaag

SEQ ID NO: 152070 - DNA, 207 bp, Homo sapiens
gcagcatgtcctaaagcagcggtgtgtgggagcgtgtgtgtgtgtgtgggagcgtgtgtgtgtgtgagagtgagtatgggggtgtggatgtgagtgtgtgtgagtgtggggtgtggatgtgagcatgggggtgtctgcatgtgtttgtgagtgggtgtgtggatgtaaatgtgtgggagcgtgtgtgtgtgtgagtgtggggtgtgg

SEQ ID NO: 152071 - DNA, 497 bp, Homo sapiens
tgtttatcgatgccacatgatagggaacatttccgagtcatgtggcaccaaagtatgttaccagtggggaatccatgtgggactgcaacaacctcaattcttgcttcctcagaagaaagaatttggctgaggggcacaaagcagaaggagacctaggcaaggtttagagcaggaatgaaagtttttttttggagatggagtctagctctgtcacccaggctggagtgcagtggcgcgatcttggctcattgcagcccccgcctcctaggctcaagcaattctcctgtcttaggctcctgagtagctgggattacaggtacacgctaccatgtccagctaatttttgtattttagcagagacggggtttcaccatgttggccaggctggtattgaactcctgacctcagatgatctgcccaccttggcctcccaaagtggtgggattacaggtctgagccaccatgccctgtcaaaagtttatttaaaagctttagaa

SEQ ID NO: 152072 - DNA, 488 bp, Homo sapiens
aactggacagtcaacagtacctgctgtctctttgctgctttctctggggctgctggtttcttgcctctcctgtcgtctgtgcctctgactcttttccttctccttgaggttaattctatgggcctgaacccattgctccactccctttgttgtgaaatgagtccccaagcaatactctggcgggcttctcatctgtttcagtcgcagggatcttgggacagttagtctttgccaaacctcctacaggccagggcttgctgaccacaggcatgtcgtgcggtcctttatggcgggtatgctcgcactgcgtctggaggttgggcactgcctcttggcttctgctcttgggagctcatatcaatggtgggcacacccccgatccatcatacctagcctataaaggagaaagccacagaccttctaaggatgcaggtgttccccccatgaatgtatttctcagctccttcatagagaaagcattttctggg

SEQ ID NO: 152073 - DNA, 157 bp, Homo sapiens
gctgggattacaggtgtgagccaccgcacccggccagatttttaaaaatcagtatagtcattggcactaacgacagcagtttcaggcttcagggtgttatatcacctttccatgatttttaaggaaaatattataatatgctttactttcctgttgt

SEQ ID NO: 152074 - DNA, 792 bp, Homo sapiens
tgaaagaagatgaagatgcttacaagaaacagttctctcaatacataaagaacagcgtaactccagacatgatggaggagatgtataagaaagctcatgctgctatacgagagaatccagtctatgaaaagaagcccaagaaacaaaaaagaagaggtggaaccatcccaaaatatcccttgctcagaagaaagatcaggtaactcaaaagaaggcaaactccctcagagctcaggagcaggctgctgagagctaaaccaaacaattttctatgaggatttttcagataaagacaataaactgatggatagcaacaacaacaacaaaaaacagaaatcaaaaaaacaaaaaacaaaaatgtgcaggaggaatatgttagaatatttcacaatatttatttatatgatagttgaattccttagttggtggttataccttgaaatgattcttggatatagcatagaattatcagtatactgctaaagcaatgactaagagggacaaagaatggcggttgactttacctcgaagtatgaaatttgctttcattataaaacaaatattgttcttaaattacttaaaataactttattctccttgtgcaaaatctaagtctatttgcattttactgatcacagtctctattacacaaagattttcctcctgaactcactgctctttattagagctttcttgtaagcatactacaaagctgtaatattctcaatcttaaaaaaaattcttataaaaaaccacaagtaaataggctgggtacagtgacttgcacctata

SEQ ID NO: 152075 - DNA, 465 bp, Homo sapiens
tgaaagaagatgaagatgcttacaagaaacagttctctcaatacataaagaacagcgtaactccagacatgatggaggagatgtataagaaagctcatgctgcattaaattccttgctttcagaatcataaccagggaatcgtttggtactgtgagggatagacaagcctccatccacagctcccttcagggcaccaaaaactttattgccagtggtagttctggcaaggcctgcatccaaatagcaggtgaaggcacctggctgaccatcaatgctttccacattgtattcatcaccagtcacctccacttggccttcatagatcttgtccatgccaaacatattgagaagcttgcgggccagcagcaggccagtacaatatgctgcagcataatttgtcaggccaaccttcacaccatattttggcagttcgtgtgcatacgccgcgcagagtttgagggatc

SEQ ID NO: 152076 - DNA, 446 bp, Homo sapiens
gagataaaaataaatagtaaaaaaagctagtcttttcttcttgtatcccagtggctcgggatgctcatctggagcagaaggacacactccagtcaactaggccatcactggccagaagttaggccggagaagactgtcttgggttagtcttaaacagggccctgtcatgagccctagctcctcagactagtccaggctggttacttggaagaggctcaaagccagttttcttcaaggaagcaaggctatttttcctgccttgggaagtgacaacccctcctggtgactggaccttaaaatcttcctgttttgtaagataactgtcatctcccagatttttacctccaaatttgctccaagaaattcaagtcctttcttatctggccccacagcagctctgaggaaggagactgtgttcacttaccttacaattaagttcaacccca

SEQ ID NO: 152077 - DNA, 365 bp, Homo sapiens
ataagaatcagccattgaaaattcctatcacttccaatgattctgaattactgttcggaaatgtagataactttactcaatcttgtagcataggatatctctggcttcaaagataaccacaatgggccaggtgcggtggctcacgcctgtaatcccagcactttgggaggccgaggtgggtggatcacgaggtcaggagatcgcaaccatcctggctaacacggtgaaaccccatctctaataaaaaaaaatacaaaaaaattagctgggcgtggtggcgggcgcctgtagtcccagctactagggaggctgaggcaggagaatggcgtgaacccgagaggcggagtttgcagtgagcggagatc

SEQ ID NO: 152078 - DNA, 223 bp, Homo sapiens
agtgtcatgggactttttttaaaggcaattttctttgtatcccagtgggagagttagaaaaaatttacaaagcatctgctgaatgcattttcaattattcctgggctttaccagtgctattactttcttgattgtaagaattttacattttcaaatatgctttaactttacaatgcattaagaattactgttttaagattcttatgatggttttatctcactt

SEQ ID NO: 152079 - DNA, 363 bp, Homo sapiens
tttccagtttctgaaatcagtgcctgtgctgtacccagccctcatctttctttccctctccatctcccatcttttatcatgagctgcctcttggactaaaggtttgaggctcgttcagtgaaccgccactgacagtttgggccttgcattgcttcggggggcacgtctgatcttcccagagtaaacattggtcattttacctggactaatgccagcacacacccgtgtctgggtggcctttctggtcattcttggaagcaggatggagccacggtttctgctggggtggatctgtagggcagcgggtttggaaagcagtgggttgcatctctaaggtggggactcctgtcattggctcaggac

SEQ ID NO: 152080 - DNA, 246 bp, Homo sapiens
aataagcggaaatgacacgcaatctcaggtctccaggggcgctgttcttatttgtgagctgccggttgttcttcagtggctggaatgagaaaaagacttgggaaaagagcagtgttcatgcctgaaccactctcttcttttggtgatttacccagctgtttataaaaggagtttctgcaggcccagatacgtgaatgatgagcaaaagcaaggaatttctttctccacattaagattaagtgttag

SEQ ID NO: 152081 - DNA, 166 bp, Homo sapiens
tgaagaggagagagaagccaggctctggggagctgcaggcagccaggccgggctgctgcggagtgcgtggccccaggaatgggggcgtctggtggtatctgggctggctggagaggtggttggggagatagtgctcttggggggctggcccccactgagccctcat

SEQ ID NO: 152082 - DNA, 266 bp, Homo sapiens
tgcattgcagagaggagggtactggacgcccttcaggggccagggtagagggtgacccctccagctgacattggagctgaggattaaggatgagcagaagtttccaggtggataagggagggaggatattccaggcagagaagcatatgtgggctaattgtctgtgaatagatttgactattgtgatagagtcgcaaacacgaactattatatgccactggcctcgtaatgcagaaggcacgctacccctgctaggaacggcaacc

SEQ ID NO: 152083 - DNA, 131 bp, Homo sapiens
catcatttatttcctcatttatttacttacattagtatggacttacagatttttattttgttatctgggttatattccattatcatcaatagtcatgatgatactcagattatctcaaatgtaggtaatgg

SEQ ID NO: 152084 - DNA, 388 bp, Homo sapiens
acatcttttaaatatcaaagtgagaagcaagaaggcaacataataatgttatctgaaagatgttaggaagtaaggacagctgtgtaaagcttgaggctgaaaagcagcttgccagcttcatttctttgttttctcgggtagtgggtgccggaacagcaagatgtgaggttctggttcatggatcatataatggacccatccctgactctgctgaatgccaagattcctccattcagattcagacatcaaatgggttttagggaccagcttggctatgtccttgggcagcatgacatgtcgatactcaaactcctcgtcgtcgtatttgtccaaatagtaaatttgtttgtgcgacatgatcgctcggtttgctagccttcagccccgc

SEQ ID NO: 152085 - DNA, 716 bp, Homo sapiens
aggcaaatacacctcaataaaatattggaatgaaattgaaaaaatagacaaatgcagattgaatttcttcccacaaccaaatgacgtgaatacaaaggggaaaacaacagcaaaggcatacagtgacaaggaggtggtctcatttccccagaccttgagtctgggctggcattgagatctacattgatcaataatatgacagaagtgattttaagtgacatctgaggctgggccttaagaggacttgagattccactttggctatattggaattcaactctgctctgagacctctacacaaggaaactggtctaagatcctcgtgaataagaagtcacttggaggatagattctaaacctcaagaataagaaataaaagtacaaattggtgtgatgaaggtatattcctatttttggggattgggaggctttacttatttttaaaaactctattgaggtaaagagttaagctgtaacatacttcattgatttcctcacccttttcggctctgttttactatatcccctaatttgttggttgtgctaatatttgtagaaagaggtcttgtatttgctgcatcataatgacatttgtacttttttgactggtttaagtacaaatgaatgaaataaccatttttcctttagttgactttaccctgatttcacctagtgtttcaatgagtaaaaatacagctaaaagaaaagaaaagaaa

SEQ ID NO: 152086 - DNA, 439 bp, Homo sapiens
gccatgcctgaaggatcacaaagcattgtcccacatgacccagatgtgcatctagcaccccttcctggattctcagtccctgggaggtaccttctagggaaccatccagagacgggaacatgtggccactggagacctgccttaggggagttgtgggcgtgttggtcggggctcagccaagttgtgctgggagagtctgtgctctccctagaccaggttctttacagagactggactctggcgggggggaatccttgcaggccattctagggagagttggacatgcgcagggcagcctgggagtctgagtcctcagcagagagtgttctgggaaaagaagaatgctgagtgagatacaatgctagacaggggatgtgggtgatttacttggtgagaatgcccctagactgggcaaatctaaggccagggccctgaagcg

SEQ ID NO: 152087 - DNA, 588 bp, Homo sapiens
aacgggactggactctcgttagtctgtgatggattgatcttctgtcactgctttcccaaactcccagcagtttcaacgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaatgctaaagggaagaacagcagaaacgagtcacaaatggctcaaagcaaagaaccctgcaactgaatggaattgaaagaaagtgtgaagagggctgatgagggtatttagttattattagcaaaattcagatgtgagaacacatctaaagccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagccagctctatgaaaataa

SEQ ID NO: 152088 - DNA, 297 bp, Homo sapiens
aaacagaccatacgctgggctgcaagtcttcatacatggaaaacaactgcaactggcatccgggaaacgcagagaaggacacaacgagatacactccctgaaatcagagagactggcaacgctgagtgctgaagagaacccagagcagctggaatcctcataccttgttggtagaaatggtcaacagtacaatcttcatggcatcagtatggcaggtgatgagtcacacactttttttttttttatcatttttttcggagaacggctctttcgtccctgcgccctagggtaaggggg

SEQ ID NO: 152089 - DNA, 255 bp, Homo sapiens
tactgggattacaggcatgagccaccatgccaggccccgcccttactccttttgaagtccaggtggttacagctgcccctggaaggggcagattgtggatgcaagccccctaacagcagaaaaaggctattgacagtgaatgagggacttccaattctagaaatagatcccgttgccttaggggtggatagtggacaaggtactaacaccaataaatgcctcaaagatttcatttgcttttgaacttgcagaaat

SEQ ID NO: 152090 - DNA, 401 bp, Homo sapiens
cgtcctcggtacccgtgtccatcccccttcgtttggttggttagttggttgattgtatttggaggtagtattaggaattgtcctgagagaggagaatgtgatctatgcaggatctagttgtttgtaggagaagagtactccagagcctccagtccaccatattgtcagaagtagatgtttattcagctcaattcttagtatattcaacatttcacatcctagatgtgctgttccttgtccatatcatgtcattctgctggatggagttattccccttctctttccttagtatcaccaactctaagccaaaaggaagtaatgaagaggatttctcatcataaggtaggaccacaaaccattccttcatcctaaggagtgaagcacctctctcttcaacttga

SEQ ID NO: 152091 - DNA, 153 bp, Homo sapiens
atattgtatgcttgtatcaaaatttcacatgtaccccatatatatgtacatttatgtatccataaaaatttaaaagcctgactgatttacctgcaaaacatgttcagagtccagccatttcttatctgctaccactgtggacagagccaccat

SEQ ID NO: 152092 - DNA, 710 bp, Homo sapiens
ttttcctgattttgccctcaccatttcagtgcaaaagtgctaggctatggagaggcaccctcctagccctgatgttacttggagtgcccaagggtctcacatacgtcactgacaaatcagtctgttggatatagtcatcagaagccacctgtcttctgctcctgcatgcccgtgccctgcctatgaagcatcacaggagagtgtttcacctctgctcttgtttatggtgtccaccatgagaaagccactgatgggccaagtgtcccgcctcctgatgctccagagggccagagttttcctagcttcctctctctccagcctgacacatcctgcacagtagatgttattacaaacgaggaaacagaagcatcttgacattttctcaagtgaatagaatagtgagtgctggggctagatttggaacaacagtgaccacgatggattatgctaaaatctagaaaaaagggaaacagatcattctggtgtgtctgctgtgtatactgttgacatattggcaaaaatcctgttatttcttctgtcattgtgatagcatatgaaagctatttaacttattcaagtttgttttgtactaagaatgcagaatgttctattctggagtgttctattcttcattttagaaacattatgataaagaccaacgttttataacgtctaatcaatgaccaagtgctgttgactctttttcttaa

SEQ ID NO: 152093 - DNA, 309 bp, Homo sapiens
gttgcctaggctggtctcaagctcctgggctcacgcaatcctcccacctcagcctctcaaagtgctgagattacaggcgtgagccactgcacctggcccggatagaatgtttataaacagagtattcctctgtgaagtatgttagttcttagaaatacagaaaagtctcttatggaataacagtaagtagaaaaatacacatttatctaaatgtaactacttgcctatgatatacatcatttagtgatggcttaaactataagatattgatcttcagaatgataaagagagtgggcttgatgtcatttg

SEQ ID NO: 152094 - DNA, 487 bp, Homo sapiens
atttgctatccgagatctttactacataatcagtgttatgggctcaattaggtcccccaaaattcctatgttgaagccctaacccctgtaccttagaatatgactgtagttggagacaaagcctttaaagcagtgactaaaataaaatgaggcccttagggtgggcactaatccaatccaactggttcccttataagaagaggaaatttggacacactgagagacaccatggatgttcccggaggaaagaccatgtggggacagagagaaggtggttatctgcaagccaaagacagaggcatcaggagaaaactaacctgctgacaccctgatcttggagttgtagcctacagaatgtgagaaaatgaatttctgttgtttaagccacccactttgttgtattttcttaagacaggcctagcaaactaatataatcaataaatgtatttctttattgtttacatttcttccatttttgttaaaaaat

SEQ ID NO: 152095 - DNA, 741 bp, Homo sapiens
gtgacctgcaggcactggaggggctgtccttccctatcttatggacaagatctcttggcttgggggacactgtctccaaggtgctaatagtcaagacctcaacaatgactcacttggactcggaaaccaacctaacttactcagggtgcctgcggcggtggggcttttgtagaccaaagccaagttttgccaaaggcagcaagtgctttataagctgaatgggcaacttacaggaacgaaagctgagtgaccttttatttacgggctgagtccttggcttgaaacctgccagttgaacagtctaacttggtgtcatatggagcatctgaatcacagtctcttgagtcttcctctgagaaggtggctggaagaagttcacatttctcagcattgaaaacaccttctgctctttacctctgttgaagatggccttacaaaaggctacgcgggtcagccgtgagtaggagagtagtttccaggagcacctgagcatgggggaaccgaagggctttagttgcagaagataagcgaattccccgagtgtcaggttggtggcgtgttagagaggccactttcctcagagaggttacagatgagtgtctctggaaatctttttttttttgagactgagcctcactctgtcatctaggctggagttgcagtgagctgagatcgcaccactgccctccagcctgggcgacagagccagactctgtctcgaaaaacataaaaaaaaaaaaa

SEQ ID NO: 152096 - DNA, 703 bp, Homo sapiens
cagtcatcccctaactcccccacagtcagtccccaaagatgccatatgctttcacttctccatgcccttgctcatttgtctcattgcctgaaatatccttttatttcaccaaactgctgctcatcctcaaggccctgcctgagtcacctttccttcttgcttcctcccccttgcctcctctccccactaccctaagaaaattcatccctcccccttcattaatatcatgcacatgcttgttattatatttaacacattgtatattaggtatttgttttgcttatccttttatcctatgaaattgtgaacaatttgttgaataattgaataatcacgtatcaaaatgtagagaggttatttgtctcttccctgtaggactacattttcaggcagtgtctgctaagaatccccttgacctgggattggaagttgtttctcccactgctgagctcctttatattagctcttcacctctcactcctttgtttcttctcttggcactttacgtctttctacccatttaatttgataaatgtctcatgtcatctttaaaactgaaggtgacacatgtctggtttatctttataactcaaaaatgttgagcttaatgcagaatggagaatagctacttagtaaatttttaaaatacatgctaccatttttaaggggagaagaagacaatatacatgacttaaaaataaaa

SEQ ID NO: 152097 - DNA, 212 bp, Homo sapiens
ctgcatggccatggtgctgaaccttaggcaagggcaaggacacctccctagttcccagtcatggtgaggacctgtctgaaacattcaaactagactttactggaaacagagaagtctctgcattcagggcagctggcttgcaaggtaaggcctgcagtctccacccgcacgctaacccatgaggggatgccagagagagcccttcccccttg

SEQ ID NO: 152098 - DNA, 197 bp, Homo sapiens
ctccccttacagatggagacactgagagggtgacgtggccccagggacctttggagtccttggggcttttctcctctgcatcggctctgaccccagcacacacaagctccagctccttctcacacatagtggaactgcacagtcgctggtccccgcctcctcccggtgtgttggtccccgcgccctgccttccccct

SEQ ID NO: 152099 - DNA, 293 bp, Homo sapiens
aaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatgg

SEQ ID NO: 152100 - DNA, 603 bp, Homo sapiens
caagcgattctcctgcctcagcctcccaagtagctgggactacaggcgcgccaccacgcccagctactgtgtgtgtgtgtttgagtgtgtgtgtttcagtgtgtgtgtttgagtgtgtgtttatgtgtgtgtgtattttagtagagacgggtttcaccatgttggacaggatagtcttgatctcctgacctcgtgatctgcccacctcggcttcccaaagtgctgggattacaggcgtgagccaccgcgcctggccgagactagaacttctaggggtgtttctgacaccaaggaaaaagtacagcgggctgtttaggcaggagagcttaggagggggccaggggcagctttgaagacccttaacgaacgttctaagattttttgtctgccaattaactaaaagttaagtacgtgatcacagcatcgccttattgaaatttcacatagttgaaagatgctcaactgagctacagcctccttgggagagtccatcactcaaacacaactctgatgggtcatgagtagcactcaggggacttgaggagacattcccatcttcagagcccagccatgacagctctgcattttactcagagctgggca

SEQ ID NO: 152101 - DNA, 263 bp, Homo sapiens
ggaatcggtctcctctgacatcaaataggtttatttttcccttctcttcccttcccctctgcctgccaccacacatggtaatttctaccctggtttgccccccaaaagccctcactcagctcaacacagggttgcgataaatggctggctgtgctccctgttccaacagccttgaagggtgtggttggttgttccatgagcagggagccttgtcagacccgtgaatcacccctcgatcacttccctccccagagaagaaaccg

SEQ ID NO: 152102 - DNA, 206 bp, Homo sapiens
agagacagtccatagttttcagtcaaaaggctaaaggggaaagtgacccaaaaacatgaagaacacttgagatgtccttcagagtcccaattcctacccccaaactcaaggcttatgagacataagaatagtgtgatgcaacccagctgtggccaggaggaaagtacagtgagtcaggagacccctcttctttctctggcccttta

SEQ ID NO: 152103 - DNA, 383 bp, Homo sapiens
tatccagaaacgatttgtaattcaatacagttaaaaggcagggaaagagaagagacaaaaaaaaggaaagcaaaattgagtggttaaaaagggacagggttggaaaaaatggcagcatcaggtgtctggaccacagatttctgatggccttcagtcttctttctttggcttcatcttcagagtgagtaggattttgccaacccaaatcaaaagaatgagaagaaatggaggaagagaaagcaaatttgcagctctaactaatagcctttcagatgtattttggctcttaatctactcactggaaacccttaagaggcaaaacgatgcaggaggaatggaaattgagtagttcagaaaacctaggcttttttatttattttact

SEQ ID NO: 152104 - DNA, 480 bp, Homo sapiens
gtctttgttatatagcgaccccttcctacaaggtgggctgggaggcttagtctaaaaggcttcattggcataccaagatacattatggtttgcttagtaaggattaaagtcactactacagtacctgatccaaaggctttaaaaaatcaggttcataactggtcttaggtggagcaaagcaactttacttaagcatcaactcagcatttcaggtgtgttttggcttccaaaaaaagggagatcattcatacagtagactcttgatttaattagcaaaggttccaatatttggtgcaaatgaggagaccaaagagcaagaaaagatgaggaatatcagtgcagcatcctttgatggatatcactgggcctaacagaagggacgtggtggcagtgagactgtctgttcaggatgtggaaaggcttaattttgtgctttaccatagtccttttatatttgggcttatatccctattgaagaag

SEQ ID NO: 152105 - DNA, 308 bp, Homo sapiens
gccttgggcaaatctttcagcttccctgtacttcaacttctatgtccatgaaatgaaaatgcaaaaatatctgcttatcagaactattctaagttccaagctgaatgcctgacatgtaggaggagctaaatgaatgagagctattgtttttgtacatgtaattgttaaggcttttagattatccctactaccttttcttttcaaaaaacctgctggctccccactgatctcttgcattacgaacaaattcattttcccatttaaacctccatcccccacacctcccaccaagtgaccccagtctactc

SEQ ID NO: 152106 - DNA, 275 bp, Homo sapiens
ctcgagcagagatgtctccccaagtccagcttgcttcatatcccctgcagttctggtggtgggaacccagaagtcagaacacatctacctcctggcagctggaggccacagcgccccgagtttgggacatgcccctctctgcatgtccgtgccaattcctcaaggctatcggccagcccctcccactcaaggcaccccatggagcctcctgggagatcttcagacccagggcaggtgggggctggatctgcccttccttcggtgccccaggtctg

SEQ ID NO: 152107 - DNA, 423 bp, Homo sapiens
cttgatcgacccttactgtgtgggagcactgcagctaatcaagggtggctttaatgaacttaaaagaatgctatccaagtatttcataatagaaaaacttcaagtccaggccctgggggacctggaactgaagtccaggccatgtacagacatttaccctgccctgctcaggcatacaggtttgtggatttgctcaggagcccccgagagttgctgggggggtggaggacagatggagtgcctttagctcagctctgcctacacattagcagtttgagctcccagctccccaataaaaggggtggaggctgggggaggcctgggaagactcggagggttttggttgctctgaagcagctggcctgtgatcaagggttgaggagttttctctcagagactgtctgaatgtggcttcttagagga

SEQ ID NO: 152108 - DNA, 613 bp, Homo sapiens
cagtgtccatccagcagaaactaacagggcgcctgctgtacccaggcattctgctggggctggggacgcatagagaggacagggtccctccttcacagctcataggctcttcaggggcaattccagcacatagtggcggtgttctgaaggaggaggctctgggagcttcatgagccccacaatcttcctttgaatgtgagggaaggcttcctggaggaggtggcatctaagctgaaatgagtgggactttgccaggtgtgtggggaaggtggtccaagaaaggggaacagcatgttcaaaggcccagaggcaggaggcagtaaagggccctttccatcctggcagctgccagccttaccccactggaccctttcagggttcttcatgagactgggttttttttagagacagggtctcactctgtcagccaggctggagtgcagtggtgtgatcacagttcattgcagcctcaatttcctgagctcaagcgatcctcccacctcagcctctcaagtagctgggaccatcgttgtgtacacagaaaatttgaagaacgtattcggctttccacaatgcgcactgcgggttattgagttggctttacaactattgt

SEQ ID NO: 152109 - DNA, 247 bp, Homo sapiens
ccagcagccttccctagatgctcaagaccagagctgccagaacctgggttcaagctggggtcagagagtcagcccagggctttctagaataaagacagaaggatcttggaaatggggcttccaggaatctcaggcaatgtgcccccacctcacactgactgcagagctcagtcatacaatatccatctcattccctctggcgcccctggtagatgattaataaatattcctggtgttaaatcccata

SEQ ID NO: 152110 - DNA, 352 bp, Homo sapiens
ttcagtatctactaacatacttaatgagcaagagttgggaaaaggcgggatgccgtggctcatacctgtaatcccagcactttgggagatcaagacaggcagaacgcttgagctcaggagttcgaaaccagcctgggcaacgtagcgaaaccccatctctacaaaaaatacagtttgctgaaagtaattataaggaatgaagtgataaataaaatttaaaaacaaccaaaaaaaaaagaaaactaaagaaagaacacaaaaaattagtcaggtgtggtggtgtataccagtggtcccagttacttgggaggctgaagtagaactaacacttgagcctgggggtcaaggctgt

SEQ ID NO: 152111 - DNA, 643 bp, Homo sapiens
gggtggctagttattaaagtttgtttgacactcctagaatatcagaattccaagttgggagcagctggtaggcaggagcagatcctgaaaagctttgaattccttgccaaggagtttagatactatcatgaagccagtgttggtaccttggaagggaagattagtagttgaactttaggaagatatcacatgtttaaaggatgtagggaagtcagttacaaggttctgacaggagttcatgcaccatgatgaggaacaaacaggcagtggggatggaagtgaaggaagaaacagaatttctaaggacttcacaataaatttgatggagggccatgcagagggtgaaggaagagctcagttggcttccaagttgtttttgtgtgactgtggatgacaaccaagataggtaaatagaggaagagcagatttggagggaagattatataatcaattctcagggtatttaaagattggaatggattggtggtcagttggccatatttatcctagagctaaggggagagattggaccagggaatgaataataggtattaccaataaggttggttagtaacttcctgcgagtggattgcccaaagacagaaagcaaaatgatacctgaaatgtaagaggaaaaaaagag

SEQ ID NO: 152112 - DNA, 449 bp, Homo sapiens
ctcactcaggggatcctgggaggacattttctagggttggatctcagtgagaaataacttccttacgtggaattgctcccagtgggtggcattattattcagtgcttttaccctcggctcctgatctctgggttcaagccctttcaaatctaatactgtatatttgtaaaggtcaacctattgttttcatcctccaccggtttgtctgacctcgtttgtagattcaccatttctgttctgtgatgtcacctctggtggggatgggagtggaatgaggagggaaatgctaaaaagacaagagccccagaaagaagcaacgtatcctcgcccactcttagaaagacagcaccctcagaaacaaaatgtctggcttggcagagtcatcctgtttgtccttatttgtaaaaagaaaagaaagccaaacttttgtgattttcttaagatccagg

SEQ ID NO: 152113 - DNA, 427 bp, Homo sapiens
ttacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaaca

SEQ ID NO: 152114 - DNA, 658 bp, Homo sapiens
ttttggccaggctggtcttgaactcctgacctcgtgatccacccgcctcggcctcccaaagtgctgggattacaggcatgagccaccgtgcctggcccatatacaggatttttatagcttatccatttggtacatttaattactataaagacaaagagtttggcctcatgcagtcactgacttgctatgtggttggtttccttgtgtgtaaaatggagatgatgtgtgaagatgagatgatatggcaaatgtaagcatttgccacagtgcctgacacagggtacacgctcaatccagagagctactactttctgtaaaaaactggtttatgtcagactccttggttccatatgctttataaacacaggaaacaggaatatctacataaaatctgtaaatgcattttaggcttctcatgtgctcaatgttgattactgacatgtcccattcttgttctgactattcaaaggttgggatctgggggagagaggtcagtgcagaaaataatttgggaatattcttaccaatgtgctgctccctccatttttccacttaaattcatttaagccttgcctcgttttttgacagtgttagatgaggttaaacagaatatttgtcttcacttagttctcaagaaacagattctgagggcttctgt

SEQ ID NO: 152115 - DNA, 175 bp, Homo sapiens
tgagaagaggagtttctctccctggttgagaatccagggcatttttgtcatggatttccattaggagtcacatccagaaaactgccaagcttctgacccaggagatagaggataagagggcacaagatggcccagaggatgagtggacacattgatagttgagtggtaaaggctc

SEQ ID NO: 152116 - DNA, 367 bp, Homo sapiens
tggcacagcaacaggtgctggaggaccctgagaccacagctctgtttccagatgtcccggctcctggcttccacagtcatagaaggcgggcagcaggttgctgtaccatcctgtgatttcaggggacccacaacccagctgctttgtaagcagtgtgggagtcaaaaggcaggaacgtgaagaggtaccagggtcaaagggaaattgacctggagatgaagccatgccaagaaaatactgtgcctggccaggtacagcggcttacacctgtaatcccagcactttgggataccgaggcgggtggattacgaggtcaggagattgagaccagcctggccaacatggtgaaaccccatctctactaaaa

SEQ ID NO: 152117 - DNA, 411 bp, Homo sapiens
aatctgctattcccccatcaccaccccattccacacactttccctttttgtatttttcccctagaatatttatcacctacttgtacactacatattttacttctttttgtatccattcccctgactagaatgtgacctgaataatgtcaggaactacatcacttttgttcatctctgaaacctaagggcctaagaaactaaaatattaatagttcctaagacacacggtggttcaatgaatacatgttgaatgaagtagttattaattttgccattaaaatggaagtcactggctggacacagtggctcatacctataatcccaatgctttgggaggcctaggtggaaggatttcttgagaccaagagtttgagaccagtctgagcaacatagcaagaccctgtctctacc

SEQ ID NO: 152118 - DNA, 318 bp, Homo sapiens
ccttaaatgagcaccactgcatctttccttgaggactgaagactggcaaagtctccatcacgattctaaatatgaatgcttagtatcacctgtccagtgacagggcaaggggaaggccaggtaggtggggtctcaattacaacacccttgctctgactgttttatttattggattctctggtgggcttccagggaggaggtcgagttgggttctgtgactcctggagagcaagccacatctgcagagagccgggtctacagtcagaaatttcttttcgaactaaatataaccttaaaatactttacttaacttgcctc

SEQ ID NO: 152119 - DNA, 252 bp, Homo sapiens
cactgagaggttaaataacttgcccaagattacacagccaataagtgtcagggctgggttttgaactctgtccttgcctctggacaagggttttgtctgcatcatgtggctcagtggtcctctagaccgaagctcacctagatggccccacatatcacaagagatacgtgcacaaaatagagacccccacactgcacacggggctaattctgcaagataattttggggaggaatcttaactattactttttg

SEQ ID NO: 152120 - DNA, 298 bp, Homo sapiens
aagaatactatttagcagtacaggtacttgcttcgatatcaggaagtctgagttcttatcctggctctcacaacaattagatgtatatccttagaaaagtctctcttcacggtcaggcgtggtggctcacacttgtaatcctaacactttgggaggctgtgggtggatcacgaggtcaggagttcgagaccagcctggcctatatggtgaaaccctgtctctactaaaaatacaaaaattagctgggcgtggtggctaacgcctgtagtcccaactgctctggaggctgaggcaggag

SEQ ID NO: 152121 - DNA, 377 bp, Homo sapiens
gtgaagagctttccctgcgatttgcatctctgggatctctgcgcatagcaagtgaccaagtcagaaaacttatccacatccaggcagcctggcacaacaggatatccccacgtgtgcatgtgcgtgtgtccagagcgaaggtgtaagagcccagattcaaggtcactcagtgctttcggaactgagataaaacccggtggaggggttgcggggaatttcactctgcccctgagaagccagccccacccagccagatccagcttcctgtggggagctagagtgaccctgggagggaagggtggcctcagggaaggaagaaaggcgctcttgggactggcaagtagtcaggtactttaccatgaagagctaaaggcatg

SEQ ID NO: 152122 - DNA, 306 bp, Homo sapiens
ctagttttccactggtgaaaatcatgcagtacacaaaatattgaagtagtgaagaaatcctgacttgttaaaaaaattcccaagtcaaatattcagattgtttctgattctaataagtgcagtatttatagatcacattttctccaaaatacccagccaccttcttcctttttcttttttgctaattatccataatctacccaaatcctttccttaaaacttacccttccatattctgtaaacacctaaatgcatattctaacacttatttcctacctccagtgtaaaaaaatgactctaggggaa

SEQ ID NO: 152123 - DNA, 266 bp, Homo sapiens
agactggacctgaagcctgagcttctcctgaaattagagtacacaacttataatgtacaagctgctaaaccccctttctgtacaaggtgattggaatggaactcttatgtacagtgaaagtacaagtcacgtttttcagccaggaaaaagccaaaccagacaacctggaagaagtgggatgcaacaagtgtcagtaaggaaggaaaatagtaaactgtattcttaagtctagagaagtatgattctgggggaaagatgggtggcct

SEQ ID NO: 152124 - DNA, 513 bp, Homo sapiens
agctccgtctccggtgagatcagcaggaggtgagtgagcatcagtcaccacctgagctccgtctcccgtcagatcagtggcggcattagattctcataggagcgtgaaccctattgtgagctgcacatgtgagggatctaggttgcatgctccttatgagaatctagctaatgcctgatgatttgaggtggaacagtttcatctgaaaccacacacccccatccgtcctggaaaaattgtcttccatgaaacaagtccctggtgccaaagtagaaataacccagatgtgcagtagtggaataggtagttaaattgtggtgtgttcatgtcatggaataccatacggcagtaaagaggagtgaactgctatgtgtaacacatggatgaatctcactagcatgatactgagtgaaagaagccagattcaaaaagaccatgtactgtacagttcatctacctgaagttcaggaacaggcaggattcatctatggtaatagaagtcagaataatagt

SEQ ID NO: 152125 - DNA, 166 bp, Homo sapiens
tactttctgcttactatatttggtaggataatcctaacatatgggttccttcagtgaggataaaaacaaggaccgaaaatggggcctgaaggaatcccgtactgcctgattactcctgccatcatgacccttggccatcatatgatttatctctacactagcagag

SEQ ID NO: 152126 - DNA, 306 bp, Homo sapiens
tgcatgttcaagcagcacgcgaggacgttttccttgtaaaagatgaaaaaccaaacccagatgtatgcggaatggagcacagaggctttctcctcccataagtcaaaacaaatgacaggacactccaagggtgccactcggagactgccttcctctccccacaggctgtctcagcagtctccatggcccgtgggaaaagagcaggtattgggttggcttcagaggatattccacatgtaaacaatcgtaggcacaatcgtgttttagatggaacctttaaaatgcaaattatacttcaagttctat

SEQ ID NO: 152127 - DNA, 286 bp, Homo sapiens
aggatgcttgtgataaacatcagaaaaaaacaactcttttcatcctggacgggattagagaatactagagaaaggataaaaggctggtttctgcaggcagaatatgcttaggaaaaatggcattgtgattttcccagaggataagagaaattctgtggatttgtaagtactgtacttgcctgatttttttttttgagatggagttttgctcttgtttcccaggctggagtgcaatggcgcaatctcggctcactgaaacctctgcctcccaggttcaagcgattct

SEQ ID NO: 152128 - DNA, 347 bp, Homo sapiens
gccattattataagacatatagtactcatcctagagaagttcacagcctaatgaaacaatagcaaaatatctgtaccatattggacaaaggattgatacccttaatatatataaggttactaaaaaatatttaaaataaaaatgaacagataatagaaaaaaatgaataaagacataattccctaaaaagtatatacacgatcaaataaaaatatccaaactcttaagtttagagattatttcactaattgcagagcttcagagttacaggatggtgaaaaaaaaattaagtatatgggtgtaggtctgaattctccaaagtagcttttccatcattaactgagata

SEQ ID NO: 152129 - DNA, 793 bp, Homo sapiens
ttctaacggctgtgaggccaaagtagatgattttgtgttaattaaaatggaggcccttttcacaagacggtgccgaaagcaaagaaggaagctcctgctcctcctaaagccgaagccaaagcaaaggctttgaaggccaagaaggcagtgttgaaaggtgtccacagccacaaaaaaaagaagatccgcacgtcacctaccttccagcggcccaagacactgcgattctggaggcagcccaagtaccctcagaagaccaaccccggagaacaagcttgaccactatgctatcatcaagtttccactgaccactgagtctgccatgaagaagatagaagacaacaacacacttgtgttcactgtggatgttaaagccaacaagcaccagatcaaataggctgtgaagaagctctatgacactgatgtgaccaaggtcaacaccctgattcagcgtgatggagagaagaaggcatatgttggactggctcctgattacgatgctttggatgttgccaacaaaattgggatcatttaaactgagtccagctgggtaattctaaatatatgtatatcttttcaccataacaacaacaaaaaaaaggctgggcatggtggctcactcacacctgtaatctcagcagtttgggaggccaaggagggtggatcacgaggtcaggggttcaagatcagcctgggcaagatggcaaaaccccatctgtactaaaaatacaaaaagtagccgggtgtggtggcaggtgcctgtaatcccagctactcaggaggctggggcagg

SEQ ID NO: 152130 - DNA, 255 bp, Homo sapiens
tttatattttgatcttaaatttgctcaactctctaatctgttctgagatccctatttaggaaattacatcacatcacatgccagtaacagcagttttatttctgcctttttcaccctctgccctgctgaaaacagtgttgtgaggctgaggatgatgtgggttacacaaaacttggctgcactgcaggggggaatggaaatctacataaccaccttggaaaaatcgatatgtatcaatatgcagacgtctgcgtt

SEQ ID NO: 152131 - DNA, 324 bp, Homo sapiens
ggtttattttttatggaagcaatttagtgccccctcacagcccaccacttccctctgagttaatgactcccaaacacttgccaataacacccattaggtcatgcagtgtttacctggaagctttgtgttagccagattctgtccagccttaaaccgactcttcatcacaacaaagcttacagctttcaattagttaatttatttggtatcccaaaaattctaattttgcttttccagtagcagtgatccattgtgacctagtaggtacaactcagtcatttttctgggtttaaaagagcgaatatatttctgtgtacagcagac

SEQ ID NO: 152132 - DNA, 447 bp, Homo sapiens
taggtggttgcaacatgccactaattggtctctttgcctcctttagaccccctcccttccttattcgtgctgaagcctaagtgaccttttcaaaatgcaattctgatcatatcactacctccaatgctcagccccctgctgtttaaactattcagtgtttaaacctttcgctcttagatgaagaagcaaattccctctgtcagctgacaaggctctgcatggcctggtctctgtctagtttccagcctccttactcactccacacacttcagcccttctagactttcatttccttgcagaagccatgctacctcctgccacagggcctttgcacaaactgctcccgctctctctccagaacactttttcctccactgttgctctacacaagcttctctttctcacaaaaaatgtcttcttctaaggaagcctcctctaaccttcctg

SEQ ID NO: 152133 - DNA, 490 bp, Homo sapiens
ttcctgcctcagcctccagagtagctgggattacaggcatgcgccaccatgtctggctaattttgtatttttagtagagatgggggtttctccacgttagtcaggctggtctcgaactccggacctcaggtgatccgcccgcctcagcctcccaacatgctgggattacaggcgtgagccatcgagcccagcctatctgaattattctgttgctgacaggaagcggaactcaggtaatgatatatactagaactgaatatttgtgactgagataggcattgccaacagactcaaagaaggggagaatatcctcctctttttaaacatggatggatggatgtaggggctccattgatcgagtgccacattgtagttgttttgtacacagagtagatttttacaggtggacacagaaagcagagatagcctagcttccttggacctcttgaagccccttctaagtaggaccataggacccgtaatctgcact

SEQ ID NO: 152134 - DNA, 246 bp, Homo sapiens
ggtaggatgagatatgagcgtatcgcagcgattggaagagtgaatctaaactcaccacaattagtaagaccctacaaaatctctcccctacctttctattcaaattcatttggaaccactctttcccaagctcaccatacactagcacaaataccttctctctttctcaaatacaacaagcccatcctcattctaagggccttgacacttagtcttctctctacccgaaacactctgcttccagat

SEQ ID NO: 152135 - DNA, 817 bp, Homo sapiens
tgattacagggatttaggagggatggcagaaaaaaaatagatgataattatgaaccaaagatcttcgggtgaaccaagggataatgtgaagaaaacaagatgaatcttcaagtccaatggatagaattaggaccaaaaatggacagcaaagcttgagtcagaagccatgtagaccttccaaagacacaagaaaaggccaggagggaaatgagggtgtcctgagcctgtgatgcgaatggagcttgagtggcctggggcttgctcttattaaccatgatctgtatgctgtgtaggtagagagagatggcttacaaccctcagattagggaggacggcactaaagctctgatggaaggactgtgatcattctgattattcggaccatgctgatggcctgggtatggaagaagttccaacagagggtgacccagaaccaagatgagaaaagaagcagctctgaatgtaaccaggctggatttttaccatttcactcatgagggggcattcaaatttaaatcagaagtagagggcatattttctgtagtttattttacctacatgcttgagttcacagccaaggagacagtgtacagtcaatttccatgtgcacttcttctcagaaattgtttggatgtcttcctaaagacctcagggagaagaataggcatcaactggatccaaccaaccattacagttaagattatgggggtcagcacagagagacttgattcttctcaccttttatggaagggttcttcaaccacatatggaactttttggggtgccatgtagatagagaggtagaggtattttttcc

SEQ ID NO: 152136 - DNA, 335 bp, Homo sapiens
ctggctcagcttgactgcctctaatctaactgtagctagtgtgggggtggagcacacaaaatctttggtacaaatatagctgttacgaatccacttctgtgtctctgaggacggaagaaggcaagtcctgagaagggggcatatcatcatgagctggttagatcctttagaaggtttttcctagagatgtgactaactcctctagagataccaaccacagtccatggggtctgtaacaaaatgtaacacctctttctatactgtttatcccttcattttatgtgtacagtaagggatactgtttatcccttcatttctgtagggcagcacagctg

SEQ ID NO: 152137 - DNA, 245 bp, Homo sapiens
ttcccaaagggactttggacagctcactaatgactcgttcttcagtcatgttacacagacatacatgccaacgtcaaacaaactggaaatgaatctggggggtgtcagcagcctccctcacaccaacggactgagtgtcttctgagacgggcgggggagtgttatctcaggaatgtgttggggcaaggtccgtgcttccgataaaatgctgtgcacaggtgagccagggcctggcgagggcagtg

SEQ ID NO: 152138 - DNA, 596 bp, Homo sapiens
  misc_feature (24)..(24): n is a, c, g, or t
  misc_feature (27)..(27): n is a, c, g, or t
  misc_feature (30)..(30): n is a, c, g, or t
  misc_feature (44)..(45): n is a, c, g, or t
  misc_feature (58)..(58): n is a, c, g, or t
  misc_feature (61)..(61): n is a, c, g, or t
  misc_feature (75)..(75): n is a, c, g, or t
  misc_feature (83)..(83): n is a, c, g, or t
  misc_feature (85)..(85): n is a, c, g, or t
  misc_feature (92)..(92): n is a, c, g, or t
  misc_feature (101)..(103): n is a, c, g, or t
  misc_feature (594)..(594): n is a, c, g, or t
cgaggccgtgaacacgaagaaccnttnctnggtgtgtgtggcgnncatagcagatatngtngaagatcgcttacnagtgcatntngacaacngggatgatnnntacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaatagggcatatccgtggtccacgtccatnat

SEQ ID NO: 152139 - DNA, 226 bp, Homo sapiens
tgctgggtttgtgggtgtgagccaccgcgcccggcctgtgattttatttttaaagcaataaacatctttggcatgcatgagaacttctttagagtaaatacctggaagtagaattaggacaataaaccgcactcactaaggtttcttgatccccagttcagagcctgccacaactccagtgaggaagatgtttgtgtgccattccgtctctcatggcgtttatagc

SEQ ID NO: 152140 - DNA, 287 bp, Homo sapiens
tccaagcaaccagccgttttcatcgtcctctttgtgtacagtgggaaactgaatggtcggtcgggagatttagtaatttgccctaggcagagcacggcagagggcagatggaagccctcagttgtctgctgctgcggcccagagctgagcagccacagggcaactgccctctgtctgccgctagcctagcaagtaattcaccccgacctcacacgttctgttgtaaaaagtgatgggaaaaacgatcgcatttcaaggtatttagcaattccacttctgagtacata

SEQ ID NO: 152141 - DNA, 541 bp, Homo sapiens
ctcaacgctttatacttcaggcttgaacttcagatttccctactgctgagatgcagttctctgtagcattgacattttctttggtcttagaatccgcagactgaataactcttaccagcaggggaagtgcttctgtacaaaaagggcgataattatctccaccgtactgtgccatgactcccaggccatatgcagctgctagaccctgacttcgatgctactgaccttgtgagctggccccatcttctctctgggccactgtttcctgggcagtttgcattctcagctggaaatgctcaatgaccttgaacacagagtccctttacccctctatgcctcagttgtttcaactctcaagaaagggtaacagactaagactccatcacaaaaaaaaaaaaaaaaaaatttttccgggctggggggtgcacacggttaaccctagctactggggaggcggaggcaggagaatcgctggccctcgggaagcggaggtggcagggagctgagatcgccccattgcgttccagcctgggtgacagag

SEQ ID NO: 152142 - DNA, 365 bp, Homo sapiens
aagctccctctcccaatcccagaggtggcctctgtccagcctatccatagcagctggaacaaggcatcccagccccctggctccagcgggggaaggactgcttccatttgctaagggtcttcttcatttccttcaccttctcacaactgcactttctaaaacaggatattaagggaagagaaaccgagggctttggggttttttagcctctgctccagggaaaaacagacactcatccctgtctgaaattgcttcactccgagagcttgtgggccgcgggagcctcccgccacagatgagcagaaaacagagtttgtttctctatttcccagccccctcgcctctcgccctctccttctctctcc

SEQ ID NO: 152143 - DNA, 591 bp, Homo sapiens
cccactggcatcaaccttctcaccctgaacttgtgttggctctttccctgatggtacctgccttccctttcccagtggactcagctggccagttctagcccagcctgctccaatgtagaatggccaccttctgaactttcttcccactcagaactctctggctttctcagcctgggagctgcctagacacctggtccgtcctcccccagccatccttgttatgagaagatgaatgctgtggaccaaagggcttgggatgaaactaacagtaataacaacagtaagcacctctttttgttcagtcagctgtaatgctgctcagaggatcactcgacgtttcctcccaggagtccctcccgtgttgttgtggctcctttgcagatgaggtaaccgagccagtgggaggggctgcctagaggtcccatctcagacctcagaggaatccgagggtgagggctcagaatccaggcctgagctccagtagggtccctccagctatttttttcttcatgtttttggctgatgttatggaaaacagcctaatgaggtaaacatcccagacattagaagctcaggtcccctgcagcatca

SEQ ID NO: 152144 - DNA, 195 bp, Homo sapiens
taaaactgcaaaagtaaaaagcacttcatagaagaatagtcttttagcattttacccaaaatcagacatgactattcagagctatacattattttatacaacaaacagatttggtttttctcaatcttgttttctttatgaaatcctgagttaaagcccaggcacggtggctcacgcctgtaatcccagcacttt

SEQ ID NO: 152145 - DNA, 185 bp, Homo sapiens
ggctcggcacccggtaaatgtagattactgtgaaggtttttatttgagggaagtttggagtgggtgagaatattctactccatatgctcatctttacctttagtctttggtaaatttaagtagcacttccaaagcaaggctggcaacaggcatttggaatcttggaatgcctgacaatacagtac

SEQ ID NO: 152146 - DNA, 409 bp, Homo sapiens
caaaggtgtatggtcaaaatagggatctttcagattaagctaaaaatacttaatggaaaaacaaagaaatattcttttgccagatttcctctgatatctatgctttccaatgtcatctgcacttattttccatcagacgaaaagtcctgctgtttctctctccctcccatggactcctttctcttcagagttgtaggacaagacttctgccatgactggtctttttatttttgttcatgttctgtacatgtgtcatacaaccaggtatgaagtcagttttcctctagagaacattattacaaggaaaaggctggataaaaagatttgccctacttactgtctctacgaagtggatttcatcataactcaataactgctatttctatataggggctattgactaatgtct

SEQ ID NO: 152147 - DNA, 295 bp, Homo sapiens
aataattgagattcagtttgctgtacttcaggaataatcaaatttagactgggagattaagaacttcaaaagatatatagagaacaataacaatttagtaaactgacaaaagaaacacaaataaagacttccaggcagaacagcctgaagtacgtggataggataaaactctccaagtttacatttaatgcaatcaactgggagagcattactttgtagtttatgaataacattcctaatgatgaccataagtcactcaaagttaaattgtttagtcacaaaaatctacggtgag

SEQ ID NO: 152148 - DNA, 104 bp, Homo sapiens
taagccacctccacctctgtcctggccgcctcagggcgccctgaaaggaccaggacatgcgggtgcggtggatgctcttttggctcctctttgggctcctactg

SEQ ID NO: 152149 - DNA, 226 bp, Homo sapiens
ctcactcactcctgtcaagggcccacccacaccacaccttgcttttctgagtttgctcttgttcccattggtcataccctgcctgtgaaaattcttccttatcctcctgggcccagctgagacaccattcatgttaaggatcctctcctagtactcagtcagcatccattgctggattcccatcaccacagtagctgtgaactgttgttaccaatgggtatggtgc

SEQ ID NO: 152150 - DNA, 890 bp, Homo sapiens
taattttaccaaggagtgctcagaagggcaactgtgtgatattagtcatttctcttttgggtgtcacttttccttgagggttttccccactttgacttcagaggtcagcatcaccatcgatctggcccttaaggatgcttctttctcctttagattccattatccttagaagtaggtctgacctgcatctgaatcacctggagagcaggttaaccaggcaccttcccagctctgttttagagattcaggttcagtgaatgtggggtgggtgggaagcgtgtatttaaccggcagcccaggtgaccctaatgtgttcaagtttcagaatttccgtagttaatgttaaccccaaatgaacaaaaagaaataattatacaaatttaaacagcatgaaaatacaaatagcacaaagtataattttgtgatgataaaataactcaattctagccctccaagcagaaaagatttcagtcttcctgctgggcttccatccttgaccggccccagcccactactcctcttcctccacccccaggctgctccagtggcccctcttgtcttaccccccagcacagatgacccaaaacttattaaaactcaaaaccggccgggcgtggtggctcacgcctgttaatcccagcactttgggaggctgaggcaggtggatgacgagttgaggagatcgagaccatccttgagcaacatggtgaaaccctgtctctactaaaacacacaaaaaaattagccgagcgtggtggtgtgcgcctatagtcccagctactcaggaggctgaggcaggggaattgcttgaaccagggaggcagaggttgcagtgaggtgagatcgcaccactgcactccagcctgggcaaacaagagacttgtctcaaa

SEQ ID NO: 152151 - DNA, 151 bp, Homo sapiens
aggagatttgttcatccagtgattatctgttcatcccatgaatatctgttgaatgcctgctatgggccaagcattttgctttgttctggcagagcagtggataagacaaagttcccactctcttggggcagacagacagatacccaatcac

SEQ ID NO: 152152 - DNA, 510 bp, Homo sapiens
atgtaaaatggagatgaaattgttactgctgcatcatacggttttttggaaaggattaaatgaaacaaaggaagaagctgtgctctgcacagtacctggcacatagtagggcctcattaagtgctccttcacctccgctccactccccatccagttttagctgtgagttcaaacactagttttgttctcatccattacggaaagatttattgaccgtaaacagagtactttgtgcttggtgctgggtacacatggactaagactgaatactgatttttccagtgctttggatctctggcaatctaagacatttacattaaatacaatagaaagtaataaactacataagaaaggtgtatagattgaggttagagggagaggaatagctagtgtgagggacaaaacgcagttttgaatagtattgagtacttacatgtcagttgctgcactgagcacctgccgtgtgagctcatttgaagaatgtgggtatgtggaatgaagagaaagggc

SEQ ID NO: 152153 - DNA, 185 bp, Homo sapiens
atcaagtttacttaatgtaaaacattggtgttcccagttatttgtaaatctacaaaagatttacagtagaagaggcaaagcctgtgaagtgtcaacataaaggctgctgctgctgtcaacatctgttcccccaactgcatacagaactctaatggggcagcccatgcctcctgaaatctgttacc

SEQ ID NO: 152154 - DNA, 114 bp, Homo sapiens
gaaggaaggcaagctgaccccaaagtgcagactcctttgatctctaacatcagacaccgcatcctcttttcatttctttttctccgtctccattgcgcagccgtggtctagggg

SEQ ID NO: 152155 - DNA, 288 bp, Homo sapiens
tctaatactccaccttgatggtctacactgaccacactgacccttcatcttgatgcctgcactgactctccatcttaatggtctacactgatcacccacgctgaccttggccactgaccactcacgttgtccatcctccagtcaacccctcattagctctcatcatcccaccttggtggcctactctgaccatcccttgacctcatccctggtaattcccatttgaaatctgcataatttcccatttgaccatcccctaaccacccacacagacctcgagttcacatt

SEQ ID NO: 152156 - DNA, 308 bp, Homo sapiens
tcattatttttaattccgtcagaagcctgagatgtgattgattagaattgtaggaggtaagtataggacaagaaggcagcggagaggggagttctaggcagacatgagctagggtgtatccagggaacggaggggccccatacctgaagtggaacagtgggaacaggagagaagacccaagaaacaggtgcaaccggctatccagcacacccatgctgatgccccaccttatgccagctcggtgtagtctatgtggacggcagagaagtgaatcagacggagttttgactcttggggagctcttaacg

SEQ ID NO: 152157 - DNA, 296 bp, Homo sapiens
caatcacgctcagtgaatttttttgtattttttgtagagacagggtttcaccatgttggtcaggctggtcttgaactcctgacctcgtgatccacccgcctcggcctcccaaagtgctaggattacaggcattgtgagccaccgtgcccggccgctactgatctttttactgtctccatactttttctattttcccgaaagtcaaacaattaggattaaagagtaatagccttttcagactggcttcttttacttagtaaatgcttttatgtttcctccattttttttaatggctt

SEQ ID NO: 152158 - DNA, 314 bp, Homo sapiens
caggacttgaggatacaagatctggaagagaaagggagctcactgagatgaatacaaaatgccacataccatatatttttggtgttgaaagagaggcaaagaggctaagagaactgctggcaaactcacagctggataaacaaaaacgagtttgatgatgccaggggagcaagagtgcagagaaaagggaagaacagaaaacagcctattggcataggccaatgctaagctatagagggcaaagggcagaaagccaagcagaaaatggctaaaaaatagagttatctgaagactcctaatgctgacaagataaa

SEQ ID NO: 152159 - DNA, 316 bp, Homo sapiens
atgatgaatttctcagaatgtattcctgtcattaagtgatgcatgactgtatttataactctcattgctttggttaggccttctaatgttaagtagtgcgatactagtgggcttgtgtgaaaagaaggcttcttatgtgttgtaaatgagtatactgtgtggtgtaggttctggcacagatcatttatcaagctgaggccatttcttactattgctaatttacaaagatttttcagttaggtatagttgaattttactgactgcttttttatatctacggaataatattttcccctttactgctaatgtaatgaca

SEQ ID NO: 152160 - DNA, 133 bp, Homo sapiens
actcccactggaatagaagctttctgagaggttctgatcgcccttaagaagctctgtgtggctggaggatcgaaaactttgggcacaagctggaaggtcatttactgcaaaccactatctcccagctaatctg

SEQ ID NO: 152161 - DNA, 236 bp, Homo sapiens
agattttcttatagtgtaatcaaaatacaaattccagagcatgggactgtatttcttagagtagcgttgctacattaactactgtaattacttttcggtaaaaaattacttttgggtacttttgacctgcatgtttctataatgttctatgcagaaattaaactcttttgtataaacaaaaacagtgtgggcctttttagcatttttctttgagattggagacttcaatatagtga

SEQ ID NO: 152162 - DNA, 149 bp, Homo sapiens
ttattcattccgccacattttctgagcgcaaagtcagtgcctggcccccttggtttagaccaagtcatgttggcccctgctttctggtgctcacagacttgcctgggcggggtgatagaggcgcttgcagttcagcacgcggcccgttc

SEQ ID NO: 152163 - DNA, 280 bp, Homo sapiens
tgcttccttgagtaggtgagcttggtggctggtccaactggtccaggcccacccttgcacaggtggctggtggctctttgagccagcttgggcttccctggcatgcgcacgcctcaggaaataacacgctgctcccagtgagtttgtcctgccttggcacaaattctaagtctggccagggccacagaaggccgagtgccctgggtggcaatcctggctgctttctacacctgaacgtaaagtcctcctcaagaggacctgtgatctgcctcgtggcaac

SEQ ID NO: 152164 - DNA, 321 bp, Homo sapiens
ctctcggttgttagctatctccaggcctggtgataatcaggaaagacaagacccagactcaccaagatgcagctgttttctcaggaagagtattttgtccatttcagcaaagggcagatggttattacaaaccaaagtctcccaaagggctaagcagagtctctgaaagtctaagttaggtttaaggctaggtgggatcacagtgaaaacagaagaggacaaaaacaaacaaaaaaatggagtgagaagaaaaaatatcaaaaaaccaaataactttcctttggagagaaggagagagagacctactcaccatgttctctc

SEQ ID NO: 152165 - DNA, 366 bp, Homo sapiens
tcttaaaattgcattgctaagtgaaagaggccaatctgaaaaggctgcatattgtatgattctaactatacgacattctggtaaaggcgaaactatggagacagtaaaaagatcagtggaggagtttgtggggagggaagagaggaacagataggtacattacagagaatgtttagggcagtgtgactattccgtatgatacagtaatagtgggcatgtgtcactatacagttgtcaaaatccaatgtacaacacaatgagtgagccctaaagtaaactatgtatgggttttagctaatgacaatatattggttcaaatattaattgtaacaaatgtatcacactattacaagatgtaaacaacag

SEQ ID NO: 152166 - DNA, 990 bp, Homo sapiens
atatgcctgatactaacatatattaatatattttagcatggtttcaaaaattttaattaggaatttttgccttttattatatcagaaagtatattttgcagtcaggcctcaaataaatcattatgaatcttgtagttgttcctgaacttggagtgttaaattttgaatttgccattttttaaggttccagttttttgctgggcgtggtggcttacgcctgtaatcccaagactttgggagactgaggcatgcagattatctgaggtcaggaattcgagaccagcctggctaacatggtaaaatcccatccctacaaaaaatacaaaaaattagccggacatggtggtgggcacctgtaatcccagctactcgggaggctgaggcatgagaatcgctggaactcaggaggtgggggttgcagtgagatgagatagcaccattgcactccagcctgggagacagagcaagactgcgtctcaaaaaaaaaaaaaaaatctactttttgtgatacgtattttcatatataaaagttttaatttcataaatacttggtttttatagtagccttcttttgggttgagtgatttgggctcttaatttttattgccacaaatagcccacagctggtagttgcagactgtaggaattgtacactggtatgatcttacacaggtaattgggctactggaagtagaggacttgcgaaatacaaaggaagaaatgagagatgtacctgccaggagactcagtaaccaaaacaaaaacttccacttcatctaacaaattattcctttttgggataaagttaaagctgaaacgtaggtttgttggttgttctttattttcctcaaacataacttaattcagacttctcttaactttggaaaaacccaacatagataagttggatagattcttttttctattttgcatcattagattttttttgcttgaaacagctgtctttagcattaattcttagcatcttag

SEQ ID NO: 152167 - DNA, 312 bp, Homo sapiens
tccagaggtcgaggctacagtcagctatgttcatgccactgcacttcagcttgggcaacagagcaagacccagtctagaaataataataatttaaaaattgcctcttgatgaagaaagtactatgctaatcgccttttagtttcatactccttgactatttgtaaatgacattgaatctccgtaacgattatttggttaaacattttatctcttgttttatctttaccagttactccctctcttacttaaattgttctccctccaaggggtaatggtggttattaaaagaagcaatgaaaccttgatgattt

SEQ ID NO: 152168 - DNA, 154 bp, Homo sapiens
atggggcctcagcacttgcccccaactccgcctgtcttcccacatgtcgttccctgggccaggctcacactgcctcttgcatcagcttggatgtttttttggatgttccttcctcggggaagctggcctcctgctccttggccaaatcagatca

SEQ ID NO: 152169 - DNA, 351 bp, Homo sapiens
gtcacgttagaattgtgtgtcaagtaagttttggagagatgagagttgtttataagagtttcagccggggttggaaacggtggctcatgcctgtaatcctagcactttgggaggctgaggcggatggatcccttgcggtcaggagttcaagaccagcctggccaatatgatgaaaccccatctctactaaaaatacaaaaattagccggttgtggtggcacacgcctgtaatcccagctactcccgaggctgaggtgggagaatctcttgaacccaggaggcggaggttacagcaagccaagatcgcaccactgcactccagcctgggcaacagagggagactctgtgtca

SEQ ID NO: 152170 - DNA, 385 bp, Homo sapiens
ctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgc

SEQ ID NO: 152171 - DNA, 241 bp, Homo sapiens
agccactgtgcccggcccacaagttcttactatgagtccagcactgttctaagctctcaagactgccaagtcaatactggatggttcctgcctcaaaaagcttatcttatacagaaggtggtgacagtaaatagattaacagaaatgcaatctggcagcgtcataatggacacataaaactagggggttaaaattcaatgaacttgtcataattcattcccttcctaactttgtacaatag

SEQ ID NO: 152172 - DNA, 859 bp, Homo sapiens
ctcagtctacagatgcctccagtagtccgaaccaagtccgaagtcaacgacaagcaatgatggcgatggcgatcctagttaataaaaaggggggagatgtgggcagcaagccacccaggcgccgaggcaagagaccgaggacacgagctgttccagtataataaaatataaaacaagaatagttatactagatgtagatcttagatatgattgtatatgaatatcattaatcattagtttgtagcaattactctttattccaatattataataatcctcgctctacaatcataacctaggaaaaaccaggccatacagagataggagctgaggggacatagtgaggtgtgaccagaagacaagagtgcgagccttctgttatgcccagacagagccagcagaagggctccttggtctagcggtaacgccagcttctgggaagatacccgttgccaggcagaccgaagtctagcggtagcgtaagtgtcaggggaaaacacctgctacttagcagaccgggaaagggagtctccctttccccgggggagtttagagaagactctgctcctccacctcttgtggagggcctgacatcagtcaggcttgcccgcagttatccggaggcctaaccatctccctgtgatgctgtgcttcagtggtcacgctcctagtccgccttcatgttccatcctgtacacctggctctgccttctagatagcagtagtaaattagcgaaagtactaaaagtctctgatatgcagaaataatggcgtaagctgtctttctctttgtctcctctctctgcctcagctgccaggcagggaagggccccctgtccagtggacacgtgacccacgt

SEQ ID NO: 152173 - DNA, 360 bp, Homo sapiens
cagatagggttttgcagtgttggccaggctagtcttgaactcttgacctcagatgatctgcctgcctcggcctcccaaagtgctgggattaccggtatgagccaccgcactcggccccccaaattctttccctttacccgaagttggtatgcattgacttacctgtggacaacagtgatttttgtctcctgtccttacttctctctgtctccaactctcagggactcattcatcacctctccctgcaccccaccccctgacccgtgctagtttggtatctatgcctgtagctttgctttggggcatcatctgaatctcatactgcacggcctttcagatctggcttcctgcactcaatgt

SEQ ID NO: 152174 - DNA, 234 bp, Homo sapiens
cccgctctgttagaccatagtataaaagaaaatctagccccttcttcgggcccgagagaatttcgagcgttagccgtctctcagtcaccggctaataaaggactcctgaattagtctcaaagtgtggcatttctctataactcacttggttacaacaagccttttattaaaatattatttttttcattttatattttatatttagagacagggtctcactttgtttcgcacgct

SEQ ID NO: 152175 - DNA, 566 bp, Homo sapiens
aatcttgatatcctcagattaaatgctatataaaaataaaggataatccacttcaagtacaaagattcctaaagtgcagagcaaagaagcatgtgttctgaaatcttcaatggaacaaaaggagagtggtgcagttcacagcaatgctgctctcggaatgtttgtggtggcatttccctaagtgttgcaggacattttgtaagtacgtttactcctgcatgaagagactaggctgtgctcacacttaaagaaaggtaaaggggaacattatagaatggaagaattacaagggatctgaagtgtcatctatctaacctctatatttgatggatgaagaagcagaattagagaggttaagtgagtcacccatggtttacacagtgagtcagagctgaaaccaagcctgcaacccaagatcccagcttctagtcatctggtgtatttgtttttgctgcaccctcctgacctgtcccaaaggccaaaactaagtcagaaacagagctagaagtcagttacaagttgagtcaacaatgcggtgatgccattacccctgggcctgtaactga

SEQ ID NO: 152176 - DNA, 599 bp, Homo sapiens
gcagggagggagggaggaagggaggaagaaaggaagggagggaaggcagaagggaaggagggagggaaagaataaagagagagagaaaaagagtgggagagaagtagggaggggagagaagtagggaaggaaggaaggaaggaaatgaacaaacttacatgaagatgagaacatccaggggaacttacaccaccagtattttccattaacaggaacacgctaactagttattggagacagacgcactactgtaaaactatatactgtttccatggggtacaaccccttcttccttctctgaaacacattattcctctggcccactgttgccagagacactgagtcttgtctttggataagttctggtgcccaaaagaatgagatgagacagtggatcccagaacaccaggccgcaaccttccctgctgctccttgtccactccagaagctgcccagctgcaggtgggggcctcagcccctgggtctgacatcgtccatttgtcattctcactggacttccctccttgcactggctcccactcccccaggacctggtggacggccacgtgagaaggatacaaacaggccatgcccctttc

SEQ ID NO: 152177 - DNA, 471 bp, Homo sapiens
ccaatatgcccatgctcctgtggaggctgagttggaaagtgacacgaagctgcccccccgcaagagagcaggtgctcggtttctcttctgcttacaggagatgcatgtcctgatttcttgttctcctaggtgtttttattgagatgtagggaatatctgaattcataacgacttagaaaatctgtacacacagttgagagaacaggtctcgaggctaaggtgctgtttactcccgtgggctggcctgttattaaaatacttgtgcagcgactgatgtttacaaattactatgttggaggttaaaatgatcaaagtgataacctccatcctgtctatcatgtttgaggagaattggttatttggttcactaatgttctgtttaaagaaaatttctgtaaaactagtaaatgttacccctcatcttttgtaagttaaaaaaaagtttaaaataatgtttgctcatcaaaagtg

SEQ ID NO: 152178 - DNA, 373 bp, Homo sapiens
gctcccctatgcccctctcctggcactgcccgtgttgaggaggcagcactggggtccggcagcagcggcacggctgcgcccaagcgcactgccaagccccgctgtctggttcctacaacgcggggctggccgctgctgaactcgatattatttttccacatggcctctgcctgaagatgaggagcatctctccggaaggtcccgcgagagagttagacattgctccattccactccttcccccatcaccaccgtctcccctgccagaacaggtcctgtgtgcggctgtaggaacagaggggtagacttcttcctcatcactaacccggtcccttctccgcctctgcagatttcgtgatccaaagcccgattca

SEQ ID NO: 152179 - DNA, 560 bp, Homo sapiens
aacgatggtcctcagctactcgagaagctgaggcaggagaatcaactgaacccgggaggcggaggttgtagtgagccgtgatcacgccactgcactccagcctgggcgacagagtgagactctgtctcaaaaaaaaaaaaacaaaaaacaacagtggtcctactctggcccaaaggggcacaggaggcttgagcctcacatgtccccaccacccgctccttggtggcccctggggccctccagggctctgtggtaatccacacactcacattaccctcagctgagtctcacagccctgcaaacctagtgttctgttctcccacttaaagatgaacaggcaggacgcaggggctcagctgaggaccatcgtggcaacgagggtcctcagctctatgagcagagggaaggagaagcacggtttaaaagctgtcagggggttactaggaggaagaagtgagggatgaatcatagcgatagaagtattatgaggccaggctcatgcctatgactccagcactttgggaggtggaggctggaggatcgtttgagcccaggagttc

SEQ ID NO: 152180 - DNA, 209 bp, Homo sapiens
cttctgatttttgtcttcttttccctgactttcttgggggttggatttctgttttgctctaaaaccctaacactaccagcatatttaattgtaaggttttctagtatgtctccccatttgtgtatttagagaaatggtcccagaaaacattggttcaacattttaggcagtaaatacttatttttactttatgctgataattactatga

SEQ ID NO: 152181 - DNA, 896 bp, Homo sapiens
  misc_feature (1)..(1): n is a, c, g, or t
  misc_feature (728)..(728): n is a, c, g, or t
  misc_feature (760)..(760): n is a, c, g, or t
nctaagcgtgactgactctcttaactaccaccgctacacgaaactttttgggaaagttccccaaaactttggggaactgtgttcccctgaagtttggagggtgaggagtgaaagaggttgagaagaatgagctggctgggttggacattcagaggtgacaatggccagatcaaccttgatggagtcttgttctgtcaccaggctggagtgcagtggtgcgatctcagctcactacaacctccacctcctgggttcaagtgaatcccctgcctcagcctccctagtagctgggactacaggcacacaccaccacacctggctaattttttgtattttttagtagagacggggtttcaccatgttggccaggatggtctcaatctcttgacctcatgatctgcccaccccaccctcccaaagttctgggattacaggcctgagccactgcacctggctgctagttcttaagagggaggtatgagacgtatgtatagactaagtgaaaggaaaatatcttgggcccccaaaatcactaagctaaaaggaaaattcaagctggaaactgctcagagcaaacctgcttcccattctattcaaagtcatccctctgctcactgaggtaaatgcatattctgattggctcctttgtaaaagctaattagaaactcaaaagaatgcaactatttgtctctcacctacttgtgacctggaagacccctccctgcttnaagttctccccacctttttggacaaaaccagngaacttcttactggattgattaatggcttgtgtctccctaaaggggataaacccagttgggccctgaccaccttgggcacaggtatcaggaccttctgaagcttggtcatgggcatgcttcctccaccttggcaaa

SEQ ID NO: 152182 - DNA, 857 bp, Homo sapiens
  misc_feature (1)..(1): n is a, c, g, or t
  misc_feature (689)..(689): n is a, c, g, or t
  misc_feature (721)..(721): n is a, c, g, or t
nctaagcgtgactgactctcttaactaccaccgctacacgaaactttttgggaaagttccccaaaactttggggaactgtgttcccctgaagtttggagggtgaggagtgaaagaggttgagaagaatgagctggctggatggagtcttgttctgtcaccaggctggagtgcagtggtgcgatctcagctcactacaacctccacctcctgggttcaagtgaatcccctgcctcagcctccctagtagctgggactacaggcacacaccaccacacctggctaattttttgtattttttagtagagacggggtttcaccatgttggccaggatggtctcaatctcttgacctcatgatctgcccaccccaccctcccaaagttctgggattacaggcctgagccactgcacctggctgctagttcttaagagggaggtatgagacgtatgtatagactaagtgaaaggaaaatatcttgggcccccaaaatcactaagctaaaaggaaaattcaagctggaaactgctcagagcaaacctgcttcccattctattcaaagtcatccctctgctcactgaggtaaatgcatattctgattggctcctttgtaaaagctaattagaaactcaaaagaatgcaactatttgtctctcacctacttgtgacctggaagacccctccctgcttnaagttctccccacctttttggacaaaaccagngaacttcttactggattgattaatggcttgtgtctccctaaaggggataaacccagttgggccctgaccaccttgggcacaggtatcaggaccttctgaagcttggtcatgggcatgcttcctccaccttggcaaa

SEQ ID NO: 152183 - DNA, 540 bp, Homo sapiens
ctcagctcatgtcctcaaagacacctggtgcagggcgggctgcaggtgcttcattcagggagccagttaacgcagactcccaggtgtcactcggggtttctgacttggttttaggcagggctctggaagtctggattctgacaaacttcttgggctattctgctgtgcagtccatttcagaagctctgctccaaggcagagagagtgctgacccgctctggcctccttcattctctgggaggagccacgaacactgagagggctgcacccattttgcagagagaagccccggtgctaagacattaccttctgggggaaaaaggagtcgggaggcggaggcaaggtggcaatagcaccttcccattagcttcagctggttcaaaagctgctcgcagggtgtcaggtcaaactcaaaaagcccttcttcccccaggatctcagcccccgggagaggccggctcactccaagctgctttattgcatgtcctcatccacagagaaacacaccccagattgtatatttctgatgtcagggcacat

SEQ ID NO: 152184 - DNA, 623 bp, Homo sapiens
aaatgtaaagatacaataaagagaataataaaatggaaactattgattcgtcttttactaattattgaccctagtcaattatttatttttttcctttacatctgttttatcttctctctctctgtctttaaatttgaagctcacagacattgccaagcattgataattagggcaaacaagattgcaggtctatgataacgtacagtctgtcctggcaataatagcaaacattgccattcgttcatttatttatttatttagagatggagtctcactctgttacctaggctggagtgcagtcacgtgatctcggctcactgcatcctccgccttcccagttcaagtgattctcctgcctcagcctcccaagtagctgggattacagacatgcaccaccacgcccagctaattttgtatatttagtagagatgggatttcaccatgttggtcaggctggtctcgaactcctgacctcacatgatccgcctgccttggcctcccaaagtcctggattacagatgtgagccaccgcacccagccacctataatttagtagggaatagttctttagagatcagatattcgagtctcgctgtcgttgtagatcactcttaagtgggccg

SEQ ID NO: 152185 - DNA, 617 bp, Homo sapiens
aaatgtaaagatacaataaagagaataataaaatggaaactattgattcgtcttttactaattattgaccctagtcaattatttatttttttcctttacatctgttttatcttctctctctctgtctttaaatttgaagctcacagacattgccaagcattgataattagggcaaacaagattgcaggtctatgataacgtacagtctgtcctggcaataatagcaaacattgccattcgttcatttatttatttatttagagatggagtctcactctgttacctaggctggagtgcagtcacgtgatctcggctcactgcatcctccgccttcccagttcaagtgattctcctgcctcagcctcccaagtagctgggattacagacatgcaccaccacgcccagctaattttgtatatttagtagagatgggatttcaccatgttggtcaggctggtctcgaactcctgacctcacatgatccgcctgccttggcctcccaaagtcctggattacagatgtgagccaccgcacccagccacctataatttagtagggaatagttctaaattcctcagatatctgctaactgtagttcagatagctgtttaactgcc

SEQ ID NO: 152186 - DNA, 262 bp, Homo sapiens
cacaccattttcattgtcactccctggtttaagaactttcatctcaagtttctatgagataaactctagtatggtgtccaagttgtcctgccacctggctctcacctacctttccagcttcaccccttactgcgccccctacatggattccctctgtatcccttttcttgcttagttttttgtgaactgctttcttcttataccgttatttattcaatatctctcctttctcttactaattcctgtttatccaaagtagttt

SEQ ID NO: 152187 - DNA, 471 bp, Homo sapiens
aggtttcaaatgcagtgagcatttttgcattattttcctttaataatctttatgcaaatgcatgtagtaatcacatctccacattgattgaataattttagagacctggattactgtgacatagtctgtagtgggctataattattagatattcagagagttgcagctttttttttttttttttttcagtgagtcttgaactcctgacctcagttgatccaactgcctcagcctcctaaagtgctgggattataggtgtgagccaccatgtctggcctatagtacgttttgaagtgatgatagacttcattttccatgggtttgttttcttgggccatcctggtgatgagttggtgatgagtttttactgtatcactgttctttgaagtggtaattactgcccagctactgaactattcttttatatatttattagatactattgatagaaattacacaatttagataagc

SEQ ID NO: 152188 - DNA, 262 bp, Homo sapiens
ccatttctccctgctttgcctgcacagagtgctgtaatctttgactcacaaagtagtgctggtgaatcccagctctggttctctggtaggagtggagcattccccagccccacaaatcagcgtgggtcctgtcctctcctcccactttttgcagtgacctgcagagctgccaccgttaacactgccagcttttgcagaagaatatatagtggctcaaaccacttccttgtacatctttttttaaacggaaaaatataagtta

SEQ ID NO: 152189 - DNA, 232 bp, Homo sapiens
ccgagagggaacacacacatccacgcgcactgcgcagatgttcaaagcggcatactgtgtcaccacaaaggggaagcggcccaagtggctatcaacagatgagtgggtcagcacagtgtggcccatccgcggaggaacggggtcagcagagggtgacctgtccacgcactggaacatgacccggccacgaacaggaaccaggctctgacccaagccatagtgtggatgcacc

SEQ ID NO: 152190 - DNA, 362 bp, Homo sapiens
aaagtggcattggatatagagtcagaagactggatcaaattctggtggctccaattattagcaatgtgatctcggacaagacatttagccttttaaaaaagactttacaaaatgatgttaatacataatctcagaagacagagttatcttattaacctcctcttttgacatctttagaaactttctaacagattacttggcttcccatccttttggaatacttcaaccaggttagtttatctaaaacagtttcaccgcattgtatctcaatgaaaaaaacttttaattgtgtctacttgcatagcaatcttccttttcagtcttatttccttttatttattcttttgagaaagggtcttact

SEQ ID NO: 152191 - DNA, 194 bp, Homo sapiens
cttacaggagtgttataagcctccatggcaaggtatgagttgtgcccggtcccggtgggggcccaataagagggatctcctcttaatatgattccatttcctctgggggtacatccttcaatataaggtaactctcagtgggcaaatctgattcactctgcggaagttaactcagcagcctcctgggagaaaat

SEQ ID NO: 152192 - DNA, 406 bp, Homo sapiens
aatacccgctttcacacagtaaaaccattttactttatctccacggcctgccatctgtatcagtgccccaccttctgaccccattatttcctgtgcactgatatttctaccaatcgccgccaatcacctcccctccatgactctagccctatgcagtcaagtgtgccagggtctggagaacctgagtcaaagcaacagttctgggccctgaacttacagaccacatgctcctgaactgggaacataaaaaagcagttatcaccaaccaaactggggagaagagtataatgacagaaatcacaggaaacctgggtcatagatgctcaacatatggaaatcctgggaaataaaaaaggaaggggaaggaaaaagagacaccccagaggccttagagccaaattatatt

SEQ ID NO: 152193 - DNA, 399 bp, Homo sapiens
gagaatgttcagcctggagtggagacacccctgggaagcccaacattgtcctctgtgcggtcatgtggccttactctgctcggaacagggaggccttgctgttggagctgccgggccagatgggctgcgtgggctcctggcacaggcagaacttggctgaccattggctcccagtgccagccaaggctctgcaaacacccgagaccctgatggagactcaggctttgggagcacctcctaatgagctggggaggatactgtgttttcttcccagtggggggtgaccaataatcttaaagttttttccctttctccagacgttcagctgtggtccgcactctggattgctctatctgccctgcggactggatagaggctcagcgtagatgcccagctgac

SEQ ID NO: 152194 - DNA, 546 bp, Homo sapiens
gctttaagttggactgccccacatgggtttggggctgtcccacttgaatagggtctgtagcccctttgtttaggccaatttctaccatttggaatggctgtatttacccaatgcctgtacccctattgtatctaggaagtaactaacttgctttctcattttacaggctcataggcagaaggaacttgccttgtcttggatgagactttgaactgtggacttttgcagtcaacgctgaaatgagttgagcacttcagggactgttggcaaggcctgattgatttcgaaatgtgaagatatgagatttcggaggggctcaggggtggattgatatggtttggctgtgtctccacccaaatctcatcttgaattcccatgtgttgtgggagggacctggtgggaggtaattgaatcatggggcagatctttcccatgctgttctcatgacagtgaataagtctcatgagatacgatggttttataagggggagtttccccacacaagctctctctttgcctgctgccatccatgtaagacgtgacttg

SEQ ID NO: 152195 - DNA, 125 bp, Homo sapiens
cccctgggacccatttattttcttttaaacctctttcattgtgcaaatgacattattattttttatcatactctacatggtccttttcaccattacctttattagtgactggtttctttgtttcc

SEQ ID NO: 152196 - DNA, 396 bp, Homo sapiens
ttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaa

SEQ ID NO: 152197 - DNA, 451 bp, Homo sapiens
  misc_feature (382)..(382): n is a, c, g, or t
ttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatacatatcagataaagaacaaaggaaatcagatactgtngtgatgaaatccatcaaattttcaggtaaggcttaaaaaggtgaagatagggagaaaaaaccttccatg

SEQ ID NO: 152198 - DNA, 321 bp, Homo sapiens
ggctcccaaagtgctggtattacagatatgagccaccatccctggcccatagttcttaattttaaagaagccaaaattaatatatcctttcttttatgattattgatctttatgtcctgtctaataatatttgcttctggcaaggcttctgaagatgttttcctattctttcttctagaaattttatcattttatgttttatatttggtcttaatttttatggtgcaagataggagggtcactttcatttttcctatatcaacatccaatcgacatttattaagaaggacatccttccccagtgacttgtaatggcatctt

SEQ ID NO: 152199 - DNA, 608 bp, Homo sapiens
tgtggtggctcacagctataacccctgcactttgggagtgcaacgcaggaggatcgcttgagctcaggagttcgagaccagtctgggcaacaaggcaaagcctcgtctctgcaaaaaaacacaaaaattagccaagcatggtggtgtgcatctgtagtcccagctacttaggaggctgaggtgggacaataacttgagcccaggaggcagaagctgcagcaagtcaagactccaccaccgtactctagccttggcaacagaacaaacagcaaaggcatatgaagagacccacaacataaaaaatccagtacagacaagagatatgaatatgtaacagaggaagaaataatccctcctagtaacagttcctgaaagggcgagaaggactaagattcaaattatgaaacgtaacatagaaagggctattgcagtggccagactgtaactcaagtacagttatgacttcacatgctagcagtatgcgacactgtcttataaggcaataatttaaatatgtttagaagcacgagtgcgcgcgcacacacacacgcgcgcgcacacacacaaatgcaatttgccaggtggtggctcgtgtctgtagtttcagc

SEQ ID NO: 152200 - DNA, 330 bp, Homo sapiens
gaaggtcagggaaggctgtgtggaggtgaaacttgaacggattgaaggacacatgtagaaatcactgggtgaacgagactggagaaaaggctataggaaaatttactccaaaagagggaattggatgcaccaaaataaagagaagaggagaggagaggagaggggcacaggagagcagaagtaggtgatgtccttccttgaagcatcatgttgtaattcctgggccattaacacagctacccttcagtggcttctcattaactgcaggagaagctccagcgtctctgtgtgtcactgccagcttctcatccccttccatcctcattcctg

SEQ ID NO: 152201 - DNA, 634 bp, Homo sapiens
atttttatttgataattaatttgtattcaaaagaaacttcaacagttaaatctttaattttctcctatctcctctgtgcacctgaacatttcccttatctcatttctcctctgaatcaagaattgcaaaacagtaccttctgtagctctgtcctcatcttcaagctcccagtctctttgaccactccatctctacctctgggctcccagaccttttatgaagctactggagagatctacttactccacagcaaccacagtcctttagaaccaaaccacttttggttgcctcataaaaacgactggggtgaaggatgtttgatggataccactctcccttctgactgcttaaaggaggattattctgtaccacttctatgtcccagacactaaactttagcatcaggacattattaaacattactcctcagaggagtctcccctggccatcccatctgtagcccctattctttatcgcagcacaccaattccttgacagcacttatcacagcatgtgtttatttaatgtctgcttccttccctaatctgtaagcacgatgagggcaaggactttatctgattcatttaacaatggaggctgaatgtctggtacagtgtttcttaaaacacaagta

SEQ ID NO: 152202 - DNA, 156 bp, Homo sapiens
gggaccccacagcacatccttcacccacacgtcacccccggctcctgcctggacacctgccattagcacactggtggcctccaaggcccgcacctactcggcacccaaacacacagcgaacacgcagctactaaacactcagcacccaaacactca

SEQ ID NO: 152203 - DNA, 302 bp, Homo sapiens
ttatgctgtattcatttgcgtatttccttgttgtatgtggttctgttatcaaatttatctttagataatagagaaagcatatttacattcattaataacaattaagagcagtaaccccaccattatagcttttaaataattctaaatttgttgttatttataaaaatgaaaaacccaggaacaaaccatttaattctagctttttattataaaaagagtagagccacatacattatgaaattgacataaaaatagaatgacagagacttgactttaaaagtttattccataaggataatata

SEQ ID NO: 152204 - DNA, 583 bp, Homo sapiens
accgctgagtatcgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctcagcgctagcgctgagcacactcgattatcatttgtagaatcatcttcctacaaacttccaagtttcgtttttcacaaaactttttctataataatcttttgtatagtttatagaagctgtatacggtagatgtaccaaaagtttcaggctggatatattactcattagcaattcatttttttaataaaaggaaaagctatgtgtgtatattctttataacttgtggctttcttgtaaaagtgaacatttggtagtagcgtatgctcagcgctagcgc

SEQ ID NO: 152205 - DNA, 1072 bp, Homo sapiens
tactggcatctttctactaagcaagcattttacacacaagattaaataaaggtttaaagaaaggaaagtataatataagaaacaaagtttcctagaagttatagtagactgggtgtggtggctgacgcctgtaatcccagcactttgggaggctgagataggaggattacttgagcccagttcaagaccagcctgggcaacacagtgagagctcatctctattttttaatttttaaaaaaatgttataacaatatcaagtatacctcataaagctggttatgaagtcagctaacaatagcaaaacctcatgtaactcacacaattgcagaactgctcattttaccaatctgtgtggaaattttcatcattttccaaaggaaagagaaaaagtgccacttttgaataatattatcactggatacagaacatgcaaagacacgaaaataattctaatccagaatggttacattgtaaatagatcatctcaggttaattgatacttgttagtaactgtgaaaccctgaagagaaatgcttaaaacattatttattctgtaaagctgcaaaacaaactagtaagcaaaatagtaaatgaacacttaaataagttaaatataatggaaacactgcataagttatgtgatagcacagatgcaaggaaaaaatgctgagattcagttaatgcgtgagcttattcatgaagaacttatcgaaagttcttgtgtagggctgaattccacattaaatggttctatcagaaggtgagtctaataaagcctgagaaggtcaggcatggtggcttatgcctgtagtcccaatactttgggaggccaaggcgggaggatcgcttgagcccaggagttcgagatcagcctgggaactcagggagaacgcccctcttcccccacttctctaaaaaaagtttaaaaattagccaggcatggcagtgcattcctgtagtctcagctatttgggaggctgtggtgagaggatcccttaagaccaggagttcaaggttgaagtgagccatgatcatgccagtgctcgccagcctggtcaacagagccagacc

SEQ ID NO: 152206 - DNA, 490 bp, Homo sapiens
tacgttatgtatgagacgaatcacgtaggctagaggagacgatctttgtgtaaagatgctgaccgctgtggtgaaaacaggagaactaagaacttgtcggtgcccttttcctagagctctgagagcggctggcccttggcaggggtcatgattcctttccagcaatcagagagcaagctaccaggaagctcaccaagacacgctgttaaagccttgctaaaatgtgctaagatgctgtgctaagctggtcaggtcttacctacctgaattacatctaaagtggggctgggtgaacataggggtggtggggggaatttccgcccagagagctcttggctgtctcaagctaccaatgtgttatgtgctgctctaaacaaccctgtgcttctagaaccttggttagcctggctgtgatcaagatgcacagtcaccccacacagctcgctgaaagaaacaaagggaagaaagaaagagaaaacgctacttgcag

SEQ ID NO: 152207 - DNA, 214 bp, Homo sapiens
cttgcttccaaagaattactgtacggtgaggaaaaactattagcaactttacaatggagaaatctagcaaacactatgttgaccaggttatcaaggttaatgtcaccagtaacaggcatgttggtatcatataactctaatgggatgggatgagaagggcatgctgcctgtctagtattcttcctctacacctataacgctagtataatcaaag

SEQ ID NO: 152208 - DNA, 439 bp, Homo sapiens
ccttaatatgatttcaggaagtaaccaaaaagctaggcttcccaaagtaagccagatcctactttggcagtttaacttgttcccaaaccctcttccggatgacatgtgagttccacctggggctctgcatttcacctttttgctattttcgaaacccgaagacatcagaatggtgcccagggaaggcccccagagacaaaaatgcaagaccggggccaaggggaggcagagatttcttccagaaacagggaaatttatgtggggagcacacagttgggagccgtgagccagttcttgcttacaaatagcaggaagaaactagacggggaagaaaggaagacattcattactgaaggcgagggatttgactgggcctggaaactccaaaactgcagccccaaattgcttcatgaacgaagccattcacttttagccacac

SEQ ID NO: 152209 - DNA, 360 bp, Homo sapiens
cttgttccgtgactaccctgggactttcatctttcacagacaaatgacttgttttgatcctactcaaaaaatgatttataatcagctataggattttgacaagtgttctcaatgcaagattccattaactctggagattatgacattgaaaaaaatacagtactcatgaagaactgaaatgttcatgaatatcaagcagaacaagagaacagaatggattgaactaatagaaaacaagtattatttttaacctttttgcttaaaactttggtgatccttgctttgtttttctgagtcaaggatacttattttgaactatttaaagcctttaataattgagtaaactatatgcctgtgaac

SEQ ID NO: 152210 - DNA, 464 bp, Homo sapiens
cttgttccgtgactaccctgggactttcatctttcacagacaaatgacttgttttgatcctactcaaaaaatgatttataatcagctataggattttgacaagtgttctcaatgcaagattccattaactctggagattatgacattgaaaaaaatacagtactcatgaagaactgaaatgttcatgaatatcaagcagaacaagagaacagaatggattgaactaatagaaaacaagtattatttttaacctttttgcttaaaactttggtgatccttgctttgtttttctgagtcaaggatacttattttgaactatttaaagcctttaataattgagtaaactatatgcctgtgaacaaaatttgaaggacgtttgtttctctctgcctggctttgccagaatttggaaactatttgtgagaatatttaatttatggcaatacagttattttcatcagtgc

SEQ ID NO: 152211 - DNA, 547 bp, Homo sapiens
tccgagcatacacacctgcttcatgaaggctttccaccctctccccttcaattggcttctccctctcagcctataaacatgtttctgtctcatgcatctgtaaaacacaaaaatcaaaatgcttcaaatatttgcctccctctagctgtgtcttcattcatgttgagcttcctgaggagttgtctatacctgctgatttcacatcctcctcacacattcacccctcagagcagacactttccagatctcaatattctcaaccaacatcatttgccagcattatgggaattctccttaaatctcttcctctccttctctaaaaccctctagcccagagcagaatcagacatggcccctgcactaagcctctctccctgtatttggtgtgggagacagtcacagttctcactgctttcgagccacttctcaagcaagctgtctacagtcatacgctcttttctcttacctgtccatctcacaccccccctcaactctgtgttgaggatcagcccctgcccgaagcttaccaataacctccttgttgagt

SEQ ID NO: 152212 - DNA, 261 bp, Homo sapiens
ttacccggccactctagtcaaagagaagactaaacatttcagagtagctttcgtcacaaatagaggtggtgttctttcatgacaaccgaatttctcaaacaagcgtgacagcagaaacccctgagactgtgtcagaatcccaaaggagagcagatagataatgaaaaggaaaagaagccagaaaacgtaaactaaagaaccagaaggcaagagaggaggatgtcaagaaggtcggcagagtgcggtggctcacacctatga

SEQ ID NO: 152213 - DNA, 287 bp, Homo sapiens
ctttctaaatgtcattcattcattatattcatgctatattagcaaaagaaatatctattatctcttaatggttactgggccaaataaataccatattgatgaaataattaaatccttttaataagagcattttgattttgttaaatttatttttagatattaaaattttaaatgggttaaagtttcagagatctgagtaaaaaggtcaatgttaatttgtgcttatgagagtgtgtctcacttcagttatataaataatacaaatgatagatacatgcagaaaagaa

SEQ ID NO: 152214 - DNA, 227 bp, Homo sapiens
gcgggtagccgttgcttctgggtagtcccgtggcttgttggttagccgtgagcttgtgggttgacctgtggcatgcagaaagcgcaagttgcaggtatgtgtgtaactctatttctagagctatagacggacagagtgggaaggggggattctggccgcaaccaggtgcactgactccagaaggatccacgctctgcacagatgagccgggtttatgaagggatccc

SEQ ID NO: 152215 - DNA, 309 bp, Homo sapiens
actatttattgtaaatgaataaatcaatatttggtttacatgtaccagtccccacgagcatctgccatgagagaaaaaacaattttctgtgctgatgaaaatcaagggtctaagcctgtgacatcaacgattaggtcctggatagtggtgtatctggcaaggacttttccagctttgggggactcttgttaaggagctgctggtagcagccccacttcaatgccaattttatcacttgaggcagctgccattattacattatgctaaacagcatgtgagaacaatgaaagttagactaggcaggtaagg

SEQ ID NO: 152216 - DNA, 557 bp, Homo sapiens
ttttatacttcagtcaacggtgagtttggttaacatgtgaactggtcatcaccacatacacacacatgccttaaccaaccatttacggatatactaatattcaaatgatcaagttgaagataagcacctagaatgtggtgatgtgtctgggcaggcagacaaccttcctcagggtatacataccaatctcatcgtatgtcttctattcaaactttaataagcagctcttctggctctatacctagttttctacgacaatatacagatattttcttttttttcttgtttttcgagatgaagtctcgctcttgtctcccaggctgatttttttttttatttaaaatattgggaatgggttttataatgccttgaattggtggctctttaaagtttattggagaattacatactctaaaaaatttgtggaaagctatagaccctagcgggcctccgaaaaattggtatctatacataagacaatatggcatgcagttttcaggagaatcacaaaccctctgaaatccacatacctcagaataagaactagtcttacacat

SEQ ID NO: 152217 - DNA, 288 bp, Homo sapiens
aaatatctcatccatttatttcctgaaccaggcctctgaggctgggtactttctatatcaccgtccaatgaacctgactctcctcagaaatatcctgggaggcaataccttccttctcctcactggatagttaccactctggggtctttatcccctctgtgttccaagccaggctagaattcatactatattgtcccgataatcaacgtaaaacttcccatttcaggtcccttcctcctatcagaaactgaattgttgttgataatgaagctatctctccaattcccc

SEQ ID NO: 152218 - DNA, 410 bp, Homo sapiens
ctaggtcaaagaatatgtgcatttataatttgggggagaggaacagtatttcatccatttttttgaaaggttatacaatgagcatgattcagcatttaaagggtagataattaaacttctttcatacccctttactgctactgtccattttcccattagaaacaatcactgttcacagctgtttattttcacagagataatctaggcaaaataaacttacagataatattaggaagatttctctcattcaagcagatttttgtatgttgttctgcactgcagtctatcagaagcagaaagctcttatcaagatattaattaaaacagagacacttggctttagtgtaactatttgagttacaaatactctttattgtcttacaaatcagggtttttattgttgttggttc

SEQ ID NO: 152219 - DNA, 753 bp, Homo sapiens
aaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaactgtcttttgtggaccccagaaaacaagcatttgaggctcaacatgaatgtaaatgctccagtactgcgcacgacagcccaaaacggag

SEQ ID NO: 152220 - DNA, 138 bp, Homo sapiens
tagtttgactatttcacacaatatgcccccatctctctctcccagaatgagtacatctttgccagtgtaatctttgccacttcccatgatgtcccaggtatatgccaaatcactctctgccaaattaacatccccact

SEQ ID NO: 152221 - DNA, 362 bp, Homo sapiens
cagtaaatatttcaggtttggcaggccatatagtcacaattactaaattctgccatcacagcagcaaaagcagccacagacaatacataaacaaaaaacaaacgggtgtgctgcctgtgttccagtaaaactttatttatggacattgaaatctgagtttcctggccgggcccagtggctcatgcttgtaatcccagcaccttggaaggctaaggcaggtggattaccagaggtcagaagttcaagaccagcctggccaacctggcaaaaccccatctctactaaaactacaaaaattagctaggtgtggtggcgcacatctgtaatcccagctactcgggaggctgaagcagggagaatca

SEQ ID NO: 152222 - DNA, 242 bp, Homo sapiens
acgtgcattctgtatttttctaagagtagggccaggcttttcctgagcagtcgggcagcggcagaggggtgccctgtagggagcttacccaggacctgccaagcacacctccttggccacagtcacagcgcacgttctgaggcaccaggctgaaggcgcagtgcctgtcccagcagtgataagtatttgtggtttgtttttgaatcagactggggaagactttgagccctgctgagactcag

SEQ ID NO: 152223 - DNA, 597 bp, Homo sapiens
cagccatacagatacctgggggtgatagtattctagtcagaggcctgtgcaaagcccctgaggtgaatgtgagccaagtgttcctagatcagcgaggagactaggtgtcactagcagggagggagctagggagagacaagtaagggatgacgttagagaagtcacagagccagatggtggagagcctcagaggccatggggagccactggggactttgtgcagaggagtgacatcatctgttgtagatttcagtaggctctccatggtgctatgtggacaatagagtgaaaggggaaggagctgaagcagagactgtcagtaggaggctattgtagtaagccaagtgagatggtggtccagagtggagcggaggaggggagaagtggtcagatactacatgtaatttgaagacctgcagggtagagccaatggggtttgctgaagattggttggttggtatgagagaagaatctgggagaattccaaaattttagcttgtgggaaaattgtgttgctgagatggagaagtctttctaaggtggagcagggttagaaaatagcaggctcttcgctctggacatatcaattttgagatg

SEQ ID NO: 152224 - DNA, 395 bp, Homo sapiens
ggggcctatcttcaggcaaatataaaattgtcactataaaaagccaattataactataattaagcatggtggatgatgcctgtaatcctagcactttggaaggctgaagtaggaggatcacttgagcctaggagtttgagtcacctgggcaatatagggagaccttgtccccacataaaattttttaaaaaaatggccaagcgtggtggcacatgcctgtggtcccagctgcttgggaggctgccgtgggaggattgctttagccctagaagtcaaggctgtgatgagctgaaatcacatcactgcactccagcctgggccatagtgagaccctgaaaacaaacaaacaaacaaacaaaacaaacaaaaaaagaaattctttgctctctgcaagg

SEQ ID NO: 152225 - DNA, 503 bp, Homo sapiens
gtcctgtcatacgtggtccaatgggtaaagctccttagaactccaatggtaaccaaactgcctacatccatttgcatcttctgcaatccagggatttaaaagtaatggcttctggcaagtcatctcactacactgctggtcatctctgtaaactcgctctgtaaacggcagctgataactagctctgttccttgagggaaccaacaggtccctaaggggctctgcctcactccagtgaggttcaggagcccaaatggagtaagttccagttaagctcttcatgttctgtgctgatatgccaggcaccaggagttgtctttaacattgtacctgcaccagccaggctggccagtgtaatatttttcaattagcaaatcttccaataatagcgttttaacaatgaagatctaaagaaaaaacttgttcttaatttttgtccaaggaggggaaaaaaaaaaagaagacttctaataatcatatcatcataaattctaatgtgggga

SEQ ID NO: 152226 - DNA, 582 bp, Homo sapiens
gtcgagccggacccaattccagttccagcgtacattaatcaaccaattaagaacagacttaaacaaaacactaaagcataataaacccctgactgcttaatagctttctactcttaatagttgtcttcctgcagtctgctcacaagattagaagagtaatctattcaagtcttaacaaaaattacatgaggaaaaaggaaaaagtaaacccatgcaaaccagacattttaaattgtaaaaaacagaatgctacttaagggttctatagttcaaatcaaaacgtaagagactgagccacacaacacagtatcaaaaaatctcatcagtatgaaatatggtaattcttttccctgaaatacctaaaataattaattcatacaaatgagccttatattttgaaattttagatgactgcattctttaaaaacactatttacccactaattaacagatactataccacttggcataaagtaatttgtgaggagaatctgaggtttcaattatggtagcatataccaaaccataaaatttttaaaaataagaggaaaattaacaaaactaggtcaggtcttgtccttt

SEQ ID NO: 152227 - DNA, 410 bp, Homo sapiens
gtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacaattgttctggtttcttcctgtgcttgaaaagcctctttctttgttgcgttaatacctctgtcttgctttcctcatgtg

SEQ ID NO: 152228 - DNA, 234 bp, Homo sapiens
cttaaatgatttggaccacaatgaagaaaccctatatatgctttttaagaccaattatctattttggcaatgaatcccatatggtcttgcctccttgaactctttcaggcatttatgaatcatcttttccaagagagtaaattctgggaaggcagagttttgttattcacccattttatcctctgtggaacagagtattgtgcttcacagttaataaaagtactttggaaaaag

SEQ ID NO: 152229 - DNA, 181 bp, Homo sapiens
ggtgcgagggagcagtgtgctacccaccttccagcacccaccacagcgctttggaacacagcccaagtctgggctgagcccctgacatggtactcaagagtactgaaggaccacagctcctcagacctggccacctacaggggaggtaggtgggctccagagtgacttctatgccatcctg

SEQ ID NO: 152230 - DNA, 593 bp, Homo sapiens
gctttggagtcgctggttctaagtgtcggtctctccactgatagagacagaggcagagggcattttttcttggaagggaaactgcttaaataaatcaacctcaagtcaggggaaagagaatgttaaaaaaatacagaagtggaatgaatgaacactcccaaaaggaacgagaaaactctcattttcaacctgatgctcccgtcagcccttccgacatgctcgtcagccacagtcactctgctttgtctggggtcatgagacatccgcaggcagaggggctacagtatccctacaggccagaccaacaggaggagggactctagctgaagctccatgacccttctgccctccagtctgggaggagggggcgtgtgtatgtgtgcgcgcgtgcgcgtgtgtgtgtaacaactacaaggtgtcccaaatcctgttctcccatatctggaaaatctgtgacctacataaagccagttcctgcctagtgaggaacaacaggaaaggatagaaaccaagggcaggtggtcgcttctggaggctgctgctggcttcaatgggcatgcctctgtctggcccataatcttgatttctgaaca

SEQ ID NO: 152231 - DNA, 565 bp, Homo sapiens
gctccctctatctgttaccacattacaaagtgaagcaactctgtaagctgctaacacgaaaagacgcttagtgctggctctcctcatacctctctggccattcttagttgcccctttgagctactcctcctctgatagaccttaagtgctatgccctctctgtttctaagagcaacatattccttctgggaagattcccaaatccatccctctagcccagatctttgtcctgtgctccagaacccaaatattcaactgcctagtggacaggtcccaaaatcaaaagtccaaaaccaaatcttccaagtctttcaatatgccttcccagtcttggcaaatgacatcaccatctgcctacttgaacaaggcagaaacctgggagttatcctctactcttcactctccttcacatccaattaatcacagtcttatccttcctgccttcttgagacggagtttcgctctagttgcccagactggagtgcaatgctcctgggttcaagcgattctcctgcctcagcctcctgagtagctgggattacaggcatacaccacaacacccggc

SEQ ID NO: 152232 - DNA, 112 bp, Homo sapiens
ttggactgcagaagggtggtgatgaattgtaacagaaagggtagctttctaccctatgtgaagagctcgctaatgtgtttttcttttttattctggtcaaactgtataatta

SEQ ID NO: 152233 - DNA, 133 bp, Homo sapiens
cccagcctctctgtgtcttatgataaaaaaaatactggatgagacaagactgaggaggaagacccagggaccctttttagcagagcttaccagcgggtgtccaaggattgaatttcccttcctagacatgttt

SEQ ID NO: 152234 - DNA, 381 bp, Homo sapiens
ctgggactacaggcacccaccaccatgcccggctaatttttttttatttttagtaaagacagggtttcaccgtgttagccaggatggtctcgatctcctgacctcgtaatctgcctgccttggcctcccagcactttggccaccgcgccggccttctttttcttttttttgaatcataacttggtggtgtgctataaagaaaagctaaaatatattggcagtaatttgaggaattaattttagaaatttggatataaaaatgttgctttaaggtcattctgtacacaggtaactcttaatattgcatcatttacctgaaatgcagccaaatcagttttctttgtgacagattagagggttacaaagtattttatgaactaa

SEQ ID NO: 152235 - DNA, 419 bp, Homo sapiens
gtttggtgagggccctggggtggccaggcgcctggtcagcctatagtcaggatatagcataaagtggactgatcctactgaatcttccacactggcctctccagtggcccaaagctagagagtcaaaccccaggatgaaatcactttcccgaggaagtatctatccactggcttcccaggctgtggttcattcacgcaacaccagagcttcctccacagcaacccccacaattcacggtttcacatttgattgtgttactatttaattagcatttgtctctctctctttagctcacatgctacaggaggtcaagcgccatggctcatgtgttcacagtgcccagcacagaagcatgcacatagtaggtgtttatttaaaaaagttgattgaatgctgaatgagtgagtgggcactcttc

SEQ ID NO: 152236 - DNA, 246 bp, Homo sapiens
gagtctgagggttggggagagagggaagtgcagtcagaggccagggtgggcaggagggtacagccaggccgcctggtgcaggagacccgggagcacccccttccttaacgagcacctttgcttcctgctttctttttttttttttttgagacagagtcttgctctgttgcccaggctggagtgcaatggcacgatcccggctcactgcaacctccacctcctgggttcaagcgattctcctggctc

SEQ ID NO: 152237 - DNA, 658 bp, Homo sapiens
tactccagagtcagggtcaaaagggctcccttctggatgaagtctgggggagattccgggtgggcctcctggggactttccacaaagatccaaccgcattcccaagccagagtctcagccacctgctcccaggatggcctctccagaaggagactgactgagaataccatccattataaccagtgaaccagccttcagaaataacacacaagtaccacgggagacacaagagtgctttctgtatggcaggccaggctgcagactccaccgggttcccttgagagacagcccagctcctacattaccttcaggaagcaggttcctgaagtccagatttgatttttctaaaaaaactacggcagaatcctcagaacctcatcctctccctttctctcgcagcctgactccccctacaggcaggatgcaccacagagaagcccactgggtggtgagttggacctgcttccacgtggtcccttgatgaaggcggcttcatcacccaccagcctcagcctgagaagtaagatgaggtcagctgggaaggccaggcttaggcccacgggacacgatcccgggagcagaaggaaaggccgctgggggtgacaggccttccccatcaccgcaaactcctggttttctagctttttcctctcacagc

SEQ ID NO: 152238 - DNA, 372 bp, Homo sapiens
ggtccccttgatacatgtctcaggactaattattttacaaggccccgaatcactaacaaaactgttgactacagttttggcaatcatcatttaagtcattactaacggttggatgcaataaatagagatgacagaatggcaaacagctgagatcccacctccagagcccaagaacacagtgtcagagaaagctaacagccacagcagttccacgccggctcgcccaagtcttcagatgtggccctgcccaataaatcagtgtctgcaatggcaagggccactctcttacattttacatcatctttctttcttaatctcaatgttgatgatgtccacttagaagctcaaaaacacgatgagatttcttcaatg

SEQ ID NO: 152239 - DNA, 239 bp, Homo sapiens
cattgaaaggctattgcagtccaaaatcaggaaatgatttaatgaggacattaaacttcttttaacttctctccttcctttttgtacacattgtaagcatcctcacctctggttttccttatcacatagttttacctccatgatcttagttaactctgtcaaaaacttggtgtgttcatgtgcagtctccacacctttgtgtccaaaatatgtcttgattctagccaattttgtgtccc

SEQ ID NO: 152240 - DNA, 105 bp, Homo sapiens
tgccctctgggggaaagaacgtcacacaagggccaggcaagcctttgtatttattaaagactggaggcaagccagggttttccgggaacagcagccgcctgtgag

SEQ ID NO: 152241 - DNA, 253 bp, Homo sapiens
ggaccttgagaagtcactggaggcgggtaaacccaggagtggcagcatcgatttaccctttgagagaacatactgggatgctactgagtgaggaaaacaatagcatagaagagtgtgaaatctagtctccctccttcttaatcaagtaaattgtatattgcagtccttaaaagagattggtcacaaataattttcaacacacctgataactgtgcaaaacttctttttgtctcatttttgagaagtgctctgg

SEQ ID NO: 152242 - DNA, 363 bp, Homo sapiens
atttagtgcagagttctacagagaaggagctaactcagtcctgtttaattgaggtttaaaagagaacactgtgatgcttctttgatcatttatgaatgttatctggtataaccctttgaagtcctctctcaaagagggcacagataagcaagacagcaccactcagcactctggaaggtatttctacttcctttcatctatccatttaacaaatatttacttagtgattaatacacaccaggcagtgtaggctgttgtgattaacaccttgccacaggtctaggtagctactgtcggctctctttcactctcatcccatggaatggtaacttttctcttgctttcccccactacttcattatt

SEQ ID NO: 152243 - DNA, 197 bp, Homo sapiens
tgtattgatctcagtcaagaacacattggccacatctaaggtcagtgatagtattttgccacggtcatagattttatgttgtattcatgatacatacaggtaattagaaagactgagttcattaaatatattcaaaacacagaaactttttaaactccataaatagtagtaatactataagtagtagtacagggtaa

SEQ ID NO: 152244 - DNA, 551 bp, Homo sapiens
ccttctggaatcgaatgtaattccacagatcttctatgttaatgtgcatcggattcctttttcttcactcacttatgcttatgtaccactcactattcctaattcactaggaaaacccctgatgtagttgggctgtgcccctacctaaatctcaacttgaattgtatctcccagaattctcacgtgtagtgggagggagccaggaggaggcaattgaatcgtgggggccagtctttcctgtgctattctcgtggtagtaagtctcacaagatctgatggatttatcacggggttccgctttagccccttcttcatttttctcttgccaccaccatggaagaagtacctttcacctcccaccgtgattctgaggcctccccagccatgtggaactgtaagttcagttaaacctctctttcttcccagtcttgagtatgtctttatcatcagtgtaaaaatggactaatacaaccccctcaagatgatgtattacatcaggaagtagtcttgaatgcccatgccaaagttgggctctctcatctgattccctt

SEQ ID NO: 152245 - DNA, 366 bp, Homo sapiens
gaaacaagattttaagggatattttatggctattttaaaaggcaaggcatccacaaggaggaagctcaaaagctctttataaaaatcaaattggccactctgggccttacaaagaacatgcccatttattaactgatgaaatgtacttgagtgatggctccagtcaactgtttatttttccaagaactctgagccccagtcctaaaaaatcagcttaatatatgcctcaaaaattccctgacagttttaggaagaactggttttaccaacaccaacaagagtaacttgtctattcactgctctaggcatttcccaggaaccatctgtgatctcaggacaatttctagatgtgatctggtgggccag

SEQ ID NO: 152246 - DNA, 140 bp, Homo sapiens
cgcccatcccaggaccataaatttgtggccttgaacttgctgccctcgactggccctttccttctccctgacctgggtctcttccccggggctctttacttggaaacctgcctattgctcaagtcagcctgtattttctg

SEQ ID NO: 152247 - DNA, 170 bp, Homo sapiens
tgtaaattaccaattatacactgaccttctccaaccagccctgcgtttgagctgggtctcatgttttctgtagcatcctccctgtctacaggtggagccacctgctcctctctcaccctccatctctctccattttctgatcccaagtgagattaatgaatcttgtttac

SEQ ID NO: 152248 - DNA, 230 bp, Homo sapiens
gcacctagcacactaaatgctttggagggtcacctaggatgttcaggagtcctgtgaaggggcctacatcgtacagcagagcactgaggttcagagaggcatcagacacccagctccatcggctggaaaagcctaggcatctccactccagagggcaacaggcagtaggcctggtgaccacttcagcttagcagactgggactgcacactttcagaggcagcatcccaca

SEQ ID NO: 152249 - DNA, 653 bp, Homo sapiens
attcctttccttggtcttaaatgccctacacatcagtgattcacaaccctagtcatatattagaatcatctatggaggtttttaaaaaattattcatgcttaagctccatcctggacctattaggtcagaatctggatgtgatgctcaccaaaattttaaaagcctaccaggtgattcttcttttttgtcgttgttggagacggagtctcactctgttgcccaggctggagtgcagtggcgcaatctcagctcactgcaacctctgtctcccgggttcaagcgattctcctgcctcagcttcccaagtagctgggattaaaggcaggcgcgtgccaccacgcccggctaatttttgtatttttagtagagacggggtttcaccatgttggccaggctggtctcaaactcctgacctcaggtgatccgcccgcctcagcctcctaaagtgctgggattataggcatgagccaccgcgcccggccagttctacactaattctcaaatgagatcactacacaatgagaactttgctatacttaccctgtgggcattatagtacaaaaccacaaggtatctgttacaaacattgaatcccgataggtgatcacatgcattcttggcatcaaagatgtcctcatagaccacataagct

SEQ ID NO: 152250 - DNA, 195 bp, Homo sapiens
tggtgatctagaggatcccgaaaatgacatagaggcaggtgcctgtaatcctagctactcaggaggctaaggcaggagaatcacttgagaagaggaaactgagatggggagtgactcattcagtatcacatggtcattttattcctttcattcattcaatcaatcatttactcaataaatttttattgaatgcct

SEQ ID NO: 152251 - DNA, 168 bp, Homo sapiens
tgaaagatcttgtaatcacaaatgcaggaacactgtgattctgatttggcccctgcaatgaggttgcacttttagagcagagtgaaaaatactagtgttttaagaaggaacaaaaccccaaaaccattcacccagattaagatacaagaatattctgaaactgttcct

SEQ ID NO: 152252 - DNA, 428 bp, Homo sapiens
gggtgggcgagtcagtgtttcacagggactgtttcagtcgggaaacatgaaaaccattctggaggtggacatgggggtgggtgcacaacgatgtgaatgcttaaagcggccacaatggtaatttttttttttttgagaccaagtttcactcttgttgcccaggctggagtgcagtggcatgatcacggctcaccgcaacctctgcctcctgggttcaagcaattctcctgcctcaacctcccaagaagctgggattacaggcatgtgccaccacacctggctaattttgtatttttagtagagacagggtttctccatgttagtcaggctggtttcgaactcccgacctcagatgatctgccagccttggcctcccaaagtgggattacaggcatgagccatagtgcctggtcttttttttttttttt

SEQ ID NO: 152253 - DNA, 381 bp, Homo sapiens
tggacaatgaaaactatatttagaaaaactagggacatagatacgcttctcaacttcaaaatacctataatctcaaattcaaattcaaggcttattggtttctctctttctagaaagtttcatgctctccttcaatccggacagttatgtaagggttgttgtaacaccttccatatctggactcactcttttactcctatggctttccaaagacagtggcaatccttctcctgtggctttctccttgaactcttacaaaaaagacaacctctagaataaacaatggaagcaggcagaactaggaaccagtcactcgaaaatatgtcctattgatgtgatgatatatagcatcaattaagaaattttactgacaaaaaaatt

SEQ ID NO: 152254 - DNA, 538 bp, Homo sapiens
catgaacatcctccaacataataccttagcaatcacaaatttgttcttccatgtgtcatttaaatatatgacaaaaagcatgtttatacttttgtattaagatattccctaatgtacaacatggcccagacttgaaattctttccacttaaagcttcaggttatatattcataaattggtcccaacatgattttcttaattagtatactcagggagagggcaaagggagtggagacagttatatctgccatgggtacagctttcattttcaagtcattcactctttttttccacttgtttcctatactcagtgttcaatattttttcctttcattgtccatattttatttatttatttatttattttgagacggagtcctgctctgtcaccaggctggagtgcagtggcacgatcttggctcaatgcaacttccacctccggggttcaagccactctcctgcctcagcctcctgagtagctgggactacaggcacccaccaccatgcccagctaatttttgtatttttagtagaggcg

SEQ ID NO: 152255 - DNA, 463 bp, Homo sapiens
tactttaacatccaaaaataactaaaaagtcctagaaaattaaacttttccaaatttccaaagtacttgtgctgtatgaattctacttcatgtatcatacacaaacaagttatgacaaagacaaactagtcattctcctatttttatgaataacttgtaaagttattacgattacacaaacaggtgattacaaggaaatgtaattacttcctggggaaagactactttcctgttcagataaaggtcttgtttactgctactgccatttctgcaatctaagaagttcaacatcacctcaattacgattctgaatgacctcataaatgaaaaacaaatgtcctgctattagagaatatgtgtatcttcaccctgggatgacacaagagtacgtgaaaataaatcaccaaaagtagcattgggagtccccacaccatcaggagctactggtctggggcactcactc

SEQ ID NO: 152256 - DNA, 342 bp, Homo sapiens
agagctacacatttttaaacaaccagatctcacaagaactcactcactatcacgagaatggcatcaaggggatggtgttaatccttcatgagaaatccaaatctatgatccagtcaccttccaccagaccctacctccaacaatggggattataattcaaacagagatatggtggcaaaacagaacaaaaccatatcagagaatgaagtttggagaacctgttttcatgcctgcttctctgttggtttatacggctgcctccaggctttccttacatagctaccctctcttagagtggggaataattcccttctttgtcttaccaggcctcgatgaggatgc

SEQ ID NO: 152257 - DNA, 252 bp, Homo sapiens
ccatttcagtctggttaagaatcattgctggggagctagtgtgatcatttggagctgtttccctctcagatgtcacaagtgccaccacagctgacaggacccccttcaggagggaaacaatatatgctcaagttctcaaagactcccatgagtataagaagaaggtccaactagtgtataaagagggggtaccccagtttgtaaatgtaccccgcctccttgcggtacgaattacggctatgaagatgcacg

SEQ ID NO: 152258 - DNA, 322 bp, Homo sapiens
cagcattcatccagccggcctctactgggcggcctagagccaagccctcaggacacaaagaggaatgagacccacgcaggggtggagtccagggagcgctcgatgcatggggtgaggacaaggggagaggccagggttcctgggacgcatcaggggaggcttctaggaggaaagcgtcggagccaggctctgaggcacgagcttcggcaaaaacacaaggcctgggcgttgcggcgacttggggggctcaagagctggggtcgggcaccagccagagaggcaggatgagcctccacactgctgcctggcttctggctggcct

SEQ ID NO: 152259 - DNA, 887 bp, Homo sapiens
gtatttagttttgcgaacaagtatatccctaatgaataggatagctggccgcatcttacaatatttccaggctttatttgatttcatggtctgttttaagtttcagaagtattttcctcattttggctgaccacccacacttcttctgctccctgtaagtatctacctctaagcatgtacagcatatgtacctccctcctccatgtgtacaaacattcatcacaaacagagtcccggccatgtgtcaggaggagatgtgaggcattatgaatgaagacaggagttacaaccaaacatgcagaagacaagctccaatgatatctcactgtctgctcacttttcaccagcactatccagagaatagtttttctccttctgccttttaagtcccaaagttctttttaatctttttctgtgatagtgttcctctgatgccttctcttgattcaagtcaagcagcatatgaaactgcctctggcaagatgcctgttcagtgggtcaactggcatatcatacatatcatactgctggaaataagaatatgaagaaatcatagaggagctactgcttattgagggcttactaagaatcagacatcctcttgcctgctgccaggtaagacgtgactttgctcctcctttgccttctgccatgattgtgaggcctcctcagccacgtggaactgtgagtcaattaaacctcttccctgatagcatcattcttacatgattttgctggtatttatccttgtcttgaccttcagttatgttgtaatgatctctttcatcacctgcactgacaggaaccatttctcttgtttaactcttgaatgattcacgtggagggcttgtaccgtggttaattaaaaaagtcactgccccttacga

SEQ ID NO: 152260 - DNA, 445 bp, Homo sapiens
tattctccccactccacaacagaggttgccaagtctctactggggcaaatcgctccccagagggcataggctggtaggcggcagagccagggtttgaacctaagtctcccgagtccagttccaaaatgaacttactggtatttggaattgccagtgtatttcgtatgtggaatcaaatgggaagtaatcagtcatttgagttacatttgcatttattctaacctgatcaagttggaatgagggatgggacagaagagaataatatttatatgcacggtgctcttcattggttactctttcatatctactgacttatttgacttttgaggagctggaagcagagagaagttggaggatttgctggggtcacacagcttggagtggccagctgagagtccattccagatctcatggtcactttctactctctcacattgcagtgttg

SEQ ID NO: 152261 - DNA, 342 bp, Homo sapiens
tgtgttttcgtggagtgtgttagtctgtcaccatatgatgcagatgaaaaaatgcaaacttggatattcaaattttccattctcctgccaactttaatctcttcatgcatcctatctgtaatctatagtacgaacgttcttaaattgctccctcagtgaaaaggtagtcaccacttcagggctcctcccttggaggtttagtaaagcactgttttcttggtattctgttgcgttttcacaatgtccatgtcacgcttgcaaatttaattgctttgctataatcagaaaccaagttggtaatacattttagaccacagtgcaaaaaggaagttttggatgtac

SEQ ID NO: 152262 - DNA, 2014 bp, Homo sapiens
  misc_feature (1)..(3): n is a, c, g, or t
  misc_feature (1334)..(1334): n is a, c, g, or t
nnntgggtttctgaaagcctactaaaagtcgcagatccctgggccaactaactctgaagcctaacatggtgattgtattagtctgttctcacactgctaattccaagtctgggtaatttataaaggaaagaggtttaattgactcacagttccacatggctggggaggcctcacaatcatggcagaagttgaatgagtagcagtgtcaggtcttacctgatggcaggcaggagagcttgtgcaggaaaactcccgtttataaaaccatcaggtctcatgagacttattcattcactaccatgaaaacagtatgggggaaaccaccgtatgattcatttatctccacctggcccctcccttgacacataaggattaccacaagtcaaggtgagatttgggtggggacacagccaaaccatatcagtgatcaaaaaggaaaaaaaattacagtatctatatgtgctgtatgtttctgagagaatctagtaaagacagcatagaaagggatataatcaagaaaaggacttaaaatctagagatggtagttaatcatatgtatgcttccttcagttacccctcccagatttctgtaaatagaacaataatccacgtagatgctgaagccaaacataagagtcattcttaattcccctccttccttgttttcaagccccttccctgataccatcacaaagcatcagcaaattccctcaactgtacctcagaaattttctgacctccactccgcctatctaaaccttttccttacttctgctcctactggtggctcaaaatgatccaaaaatctatgatttctaaaagcctgaagccttttcaaacattcatctttaaattcctggatgcttgttcttttttttttttttttttgacagagtctcattctgtcgcccaggcttgagtgcaatggcatgttcttggctcactgcaactgcccgcctccctggctcaggtcattctctgctcagcctcctgagtagctgagattacaggcaagtgccaccacgcctggctcatttttgtatttttactagagttggggttacatcatgttgaccaggctggtattgaactcctgacttcaggtgatccacccactttggcctcccaaagtgctgggattgcaggcatgagccaccgtgcttggccctggatccttgttctaaagtcacctgttcccccagcgtattactttgtggtggcttcctctgattcacgtcatattaacttagatctactaagatttatgccacatctggatactagaaaacaaacaagcaaaagattttaaacactataaacaaacttggtttagntgagtaaattacacacatgcatgcatacaaatacatatctgtgtatatgcttttaaagtatgtatcagtatatacgtatatgtgcatgtatctacatatatatttatgtgtatatctatatttatgtttttaaagtcctgagaatagtagggtggttgaggatataaaacctgaaatattggtgaggacacattaagggtgtgatttcaatctctgtaagtattgtttcacctttttgcttctgtataatatacctgacctctgtagactttaaaacattggtgagcaaattccctttgaatcaccctgggtggagcagcgtacattactctgttcacaggagatgtctttagttattctccaaactcggtctgttttgctcaccaaaatgaaaaattataaagaaaataactatggtttatcttggtataactcaaatcgtttagaacattatataaatcatagaaactactggatttaatatgaaagtaaacagatttttagtagaagattctttaaaatacttaactgtgtcttcttagttttcacacacaaaaactatgcctgcttctagagtgctgataggtaatacagtgtttaaaaatgtgaaaaaaaaagagtaatttatctacaaggcctaattgtacctcacattctgtgataaatatttcttgtgctcc

SEQ ID NO: 152263 - DNA, 283 bp, Homo sapiens
tccccctcgtcctccaggtgtcatgtaacttgctcctgagaaattaaatctatttctgaaatctctggctgatttcactgttccgtattttcattttttacccaaatctcatctaggtgtgatgactttcattttagaatatattaaaaactctgctggatttggaaacatccccgcttcacaaattcttgctttttaccccctcacacaaaaaaaaaacatatggtatatttgtttccctctttttctataataaataatgtaacacagtgattcaaatgat

SEQ ID NO: 152264 - DNA, 322 bp, Homo sapiens
ggctgaggcaggaggatcacttaaatccaggaggtcaaggctgcagtgagccatgatcatgccactgtgctccagcttgggcgacagagtgagaccctatctccaaaaaaagaaaaaaaaaaaaaaagcatacacagagcaactctgagaaattagtttctactaaaagcacattcatgttacattcagagaaatggaaaatttaattacattacttttcgaccctgcataaataggacaacagcagatgttgtcctatttgagtagatatgacaccctactttaaaaagtacaggtgaaatgacacttggaaatgccacat

SEQ ID NO: 152265 - DNA, 563 bp, Homo sapiens
tacggaggctgtggagttcaggaattcccaactacctggccatgtcagaatcaggggagctgttcactgagcagatgccagggtttgcagaggggcaccagcttcagggtttgtgccctcaggttcggggcctcagactcgattactacactctgggcagcactgacgtccagctctgggaacctggacacctgcatcatggcaatttaagtttgggtttgaagctggcccctgctctgccactcactcacgatgagaccttgtgtggtgcctactctgagcccgtttcctcttctggaaaaaggggctgacacgaatacctaccacctcacatggctgctgtgaggacatctgagttaatacttgcaaagcgtggaaccgctaatgctgggcacgtggcgactgatcaggaaagccgctctgaaattattactgctgtgatgaccttttaaaaactgaggtttgtctcacaggcaagggggcatttaaagagtgtttctcttctttcatgtcccactttcccctaacctgaggcaaatctgttagtaaatggttgttagtaa

SEQ ID NO: 152266 - DNA, 287 bp, Homo sapiens
ctgtgaggtcgatctacaggatcttaacgtcagcactccttgagcaggtacaggatctcagacatatctccatgggctacaaagagcaaaaataaagcaaataaacaaaaagcccctggaaatcctatagttatcctaatacatattttaaagtattacctatcactgagcaagtgcatctatacatttcaatccttttggaaaatatactttctcaaacttcatgttgtatccctctaaagttagttagcacatattgtacattcagaagaaatgttcatttacag

SEQ ID NO: 152267 - DNA, 513 bp, Homo sapiens
ttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttag

SEQ ID NO: 152268 - DNA, 267 bp, Homo sapiens
ataattcaggtaatgcatcacagaatggacagtgataggccgggcacaatggctcatgcctgtaatctcagcaatttgggagatcgaggctggtgggtcacctgggcccaggagttggagaccagtctgggcaacatagtgaaaccccatctctaccaaaaacacacacacacacaaactgccaggcatggtggtccacgcctatagtctgagctgtttgggaaatggcttgagaccaggagatgggaggatggcttgagtccagga

SEQ ID NO: 152269 - DNA, 165 bp, Homo sapiens
ttttcgagtgtgtgtttctctcgtactttcattgtctggagggatgttttgctatttagtcttctcttctttatagaaactatatgtgagttagttttctgagcctttagaacacaggtgtccaatcttttggcttccctgggtcacactggaagaagaaggatt

SEQ ID NO: 152270 - DNA, 726 bp, Homo sapiens
ggctttatcagcctttgaccaattaaagcaagccctacttgaggcaccagccctagatattagaagaatatctgtctgaagctgagtagggtgcaaaacctttggcaccaatcaagtgaaaagtttgctcaactttaatttttcagagttgtgtaagctgaagcagttgagatgtctatggtgtcagctattgtttgtgctattaatcttcagtcctcttcaattacgacacaagcaagattatattttttctcataagttgatgtggatggcctgtcactgtgaacttcattttcaagattatcttttcccttcttaaaatgaattatctatttgtaaactgatgatttcattgttcccataaactttttgtaaagcatcactaatttcaccattcttccactcaaacttcactatacaattgatgtttgtccttgcttcaattttagcagaatttgtgttgctgtcataggggcctttttcaaattgatgccttttccttagtgcttcaaactagatcctgttcagacatgtcatgacaaattgttgtgtatttattttagtataaataattgaaaaccatgcacagatttttatgatatgcattttccataaaattttggcttgtatctacaagaaacacactttaaatataaacatataaataggttaaaaataaaagtatggaaaggggtgcataccatgcaaacacaattaaaaataaag

SEQ ID NO: 152271 - DNA, 183 bp, Homo sapiens
ggagtccccctcaagtagctctgcccacaggaactgctgatgtacaaagacagctgttgcttcaaaggccagatatcttcaggctcttctatatgccctggcatctgttaccattgctgccactgctaccaggcttgcttccatctctggagcttctcccattttcagatctttcccatacct

SEQ ID NO: 152272 - DNA, 345 bp, Homo sapiens
cgggcggggcgaccgggctctggggtctggctgtgccggtggggcacacaggatgccagagcagtcacaccctggggaccacccagcccaagccctacctggagaaatccaggcctttccccagcgcctacagggagaggggaaactgtcctgcgctgcccgcctcacaacatctttgcaattgccctccttgccaaggtgagagagaggccccagaggtgaagttagtggagggctcggctcctttctaaccgctgcgctgtggaatcaggggcactgtccagagccctggcaggacctctttgaggactcaggaaaaggtctcctttgctccccccattaccc

SEQ ID NO: 152273 - DNA, 257 bp, Homo sapiens
ttttcagtctttctgtattgagaagcagtggttggggcattttttaaggtggctggctactcttgttttccctcatgatagtaagtttgtcataactcagtaacatggacttgcccctagaggcagctgttaataattttgaaatattaaggtcttgccaagcttctgatgattcaaacctgtactactgattattaagcaggacagactgagctttctgttgcaaatcccttggaggagaaagtaatttctaaata

SEQ ID NO: 152274 - DNA, 294 bp, Homo sapiens
ttttgaaagttgccaatgacctcttaattgccagatttctataatatttcaccctgttcattttataagtcctcttctatgttattcttggattcaatatttgtgtttaaaaggtaatattaagtactatgtatcaggcactgtgatatctcttaatctaatttgtcactaattcccttaaagtaccccatgcccaacctaaaccaagtggatcttctttccaatttgtaccccatggtggcatgcctatgtgttttcatttattctgttagcccatcctcttacatgtcgaaa

SEQ ID NO: 152275 - DNA, 779 bp, Homo sapiens
ctcaggcccctggaccttggctcaccacctaagactgaacaagcactaaaggacagaccagcccgctaacagctcactccaaaaatgagcgggactcccagagaaactatttttattggagcatcctggttttgccacctgctcaccccactgcctgtccttctctccaaggaggcttctgccagccctgcttgtccttccctagaaaaggaaagccttttcctgtttgatcctgagacacctgtagattgagtttggaatattctccctattgcaatagtatttttgaataagttttatttttccctacctctggttgatttttaattaataccagcaagcttggatgaaagcctgcacaccttaggggtgtgtgtgtgtgtgtatgtatgtactttagcattaccatgaaagtaataacagtaaaatcaaacaaacacagatggataagcaatatgttggactagtatgaaaatggcattgccagcagtgacatgattttttttcaaaatggtacactttttgaagtataatcttattttaacctaaaatcttactatcagaaaatgcagtgtacattaaaatgttctgaactgcttttattcatatattaaatggttgtactcaaatatctacaaatttgtttttcacttatgtgattgtcttatagaatgtccaaaagtcttgcagaatgtgagacaattttctattgaatatgattgctttatcattgcaagacatcaaacatccctgtttcctgccaaataaatgtacaatag

SEQ ID NO: 152276 - DNA, 141 bp, Homo sapiens
tgggggtagttttgccaatgaatattttagagactattaggtttagtataaagatggtttcagggtggtagtgtgaaagtatcggaatcctggaataaaaatacagctcccatgataaaatcttaaatttatacagctaaa

SEQ ID NO: 152277 - DNA, 302 bp, Homo sapiens
ccaccatggacagagcagggttatcatgtagtctgaatccgtaaaaacaccctaggttttggcggggcctggtgactcacgcctgtaatcccaacactttggaaggtcaaggcgggcggatcatgaggtcaagagatcgagaccatcctggccaacatggtgaaacaccatctctactacagatacaaaaattagctgggcatgggggcacatgcctgtagtcccagctactctggaaactgaggcaggagaatcgcttgaacctgggaggtggaggttacagtgagctgagatcgcgccac

SEQ ID NO: 152278 - DNA, 356 bp, Homo sapiens
gactgtgtcagtgcactggaacaaagcaggaacttatctgccggaaacagaagccacactttttattcaggagagtggccctggaacttcaacgtactttctgatcctaagagctgggtgtggtgggattagtggagggcaaagtgggagataatgtggcagggctgggcacggtcaaacatcttcctcccatcagctctgcttttctttcactagctgcttcctccatgcccaataccgctgggatgtttctcatcaacgagcaccctcctgggccagaccccaggccaggtgagcctatgaaagtcctcatctgttcagcattgtccagatgcttcctgagtgcctcttaagaa

SEQ ID NO: 152279 - DNA, 335 bp, Homo sapiens
ttgttgtgtacattgctttcttttgagaaaaagaatgtggttttcattatatatgaaaaactaataccaggcttggcacggtggctcacgcctgtaatcccagcactttgggaggccgaggcgagaggatcacctcaggtcaggagttcaagacgagcctggccaacatggcgaagccctgtctctactaaaaatgcaaaaattagccgggcgtgctggtgcacacctgtaatcccagctactcgggagactgaggcaggagaattgcttgaacctgggaggtggaatattaaatccttctaatatttaatgaaaaatcagccttggagatactg

SEQ ID NO: 152280 - DNA, 147 bp, Homo sapiens
atttcacacgtaatggtatctgtgctgtgtcttgaaagataagaaactccaaacaatcaaagggatgatagtcattccaggtaaaaggacaaaagcaaacattcctaggccctaggtgatccaccgtgcctagccggtgatgggttt

SEQ ID NO: 152281 - DNA, 387 bp, Homo sapiens
atgcctaagtcagaaatttaagttcagacttatcctgctttatcagtaaaaaaaattgacaaggacaaatatgccagattttaagaaattcttaaagcccacagagaatcttagaatgacaatcctcatcaggctcttaggaaatcatccattccatggaattgcttgctattctgagaactgctatgactaaaaaatccaacaagactccatttcaaggaacctaatattcaattttaaaagcaaactaaagtaacactctttgttgtgttttaaatttagcaggtattactctcctatgccatttttaaaataatgggttcctttaaaacaccttcattaaaattatgttcatttcataccaaacaacaaagaatgtttccacta

SEQ ID NO: 152282 - DNA, 239 bp, Homo sapiens
ccagaagactgagggttcagcaagttaacttgctcaaggacaaagggctaataagtggtggaactaggattaaaatctgcttgagactcactgttcaatacaagagccactagctccatatggctacttacatttacattaaaattaagttaaaaaatcagtttctccatcacattagtcacacttcagatactcagtagtcacatgtggcttgtagctactgtcttggatagtgcaaa

SEQ ID NO: 152283 - DNA, 533 bp, Homo sapiens
agctgggactacaggagtgcaccaccacacccagctaatgttttgtattttagtagagacagggttttaccatgttggccaggctggtctcgaacttctgatctcatgatccaaccacctcggcctcccaaagtgctgggattataggcgtgagccaccgcgcctggccctttatttctttttataccaaatacaaaatattacattctatagatataccacattttgtttatctgcttgtcagttaatgaacgttcggttgtttctacattttggctattatgaataatgttgctatgaacattggtgtgccagtttttctatagacatatatcttccctaggagtagaataatgggatcatatgatcactcttaacgtctaactttctgaggaactgtgaaactgtttttccaaagcagatgtaccattttacattcctacctaccatgtatgatggtttcagtttctctctatcttttcccatcttcttaagtattactacttttttttttcctgacagtctcgctcttt

SEQ ID NO: 152284 - DNA, 650 bp, Homo sapiens
aatagaacaattcagctgtctctttagaaaacttggcaaaaggaaatgctccctgctgaaaattttcttagcctgttgcacaaaagatgaagtttgtttaagaaattgctgctaaagaaagcgtcaacccattaaggtaacatggaagcaaatattctcagaaaccaacagagaaattgagctgattcggacactagaagagccagctaccttctgttttattttagctttgttgtttcatcttcgtcatatcgtatccaagtaaaattggaggaaaatgtcagaagaagcttacaggctcacactcccttctgcgaccttgttgaagaaggcgcctgctccccttttgtcttctgccatgattgtaaggatcctgaggcctccgagccatgcttcctgttaagcctgtggaactgtcctggctatggaggagggttccattcttacctgttgctctacaatgtacagctgatgttttacaataaaaacatggagtcatgctaactcccacatgccctaccattcactctccccaagccagtaacaaagcaggcaacgcagctaatataatatttagactaaccgtgaagaaaaagatctttctcccttctgtactctgaataaataaattagtctgaccaaatgaagaa

SEQ ID NO: 152285 - DNA, 287 bp, Homo sapiens
cgccaacattatttctacaactctaccagaacgcgaaacaaaaaaaccttcagtcctggctatggaggagggttccattcttacctgttgctctacaatgtacagctgatgttttacaataaaaacatggagtcatgctaactcccacatgccctaccattcactctccccaagccagtaacaaagcaggcaacgcagctaatataatatttagactaaccgtgaagaaaaagatctttctcccttctgtactctgaataaataaattagtctgaccaaatgaagaa

SEQ ID NO: 152286 - DNA, 499 bp, Homo sapiens
acatctctttccctacttctcatcctcaaacctcatattatgtcattaaggacaggttaatgacaaagtctgagacaataagtcagtcttactaactcccaaattcggtgttgattccacaacagtacactacctccctgggaggaggtggccaatcttctataatctaggtgaaattaactgacctatccttttatctggtctctaatgaatttaaagaggtggattcatatgaaaaatatttactatttattacacaggtagaacattcccattcttcaaattatgtttttctttatttctccaattatttgttacatataggcgcatcatatctgaataaaaggtttccttttattcgtcaaagaaaaggattttatatctaaaaggaaaacaactctatacataggttatatgatattttggtggagtttttaatcctaaaccttaaaaaaaaatgtttaactggaggtgggaggagaggaagggtaccgagctc

SEQ ID NO: 152287 - DNA, 316 bp, Homo sapiens
tcaaatgtcttaataagcaaatacatggcaagagaaccagactgtagtttgggttgttgagatgaggttatttataagatctgttaagtcactttcgttaagattgcaggttatcaggtccaggaagatggtcacagtagaaacatcacataggttgtgctttagccacatctagccaagaatgaagttcattgagcaatggcaattatgagaacataaggactgtgtttttctcccccaaaattgccagaataagatagatattccctagtccagtggttctcagacatgcttccagaccagcagtgccggcctg

SEQ ID NO: 152288 - DNA, 237 bp, Homo sapiens
gcacctaacaggctctccagaaatgctttcctaactcaccacgggaagtcccggggtcagagtcttctcgcttttctcggagtgactcctcacccaaaagctctttgcacagctctgctccatgtgaccccttttagcctgggtcaggactagaatgctggtgccgacttttaaatcattcccagccgggcgccacggctcatgtctgcaatcccaacactctgggaacccaggtgg

SEQ ID NO: 152289 - DNA, 414 bp, Homo sapiens
gcactctagcctgggtgacagagcaagactccatctcacaaaaataaataaataaataacacaaaaaaacaaaacaaaaaaaacccttatcacagcactgcataaatgcttatcctgatgcttttgccaccgccattcgggtttaagctccaaagggacagaatcccattctgctcagatttattttcccagggcctggcatcatacctagcacatgacagatacttaaaaacatgtgccgacccaatggaaggctgtggtgtgctggtctatatgtaaacttatcccatcattctgccagagtgacctccatgaacaatctaattctggtttcttgcttaaaaaacctgtgaggactctgggatactcacagactgaagtctgactccttggtagtatccacaaagattcaaa

SEQ ID NO: 152290 - DNA, 286 bp, Homo sapiens
gctacgtgcttcattctgttaggtaggtgtgtgggaggaggagaacacaaggggagaaagtgttgtacatgcaaaagaaacaggaggcttataatctcatcagggagatgaaaaaaaaccctgacaccctcaaagtcaaagcagtatgcaattaagtgagaatccagggatacagacatcaagaacagcagaggctcagagaaggatgaggctagcatggccagagggtcaggctcccagtcctcatacatcaggccagaaacaaggcacctaatgcctctcctgg

SEQ ID NO: 152291 - DNA, 172 bp, Homo sapiens
aacgcacctgatcacacacatgcacacacatgctacactctcacacatgcaaacacatacacttacctgaacacacacatgcgcacacacacaccacactcgcacacaccctccggcatgtccagagtatttctcttccctggtgggagaagctcttggtgcttggagactc

SEQ ID NO: 152292 - DNA, 310 bp, Homo sapiens
gttctgaggatcccggtctgtatcgggggtgggatgtccttgctcaaatggatgtccttgacatatctaggttttagttaactcaactaatggcatgcatgtattgatatccaccccctctgctacatagtgttaatctgaggattaatgagatgacatgtaaaaaagtgctttgaaaaacactttttcagtctgatgaaaaaagctgagatttttgagcctgatgggtcaccactgctgcccttcatggaaccatgctctcataaaataaacaaaagcctcgcagccagccagccagccactttcctcg

SEQ ID NO: 152293 - DNA, 363 bp, Homo sapiens
tgtgtgtggttagtggtaataataataattagcaactaatatttaataattgtagatgtacaatgttttgcataacatacccatggctggctaaagtcccaagaaatacagaaggatttaagatgaaaagtgcattcctgcacctcccacatctggaaatcaccgtctcacctgcttctcatatatcctcccaggattttaaaaatgctcatacaggctgtgtgtgtgtgtgtgtgtgtacacacaatgtattcatttgaatgcacctggcatcatattaacatgctaaaagctaggaattacatcctgtatattgttaatgtcatagttactgttaattggatgatgtttaaagtttgcaag

SEQ ID NO: 152294 - DNA, 376 bp, Homo sapiens
tttcccatggcctcaacaagacaaccacatcagaatactacatgcacatattgatggatgaacacacccagcggtaggacgttgttttattataaagggttattatgatgatacaaatgtcacagacatttagagagtgggccagtgttcctgggtgctaaggcgttgtttgcagctctagtgggaggcagaggaaggtacacattgtaggcctccgtttctttaatagggaagaccctcttaaagagggtgcagcagtttggagaagaagctcctgctgttgttgttgctgctgttgtttctcctggggccacgtgtctgactgctcctatttcagggcaactgggtcacagctgtgctgccggccacagggctt

SEQ ID NO: 152295 - DNA, 284 bp, Homo sapiens
atactgaacaatttagtctctgctagaaaatctaggtatattccatcctgcccctgccaaagattgtagacgtcagtctaactacattagtgaaacaaaaatgtaatataaacagttttaactctgctatttaaaataaaaataccaagaacaaagccttctattttaagtgctctgatttctgctaaaaacattagcatattttggggactcaatgaaaagcagctgatggttcaaatgatcaatgtctcaaatatttattgcctttacaaatgattttcaag

SEQ ID NO: 152296 - DNA, 379 bp, Homo sapiens
attactcactcgtctgtctcctccttctagaatggaagctcttgaaggcagagatattcaggtcatttacattcactcctgtttttccagtgcgcagaaagttgcgtggcacacagtggtccctcagcactgcctgaacttgtgcaccgctgcctgctaggctaaatggtaccctgtatttcttcttgaatcacagtctccaccctggatttctattacttgtctgtttttgctgctggaaagtaggctttgtgagtttgagatccatctgtctgtcttgttcatgggtctgttctcagggcctgccagcagttggtaggccctaagtactccgtaagtatctcttacattaaaaaacaaatgactaggctgggcgcag

SEQ ID NO: 152297 - DNA, 533 bp, Homo sapiens
acaggcacgcaccaccatgcctggctaatttttgtatttatagtagagacagggtttcaccgtattggccaggctgggcagtgggattcttatcatgagagtgggtttgctacgaaagtgaatttgacctttttgctgtctcttgcagggactttttccctttcaccttccattataggatgatgcagcaagaaggccctcaccagataccagtcctttgatcttggactacccaggcttcagaactataagaaataaatctccgttctttgaggattacccagtttgtgctattctgttatggcagcacaaaatggactaagacataggtccaatctaaggcctatctcccagaggacacctcatagctgtgaatgaatgagcactaagtaagccagcatctgccttttttgttctggaaatcccactgtttataagatttcaaactattgcacatctctggtaatcttttctccttgtttctctctctacaaggtcaaacagacctgtacattttcaactgactctactgg

SEQ ID NO: 152298 - DNA, 159 bp, Homo sapiens
tatgggtcatgaggaaaaggaagaaccaaggatgactgcaggtttctagctgggggatttcaaagggaggcatatgctagtagaacctaaaagaccattttgccagttttccttttctccttatgtacaaagacagttcctacttcatgactctttttt

SEQ ID NO: 152299 - DNA, 366 bp, Homo sapiens
aacacgtacaatattatgcttaaatattgatgtcattacttcttccaggcaacagctcataaaataaatccatagttctctgccagctaagaagtcacaggaaacagaaactccctcaaaatcttagcctgtttctgagggtaaacctgagatttcatgggcactcattctgctctgctacatttttccctgtctttcttttttataaagaggatttgcttcagaggcaatgcagacaaatgaattattcatagagaaagagataaaagagagaaggtttcagggactaaaatagttaggcctcaggttctatgagtttgatcacattgactactaagtaggcatcttgggagctgaaataaacca

SEQ ID NO: 152300 - DNA, 458 bp, Homo sapiens
gaatgctgctgaggaccctgaaaacctgcagggaccctgtcccaggccagcgacagccacccctcagggcccctggtctctgtcaggcaatgcgggtcatctgagggaggctgggccacagattccacgtgtagctgggaggggttgctgcgtctggcgaggcaagggctgctgtctaaacttccaagggaatgatgtgggcaccccaggaggaagggatgccctgaccccgctgcatagtcgagggcatggagaacccatccgactgtggccttgtggcccatccccattctctgacgggctcattgtgattttcagccacttgctatttgccactcagaggcaaagcggctgcaagaggtaggagaaagcaagagactccctcacctggaatagagcatccaccgcgatcccagaaaagacaaatcccgttgcaggcacttcaatccacacagcag

SEQ ID NO: 152301 - DNA, 682 bp, Homo sapiens
cagtgtctcttctgtcacccaggctggagtgcagtggctcagtctgggtcactgcaacctctgcctcttgggctcaagtgattctcccaactcagccttctgggtagctgggattccagatgggggagtatgaacattgaaaaccaaggaactgggaccctttcctctcttccaaaaaatgttgttgagcacctgtgtcagacacccatcatactaaaatgaataagatagagcccctgtcctcaaggatctgatgttctagtgaagaagacagattaacagattttgctgctgctgctgctgctgctaagaatcctttcttctcacctctgggtgcctgaaagtcagcaggagttacaagcggaaatttggccaaaatgcattgcactctgaaagaaaatgcttaatttctctaaaagtgaaggacttgctgagaaaaaaatgttgaaaatataatgagcaggcatttcaatgcaaaaggtgatacaatatacccattacgttgctattctcatgggacagaaccaacctttgacttttgtataaactatctggcaatattacgtaagacacctcctatttgtagttctgtttcagaacatagtatataatctggtatatatcataatgaataaagtcataatgaataaaatcaaaatagggtgccgccctatttgataat

SEQ ID NO: 152302 - DNA, 621 bp, Homo sapiens
  misc_feature (20)..(20): n is a, c, g, or t
  misc_feature (35)..(35): n is a, c, g, or t
cccccccccccccccccccnccccccccccccccnccttgctccccaaccctctcaccatgggggagtatgaacattgaaaaccaaggaactgggaccctttcctctcttccaaaaaatgttgttgagcacctgtgtcagacacccatcatactaaaatgaataagatagagcccctgtcctcaaggatctgatgttctagtgaagaagacagattaacagattttgctgctgctgctgctgctgctaagaatcctttcttctcacctctgggtgcctgaaagtcagcaggagttacaagcggaaatttggccaaaatgcattgcactctgaaagaaaatgcttaatttctctaaaagtgaaggacttgctgagaaaaaaatgttgaaaatataatgagcaggcatttcaatgcaaaaggtgatacaatatacccattacgttgctattctcatgggacagaaccaacctttgacttttgtataaactatctggcaatattacgtaagacacctcctatttgtagttctgtttcagaacatagtatataatctggtatatatcataatgaataaagtcataatgaataaaatcaaaatagggtgccgccctatttgataat

SEQ ID NO: 152303 - DNA, 987 bp, Homo sapiens
  misc_feature (20)..(20): n is a, c, g, or t
  misc_feature (35)..(35): n is a, c, g, or t
cccccccccccccccccccnccccccccccccccnccttgctccccaaccctctcaccatgggggagtatgaacattgaaaaccaaggaactgggaccctttcctctcttccaaaaaatgttgttgagcacctgtgtcagacacccatcatactaaaatgaataagatagagcccctgtcctcaaggatctgatgttctagtgaagaagacagattaacagattttgctgctgctgctgctgctgctaagaatcctttcttctcacctctgggtgcctgaaagtcagcaggagttacaagcggaaatttggccaaaatgcattgcactctgaaagaaaatgcttaatttctctaaaagtgaaggacttgctgagaaaaaaatgttgaaaatataatgagcaggcatttcaatgcaaaaggtgatacaatatacccattacgttgctattctcatgggacagaaccaacctttgacttttgtataaactatctggcaatattacgtaagacacctcctatttgtagttctgtttcagaacatagtatataatctggtatatatcataatgaataaagtcataatgaataaaatcaaaatagggtgccgccctatttgataataaaacttttcatgtcactgaatgcatatatttatcaaacttcctgtactaaaatgaaatacacatatataagcaggcatactccaaaaatttaacaggaataatttaacactcttgagacaggagtaatacaaggtggtcacaggagaatagaaaattccagacagcagtttcacatgtttagcagaagaaaactgttgaaatagctgcataaggtaggggctgataagaccctgaaaaacgaaggtgtgggccaagctggctaagactaactggacccaacatggcactggatttgacctaggtttcacctaagatctcattatactctcattaacatactaaatcacacacccaccagtgtaat

SEQ ID NO: 152304 - DNA, 619 bp, Homo sapiens
  misc_feature (20)..(20): n is a, c, g, or t
  misc_feature (35)..(35): n is a, c, g, or t
  misc_feature (612)..(612): n is a, c, g, or t
  misc_feature (619)..(619): n is a, c, g, or t
cccccccccccccccccccnccccccccccccccnccttgctccccaaccctctcaccatgggggagtatgaacattgaaaaccaaggaactgggaccctttcctctcttccaaaaaatgttgttgagcacctgtgtcagacacccatcatactaaaatgaataagatagagcccctgtcctcaaggatctgatgttctagtgaagaagacagattaacagattttgctgctgctgctgctgctgctaagaatcctttcttctcacctctgggtgcctgaaagtcagcaggagttacaagcggaaatttggccaaaatgcattgcactctgaaagaaaatgcttaatttctctaaaagtgaaggacttgctgagaaaaaaatgttgaaaatataatgagcaggcatttcaatgcaaaaggtgatacaatatacccattacgttgctattctcatgggacagaaccaacctttgacttttgtataaactatctggcaatattacgtaagacacctcctatttgtagttctgtttcagaacatagtatataatctggtatatatcataatgaataaagtcatggcctcgttggcctcagcggtggagctctgcngccggan

SEQ ID NO: 152305 - DNA, 229 bp, Homo sapiens
aaacagtgacgtgtgaaccatcctgggatggtatgaaagacaagcgcaggtctggaaaagcagttcagaagccactcaactgtctacgctggggagacggtttcgtgagctaccaccacagcctataactacttatccattaaaaatgataataaaacccaggaagaggccgggaaaacattcaataaaccagcgtgctgagggaatctgcacaacccccctccctgcc

SEQ ID NO: 152306 - DNA, 354 bp, Homo sapiens
ccggaacggtttcagttgttaacctcacagcttggtgaccctgcagacactgactacacagctgtgggatgtgcgatcaccactatttcttccaacctgacggagatgtccaagggtgtgaagctattggccgccctcatggatgatgaggtgggcagcggggaggacttgctcagagctgccaggaccctcgctggggcggtgtcagacttgctgaaagctgtgcagcctacttctggagagcctcgacagacagttttgactgctgctggcagcatcggacaagccagtggggatcttctgagacagattggagagaatgagactgatgagcgattccaggtaagatatttg

SEQ ID NO: 152307 - DNA, 280 bp, Homo sapiens
gagaggtgggacacgggtgcacacaccatgctggtaatttttttttttgtagtagatatggggtttcaccatgttggccaggctgatctcaaactcctggcctcaagtgatccacccaccttggcttcccaaaatgctgggattataggactgagccactgggcatagcctgtttcccttctcatttgacatttaagaattggtgccttggactgctccctgctgcgtgaaacactccctccacatacactgcggacctccctctccctggttctcctcc

SEQ ID NO: 152308 - DNA, 130 bp, Homo sapiens
tcattcctctgccaagtccgctgaaagaatgaggaattggattgccttctgcagggagctttgggcaggtgtatgtctggcatcccagatattattcttattggaacaatagaacatcatgagtttgcat

SEQ ID NO: 152309 - DNA, 414 bp, Homo sapiens
ggcgacagagtgagattccatctcaaaacaaaacaaaacaaaacccctgttaagagaatgaaaaaacaaactacaaaatgggaggagggatttacaaaccatgtatctgacaaaggactagtgcctagaatacataaaaaattcttaaaactcaacataaatacagtgagccaggagaacactggtttggactgagctcctgcaccaggcccagcagaccaaaccaaaatggagtccctcttggtaacctccataccaccaagccaaaagtaagttgtttatctgactttgcaagaagtcaggagaaagagaacagcaaatcccccaaatgggccagtttgggccagcgtggtaaggaagtcccctctgcgttaacctttacaagggaagtcactctgaaaccacccatctgct

SEQ ID NO: 152310 - DNA, 771 bp, Homo sapiens
cccggtgctgggtaaattagagaaaatgaggaacaaaaccacacctggaatctgaaactaaaattaactttttccagcaatgtcctattgtgtccggaattggtgggttcttggtctcactgacttcaagaatgaagccgcggaccctcgcgctcaaaatactcttatttgagcctaagaagagaactaagaggagaaaggaatgtgcagctgtgagggtcttaaaagcaaatgaatctaaggtctgtttcctagtgctacctttagggtctcttacccttggaactctacacagctgtcagaaagagataaatgaattcttagagtttgggtgcacagaatattgtcttatggaacttcaaaaatcgttagatccatcttcataaaaagaactcttgcagtcaaataacctgtttccaggaaaggaatggccatggcatatagaccaacctcgacttgcggatgaaactacactaatgggcatcaagtttatttgaattcgagatataaactgaacgtctgccagagaagacttgatttgatatttttatataatctgtattttagtaaactaaagtctatgtatgtaatctgatatatatgtaataaataaatatgcataataaatagcgatgccggcgtttccttagggagggtaaatcatgatcccgcttacttactcgctgcgctcgggctttgggtgcgggaagcgtttatcttcctaaagggggtattcggttatcccagatccgggatacgcgagaagacatt

SEQ ID NO: 152311 - DNA, 628 bp, Homo sapiens
cccggtgctgggtaaattagagaaaatgaggaacaaaaccacacctggaatctgaaactaaaattaactttttccagcaatgtcctattgtgtccggaattggtgggttcttggtctcactgacttcaagaatgaagccgcggaccctcgcgctgtcagaaagagataaatgaattcttagagtttgggtgcacagaatattgtcttatggaacttcaaaaatcgttagatccatcttcataaaaagaactcttgcagtcaaataacctgtttccaggaaaggaatggccatggcatatagaccaacctcgacttgcggatgaaactacactaatgggcatcaagtttatttgaattcgagatataaactgaacgtctgccagagaagacttgatttgatatttttatataatctgtattttagtaaactaaagtctatgtatgtaatctgatatatatgtaataaataaatatgcataataaatagcgatgccggcgtttccttagggagggtaaatcatgatcccgcttacttactcgctgcgctcgggctttgggtgcgggaagcgtttatcttcctaaagggggtattcggttatcccagatccgggatacgcgagaagacatt

SEQ ID NO: 152312 - DNA, 847 bp, Homo sapiens
  misc_feature (270)..(270): n is a, c, g, or t
  misc_feature (276)..(276): n is a, c, g, or t
  misc_feature (279)..(279): n is a, c, g, or t
tcacagttaaattgcctaaacgccagtccagtggctttttttcccccccaagggggaacttaaacccgcgggcccctcttttaataaaaccccccctggggcccgggggggggggttttttttaaaaaggggggccaccccccccccccgaattttaaaaaaaaaaattttttttccccggttcttttttcccaaaaggggtttttgccccccccctccaaaaaaaaccggccccccccccccaaaaaaatttttttttttttccctttnaaaaanccntaatacactgtgagggtcttaaaagcaaatgaatctaaggtctgtttcctagtgctacctttagggtctcttacccttggaactctacacagctgtcagaaagagataaatgaattcttagagtttgggtgcacagaatattgtcttatggaacttcaaaaatcgttagatccatcttcataaaaagaactcttgcagtcaaataacctgtttccaggaaaggaatggccatggcatatagaccaacctcgacttgcggatgaaactacactaatgggcatcaagtttatttgaattcgagatataaactgaacgtctgccagagaagacttgatttgatatttttatataatctgtattttagtaaactaaagtctatgtatgtaatctgatatatatgtaataaataaatatgcataataaatagcgatgccggcgtttccttagggagggtaaatcatgatcccgcttacttactcgctgcgctcgggctttgggtgcgggaagcgtttatcttcctaaagggggtattcggttatcccagatccgggatacgcgagaagacatt

SEQ ID NO: 152313 - DNA, 636 bp, Homo sapiens
tcatttgcttgatgacttcatttcttgacacttgggaaaaggtgactaaatcctttctttactaagaatgaaagaatgtgaccacattttcccctcattctgtgtttgctccagactaagaaagattcagataagatgttgcaggggtggtgggttcacaaatgatgtattggtaataaagcagaagtgttttgtaagggcatgggtgatggctatctgctcccaaactgtgtcacctgccttatcagagggagactcacttgggttcctcaagcttacaagcctctttgaggaattctcaaactaaagatctatcccatgtgtctagaattagctaagacatttctatgagtatttacaaccagcacagtaccagggaatgcattactgattgtcagacagacttattggtaaatactggagtctctaattgcacagatcattaaaaaatttatggctactttacatagtactattacaatggcatgagaataaattggttccatggaagtataaagcgttgagctcaacgctttatacttcagaaatgtttgcccattcaaaaatgtcgggcaggggctgttccatgttataagcttgactaaaaaaaactttttgggaaacacaatttgcggg

SEQ ID NO: 152314 - DNA, 115 bp, Homo sapiens
ttcagttaatccagggatatgcacagttacattttattcctaaacactgggcattttattttgtctgtaaggttaccccttcttctttcattacaagcacttaggaaagaagcct

SEQ ID NO: 152315 - DNA, 541 bp, Homo sapiens
cttaacttctctgtgtctcagtttcctcatctgtaaactgaagataataatagtaacatactttatagggttgttttaagaaataagtgagttaatacataaaataaacttagagcagactgtggcacaatggtaagtgctcaataaatattagttgctattatttgaattccagcgttgtcacttgaaactgtgtaatcatggtcaaagtttaagtaactctctgagacttaatttcctcatctgtaggagtgggattatacttcatatagtggttgtgaggattaaatgaggtaacatatgtaaagtgggtttcactgtgcctggtaagtattcaatagattccagtttttttccccatattaacctgttgtcaggtgctagctactgtgttagatgatttaggaagctaattatctgaattatatattggcttattacttagttgtatgtttatcccaggaaacattacagataatatgaatttgaataaattctgaattccatcttttttttttttttttttttttttgagacagtc

SEQ ID NO: 152316 - DNA, 446 bp, Homo sapiens
aacgggtgatgcggttggagctgaggcacgtcctccaaagcagccgaggaggagggggaagatccgcaggttcccacaaggtcaaggacctgctaagcccctgcctaaggattcacctcccaggaaggtcctgccacacggcagggaggcggcagggccttcagggctggagtgcccttgtgggcccccagacctcaccccttcctcatctgtcacgtgcgagtggaagaaggtgtcacttccagttctaagaaggggaatctccactatgaccagggagggagcagatgagagtttttagtttttagtcatggaagtctagctcccatgactcagtttcccttttggtttcacctcctataaactggggaccatggtccctgctgtgcccatctggtaggaagaccatcataagatgctttgaaggtgaagttgaaggtcaccaa

SEQ ID NO: 152317 - DNA, 527 bp, Homo sapiens
attagaaattaaatgttacctctgttgtgggataagtatcattctaatgatctgttaattgaaaacaaaggaaaaagttgaaaggattaagttaaaatttgtacttgagaaggcctttaggaaatagcttaattattaccacctgcattgaaggaatctaagtagatttttacaaagctcagcaatacaaatataaatacctatccaatttatgactttcaacaaatgtataaagatagctaaatttaaaaatagttcttttcaactggtgaatggataaactatggtatattcaaacaatgaaatattactcagcaataaaaaggaatgaattactgacattcacagagacatagatgaatctcacaagcattcttctaagtaaaagaaaccagacccaaaaaaacttacactatatgattccatttattttgataacgaagttcaatgcgtgactttgaagagtagttggatgaataggtttttgaagtaaatgtggcaacaaaccacccatgctaaaatggaga

SEQ ID NO: 152318 - DNA, 192 bp, Homo sapiens
tttatacacacacacacacacacacacacacacacacacagagtttcactgtgttaaccaactctgctctagaaaaagaaccgatggggttttgatgacgagctgctctcttagttatgggaggtggggactctcttactcatagcatttttttttttttttttttgagacagagttttcctctgttgccca

SEQ ID NO: 152319 - DNA, 129 bp, Homo sapiens
tcgaggataccgacgaggctactaccttatattgagttatcaagtttacttagcctccttcaatcagtcaatgtctgtttcattgtttaaacacccatgatgcttttgaagagtaactttgtctctctg

SEQ ID NO: 152320 - DNA, 299 bp, Homo sapiens
tcccagctacttgggaggctaaggcaggaggactgcttaagtccaggagacagagctgtgtgagctgtgactgcaccactgcaccccatccagcctaagcgacacagtaaggccctgtctcaaaacagacaaacaaaaaacccaaaaagttggccggtcacagtggctcatgcctgtaatcccagctacttgagaggctgaggcaggagaatcgcttgaactcaggaggtggaggttgtagtgggctgatatcgcacctttgcactccagcctgggcaataagagcaaaactccacctc

SEQ ID NO: 152321 - DNA, 1005 bp, Homo sapiens
  misc_feature (1)..(1): n is a, c, g, or t
ncctagggatcatagacggtatttctatgtaaacgaactgtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacagttgtttactcagacccagggagtgactggttgtgcaatggtgagcaaaacgaagcatctgcctttaactcagtgagaggatgacaataaataatcatcaaacacatcattgcaaaataggaagtgaaataaaaagaagagcatgatgaaatagagaataacatggggttgtgtatggatggaataattaaagaaggcaaggggatcctaatgaatgagaagaagacaaaaatcctggaagggaaagagctttcttgcggaaggaagactatatgcaaagacctcaggaaaatgagaaactgaaagatgggccctgtgactagcatgaagtgggtgaaggagaaatgatgtgaaattaaattgaagaagtcagcaggaattagacctcctacagccatgctggccaagatgcagaggccacttcattccttgtgccatgagaagcttaacctaagagagaagtgcccagaggtggtcttgactttctaccaatgatccagatctgaagattattttagtatcacatttctattatttcacagaaattgagtataaattaaattgtaatctttaagaagtatataactatcatatctctcatagatttaagatagctgaataatatgataaatttggacttgcaaaaaaagcatttaatatctcctataaaacaatgccctactaagtgctgaagataaaacttaaatagagtactctaaatcactggtctgtttatgacctcacaagaaaagatctactctttaaatccgctggcaatgcttcgctgtttcatccagttcatttcatgtatg

SEQ ID NO: 152322 - DNA, 305 bp, Homo sapiens
accgtgatggtctgtgctatgtattttaggtaaaatgcttttgtcatttctggtggtgggaggggactgggcctttctcttatttccaatattttgctgttctaaacagcagcacagtgattcccctcatttgcatgtatgtgaaactatcctggtgggtccgcttccagaaactactggatcagggaccatgtgcatttatggccttgaccatactgccagagtaccttccaaggagtttgtgtcatcaatttgcactccccagtggtgttgagagagtgcctgtttcctccacccagcacagt

SEQ ID NO: 152323 - DNA, 449 bp, Homo sapiens
aggccagagccgggggagtgtctgggagaagactgcatgcccggagtccctgttcccatctgaatgggagggaggctggtggcagatcagagacctgggttctgagtcaaacactgaaatccaaggccctgggcctgtcactcaatatctgtggaatttgaccttccccatccataaaatgggcaccaccaacaccagtcgccaaaattacagcaagacacacacgtctaggccaggaagtgcggccactcagaaaatacagctcccccttcctccaagaagctaatttccccagcactgggagtgagaagagcctgtcttttccactgtctgcagcccagcccagggcaccctcatcactggcccctaaagggcagctccagaaaccgctgacaaaggatgccagaaggaactcctttctggccaggtgtcagggtcaacagaaagcc

SEQ ID NO: 152324 - DNA, 256 bp, Homo sapiens
gctttggccccccgtaagaactccagttccctcaaggtggccacataaagagaccttgcagagagtaacaggaacgcctgaggagacccagctgtcccagccccagccaggcaccggacatgaaagtgaagagcctgcaagatgaccctggccactgctggactgcaatcacccaagagatcccagatgagagctgcctagctgagcctggtcaaccctaagatttttgaacaaaataaatgattgttactgcttt

SEQ ID NO: 152325 - DNA, 298 bp, Homo sapiens
ttagcagggcatggtggcaaatgccagtaatcccagctacttaggaggctgaggcaggggaattgcttgaatccaggaggcagaggttgcagtaagctgagatcatgccactgctctccaacctgggagacacagcgagagtcagtctcaaaaaagaaagaaaaagctgcgtggccatattgtaatcagacaaaatagattttaaatcaaaaagattacaagacacaaagactcatttgataaaagtttcaacccaccaaaaagatatagttataaaatataaacacctagcagcaga

SEQ ID NO: 152326 - DNA, 613 bp, Homo sapiens
tatctggaggccctcgttctctgaaggcacggaccttttcagctttttccgggacgtgggcctgaaaatactgtccaatgccaaaatcaagaagccagtagattgcagtcacagatctccagaatacagcactgctatgggtggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggt

SEQ ID NO: 152327 - DNA, 117 bp, Homo sapiens
gggccgcaatttgtcacaacaaatgttgaaaaaggcacggaagctcttccacatccttccaaaactgagctcctagctgtgagaatcaatgcccactacttttcaagaatcaaagca

SEQ ID NO: 152328 - DNA, 305 bp, Homo sapiens
gaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagggtggtgaggctgagcatggggtgcgtggaggctgagcacagggtgcgtggggaggagagcggtgaggatgagcacggggtgcatgggggaggtggccagtgaggggcgcacacaccctgggatggctgcaggcctggacctgctgcccggcaga

SEQ ID NO: 152329 - DNA, 287 bp, Homo sapiens
actgtggtcaccctcatcctctccctgccagccccgccctcccaggcggaccagtgttctccttggcaacgcctggagccaagctggaagctcagcctataagcatctgtcgaatgactggcctctgccaaaagccctgtcacagctctcagggattctgacatcatgacatggtgtcacggggaccaggcctggatgggaaaaggcctcagttcacagaagacagcacaacctcagattgacgggtcgcaccatgaacatagccgcctgaccaggagcgccctctg

SEQ ID NO: 152330 - DNA, 381 bp, Homo sapiens
actctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatataccagcatttacatgtgtgaatacttggttaatttatggattcttaaacctagaaacatgtaatgagcatttccccttgtggttgctgacatttcaaaactattattaatagcatcagcctgt

SEQ ID NO: 152331 - DNA, 310 bp, Homo sapiens
tgttggtcagggtgaaggaaagagaatggagtggatgtcattgttggatgtggtggaggagtcaaatgtgcctccagagtgtttggccccattggctaggcgtgtggtggtagcattcactgagggaaggcccaaggaagaagaaccagattggcggagaagagggtgctgaagaaggttgtagatcatggagagccaatgttacaggcagactgcttggaaatgggaactgtttgagaagaagggagggtgcactctgccaaatgcagcctatggatcaaacaaaagggactgaaaacttaatgacttt

SEQ ID NO: 152332 - DNA, 456 bp, Homo sapiens
gaggacagggcaaaacaggagttcatgccaaatgggttggctaagtatacatatttaacaggttgcaaaaagagctatgaatattcatgaaggaggcttgcatgcacagtaagcaaacatgcacgttacatacatcccatgttcactttggagtggagacttaacatttaaatgtattaaaattaagctctatatgttaaaaggtgaaacggaggacacaggcatcctgtatgagtagcctctataaaccagccagaggaagtccatggtcagtggtcttctaagaaaaaaggaatgctagtcagttattgtgtaaatcagtggtggagcaaatttttccaaagggctggtttccattcaacccttacgaaagaaagtctaaaggcagttatctagggagtgggtataacaggcatgtctgacctcccatcatgtcatggccaggaactcagtttt

SEQ ID NO: 152333 - DNA, 141 bp, Homo sapiens
aagatatcatcaagatcactatagttgtatatattctctatttttatatgtaaatgttaacttagttcaagtattttttgcttgtatcgttaactgatcatcaaatacaatcctaaagatatatcagaagctttattttgg

SEQ ID NO: 152334 - DNA, 289 bp, Homo sapiens
atggtggcattggtggtggtttgttatgcaacaagataaccagaccagaaagggagagaagacaacaacagacaaagcaggtccataaattatgaaacacaaaaagtacatgaaatgccaagtgtcttagatttcagctaccaagacaaaagccctttcaagcagcagaatcctggaaagaaatgatggcaggaactgaagactaatgaaaaaaactgaataagaactaattagtcctctagacctactcctccagaaaacactaccagggaactgtccctcctctatt

SEQ ID NO: 152335 - DNA, 227 bp, Homo sapiens
tacatgtgtaaaaatactttattatttctaaggatattaacaaaataaacatactgaaaatactatcatgttgatttgtgacgctgggaacagaaatagggaatagcattaacaagaatgaaaaatagaattaaaaaggatagtgacttagaactgaaagtgatagtttgccatcatctgaggtgtatgattaatttgattaattcagctgcacttaaaagactttt

SEQ ID NO: 152336 - DNA, 479 bp, Homo sapiens
gggatatgtcccaccttggggctgggggcactgggcagggagtcaagtttgcaggaagcttcgcagagggtgacgcaaaacaggagcgtggtctgcacttggttgggcattaaactccacgttgatgagttagtcaatcccactagcaggcagactgacatgtgggggatgtcagcagcaggggcccagacctgtggacccgaggggcagaggtcagcaccctcctcggtgcagctaacccaggaacttgcctcagtggccaaaattgctctcttgccctcagttctgtaaatggcccatgtccatcagtatctatggttgtgtgcctgtcctgtcttccaacccacatccatgtagggaccctgaagctggaccagtgagtgattgggtgaaggctggctagcccgtaggaggtcaggctcacagaggcagctcatggagatccttggaggggcgcaccttactcctgctggccctgg

SEQ ID NO: 152337 - DNA, 497 bp, Homo sapiens
cactggcttcagacagttttatttaagatgtgtagaataaagaggaggtcaggctgggtagaaccagaagtatctattgccctgttcgcggtcacctgagttatttctaatgttatgttataataaacaccacaataggcttctcttcatagatgcaaatactttttagtattcttggtagaaattcctaatgagctcagctgtctcttcagggcttccctgcccagtctcttaacatttaaacatgtcatttaccttaaaaacataagtgcaaaccaactgataaaaaacaaccttgccttcagtctgcatcctgtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccactt

SEQ ID NO: 152338 - DNA, 569 bp, Homo sapiens
tcattggcttttgttaaccgcacacatcaaatacaaacatttcccacctgctacatggacctctaactgaataaatcccaagcagtcactcctaaatttaccatttacctcagcacacagcttcagtttcacctaatcagaaattagttactctctgtgacatacctatcctccttctcaaagctctactcagtccttggagacagaagtatttgccttggaagaggggagaccactgagaactccctgtgctctctttgattctctcatagcctccctcttcgtatctctcacttcaaaagaagctgaaaatgtttctacttctaacatgaaacaatctatgtactatcatcttagatgtgtaaagaacatgtttttaacatgccattgctcaactctttaaaaagtcatactattattaagaccatgtaacaacatggaaaagtgtccatggttatgttcattgaaaaagaacactgaaggttattatacatattgagtgttaggcttatggggtgatgtcccttcaaatttgtgttcatatgtttatatattaggagtgatggata

SEQ ID NO: 152339 - DNA, 307 bp, Homo sapiens
tcaagtgataccacgggttggagaaataccagtctggtcccaggcctctcattttatcagtaaggaaactgaggtccagaaaggggacacatctcagcccaagtcccacagctctgtactagcaagacctagattaaaatgaacgtttgtagggatagaattttgtccctgtttgtaggtgaactggctgaaatgtagaccaaggagttccctgagtgggctggggcactgttggtccttcgtcacttggtagccgccctaccttctttagcccagtagttaccacagctccaaagaccccatgaag

SEQ ID NO: 152340 - DNA, 192 bp, Homo sapiens
tagttgtatgtactaatacacaccaatgacattttaaaagctatcaaaacaatttatatacatgttatgccagctttaagagttgtatttcactgggccatggaatttgttcccatttaaagtatagcagtgagagatccttctggccactgatcggaaaaactggccctggaattcacggtccttactgat

SEQ ID NO: 152341 - DNA, 157 bp, Homo sapiens
acggtttgaatgtgtcccctcaaaacttcaggtgttgccaatgtgacagtatcaagaggtaacagggcctttaagaggccatgaaggctactccctcatgaatagcagtaaggcccttataaaagaggcttcccacagtgttcagttagcttgatct

SEQ ID NO: 152342 - DNA, 372 bp, Homo sapiens
tccaggttccctcagattctgttcctggcgagaacccacttcctggcttgtagacggctgccctctcactgtgcactcacatggcattccccaggcgcatgtgcacggagtgaaggagcacgagctctctggtgtctcttataaggacactaatcctggccaggcgcagtggctcatgcctgtaatcccagcactttgggagactgaggtgggtggatcacctgaggtcaggaattcaagaccagcctggccaacatggtaaaactccatctctactaaaaatactaaaaaaaaagccagatgtagtggcgcacacctgtgatcccagctactcaggaggctgaggcaggaggatcgctggaacctgggagg

SEQ ID NO: 152343 - DNA, 367 bp, Homo sapiens
tagctattgctgtgtaagaaacaaccatagaatctcagtggaatgtgacgatacgattttatttctcgcgtgtctgctagttgacttatgattggctcttctagactggccttagctaggcagctgtgcttaagctaagggttgcactggacgtcgctactctctacgatctgggttttagtcctctccacctgtatccctgctgggactcagctttcttcttacggtcatagacataagagggtgggtaccattgcccaaacacatttcatatctaatattgtctcattgcctaaaccaagtcacaaggccaatcccgaagtcaggaaatagggagttccgttccccttcttctgggagaaaattc

SEQ ID NO: 152344 - DNA, 321 bp, Homo sapiens
ggcaacagagagacaggagaaggcaatgtacaaccgggaactggcccgaaggaaagaaaggtgggagaaaaccagatatgtgttaggagatggcaaatattccagctggactggaatggagggtcccagtaggtaaaatgtctattgttgggaatgactgtaaagctgaaggaatctttgaagcacaccacagagggaagaccaagaaagggctgtgtgtgtgtgtgtgtgtgtgtattttttttttttgagacggagtctcgttccgtcgcccaggctggagtgcagcggcgcgatctcggctcactgcaacctccacct

SEQ ID NO: 152345 - DNA, 352 bp, Homo sapiens
tggacaaaaagctgatggattttctgttatttccaaaggataactatgataaagaaatgctttttatctttgtagaaatgtactgctgtttttatcttttgttttgggacataagactcttctttatgcaattaggaactaatcatggaggacagagagtactttctattcctctgtgtgatctcagaagtgctccctctttttcttaccaatgacttattattggggaacctgccctgatattcacgtaggttcttttctattttccttaagcgtcggccagcttgagaaataaagggacagagtacaaaagagagaaattttaaagctgggtgtccgggggagacatcac

SEQ ID NO: 152346 - DNA, 578 bp, Homo sapiens
taggagggttaactgagaaaagaagagagaagatccaaataacattaattagaaatgaaatgggagatattacaaccagcaccatagaaatatgaaagatcattcaagagattcaacttcttcctggtttagtcttgggatggtgtatgtgtccaggaatttatccatttcttctggattttctagtttatttgcatagatgtgtttataccattctctgatggtagtctgtatttctgtgggatcagtggtgatatcctgtttgtcattttttattgcgtctatttggttcttctctcttttcttctttattagtcttgtcagcagtctatcaattttggtgatcccttcaaaaaatcagctcctggattcattgattttttgaagggttttttttgtctctatttccttcagttctgctctgatcttagttatttcttgccttctgctagcttttgaatgtgtttgctgtggcttctctggttcttttaactgtgatgttagggtgtcaattttagatctttcctgctttctcttgtgggcatttagtgctataaatttccctctacacactgctt

SEQ ID NO: 152347 - DNA, 329 bp, Homo sapiens
tgtaccctttctgcagaaagtaaaaatagccttgctgaaaaaattaaatttacgttcaagtgctatttctttacagcatcaaagaacaagaatttcaaacagctatattcctgggtattttggtttttttgtagctattataaatggaattaagttcttaatttgatctcagcttggtcattattggtgtatagtagtgctactgatttgtatacattgattttgtaacctgagtctttaccgaattcatttatcaagtctgggagttttttggaggagtctttaggatttttgagatatgagattgtatcatcaccaaatagacatag

SEQ ID NO: 152348 - DNA, 332 bp, Homo sapiens
ctacttagtagttatgtccttgagcatgttatttaacctgagccatctgtaaaatgggactgattatatctgtttaaagcacccagccaaacgctggacacaccatgtatctactcatttctatataaatatgccattatgccacaaatgcctcacataaatgacataaaggaacgtttggcataggggtgtactgagtgtttttgcggggaggggcaaactgcactcaggggctctaggaacttaccttttggtaaggcagaaggtaaattgcagaaccagcatttgaacccaatgttacttagaagttatttcaactcatcagcagagac

SEQ ID NO: 152349 - DNA, 700 bp, Homo sapiens
ttgccagtcatatagaagctcctggtggtttggcaagtgcccagaattccaaccacctgttggaactgttgccaaaatacagtagatttttatttcccagatgttgttcaaccgagagtacaaatcattaatatgactttgtgtctttaaaaaaattcgttctcctattacaaaagtattatgtttcccactagttctgtgaagctgagcagtcacagaggtcttgttcctgcctcttgaaaaaacattaaaacgggtagcaaatgtgctggggatcggtcacctgagatagctttcagagataaacctgtgcgagatagagaagggaaaactatttttcttttctagcaatccaggtagccaagcaagtgattccaccgtgcaggggcacttagcaaatcaggaagcgcgataacagtgaatgactttctactttcaacaatttgaagggctgctaacaactgatggcttcttcttgaggatggcattatcagtagcagcaggacccagacctctgcaccgtttctgcatgttaagtttaaacagtgtatgcctatccttgaggataaacttataacagggccaaggtaaaacttagagaagaaattctagcctgtgatttgaagatctgggagcattcagacatattggaacttaagttttcattctttttctcaggagacaaagctgcaattatgaa

SEQ ID NO: 152350 - DNA, 647 bp, Homo sapiens
atcatctcacatttcccaaattcatcttcataacaatcctcactcccgtatatcgtatgctctgctggatccatagggaggactgcttccaccagaagacacagttgaactaaattccattgaactagaagttaagactgccatccaaccactttgggctccttatgcctctgagtcaacaggccaataggggagttatggtgttggctggggtaattgatccagactaccatggggaaatctgacataaaagaggtaaaaaagaatatgtctggaacacaggagatctcttagggtgtctcagtattaccatgccctgtggttaaagttaatggaaaactacaacccaaaccaggcaagactatgaatggcccagacctttaggaatgaaggtttggtttacctcccctccaccctcaaaccaaccttggccttctaggttaagaagcataaccagctgaggttcttgctgaaggcaaagggaatacaggatgggtagttgaagatggtagttgtaagtatgagctgcagccatgtcatcagttacagaaaagaagactgtaattgccatgaatatttcatccctattttttttaaataatgtgtgtatgtacacatatattaaacaaatatctttgtttcctttc

SEQ ID NO: 152351 - DNA, 419 bp, Homo sapiens
tctctagtcttccaaccctcaacttctacagctctgttcactaatattagcattcatcttgcccactggaatgcaggctccaggaggacagggctttcgggggtcttgtttgctactattaataataccagcacctaaaaatgcttggcatgtagtaaatagccagatctgatgactcaacaaataagaaaaccctggaatcagttaggatattgttgattctaagtaatagaaaactcaattcaacaatatagttggcttaaacgatagagatatgttgaattccctaatgagaaagtctagaggtaactcactccaagtgaggcctgatccagcacttcaacaacatcaccaaagactcgatgtctctcgatctctctactagtccttccaagaaaatggctaaaatcacatcgggg

SEQ ID NO: 152352 - DNA, 750 bp, Homo sapiens
gttagggggagaaaaggcagaggagtattttctgtatatgtccacgtggtggtggaaagtggctttccaagtctgcctacctgcgtgagaattcttcttcatcacttactacctgcacttctctgtacttcagctttcttctctacaaaatggatttaataatagtactcaccatatgaggttgttggatggaatgaatattatatatgtgtaaatgcatagcataggttatggtgcacagaaggtgtgcagtaaccatcaggaagtatttaatattattatttttaaagcaatagttctcaagcctggcaatttttgatcacttaagagcctctttaaaaaaatacagttgctcagaccttgctgaatctcctggatcagaacctcttgggttggggctatggcatctgttatttcttgaaaacatctacaaatggttttgatcctctgtctgttgaaaatcactggcctagaattctattagttattattattcagagaacacaaattgtgccacaggttctcttacacagcctttgtttagagttaagcatgaggaggtctggaaataaaatcaccagggatgtaatttagtttggcaaagatgggagttccgaattcctcgaagccagagaactgagtatggaggccagtgacagaggtgtccaagactgggattaaagcctgaacaatagagccaagggctggagtccaggaaaacgaggctagattaaagttgctgcaagaaac

SEQ ID NO: 152353 - DNA, 390 bp, Homo sapiens
catggaatgttttttagcttctttttgcccacatctattcctttctttcccctataaatatgtctatactacagaccattaggatgcacaatagaaaaggtagtgctggctgggcgtggtggctcacaactgtaatcccagcacttagggaagccaaggcaggcagattacctgaggtcaggggttcgagaccagtcttgccaacatatagtgaagccctgtctctactaaaaaatacaaaaattagctgggtgtggcggcgcacacctgtagtcccagctacttggaaagctgaggcaggagaattgcttgaacccaggagttggaggttgcagtgagccgagatcgcaccactccagtctgggcgacagagtaagactccatcttaaa

SEQ ID NO: 152354 - DNA, 288 bp, Homo sapiens
ttgttctcctgctcactcccactccactacctctcactcacactctcatcttgtgataatttctgccaagaccttgccaaatactagtgtcatgctcttggacttcccagcctgcagaaccatgagccaaataaacctttctttataaattacttagtctgtggcattctgttatgcaacagaaaatggactaagacatgtctataaaacctctgtctcccccagtcttgcccagtacagtaaatggcaccacaattcacccagttgctcaagctgcgggtcttgcgg

SEQ ID NO: 152355 - DNA, 253 bp, Homo sapiens
aacctaacctcccctcaaatcatccaaggataaaaacaactggaaaggaatggccaggaaactattgaaacatttactataggatcttgacctacactcttaactcattgaaaacaggacttggccaacaatggttctatttacgtccaccttttagaaatgtacctgttcaaactagaaatccctgagcattccagttgcattcagttaaaggaggtaatttgttagctatgttgttagtgaccagaactat

SEQ ID NO: 152356 - DNA, 323 bp, Homo sapiens
aagagagaaatagagtggcagctgtggtacagactgacagagcaagaagacacggggctctgatgattggtacctgtgaaatgcggggattcaagggattttattcaattctagaccatggaagagaaaaaacaattgtaagttccaagcaagaaaatagaacatatttggggacattatttaaatagtgaataataattataggtttgcagaaataaaacattctttgatttccaacttttagaattaatcttaaccaaagtatagaagccttaattaaggctacagaacaccgagttgataatagtcagtattgtataaag

SEQ ID NO: 152357 - DNA, 206 bp, Homo sapiens
ctaggatgggttgcagcctgtcaatgttaagaccatccacagccctgctaggtgccatgaagaagatggtgctcttttaactcaactcatcatgaatcaagggagagggagagagtgtgggagccggcagcctgctgttgcttagggttggggaatgcaaagtgtcctgcgacctctatagcagctactgtttcaagccttggcag

SEQ ID NO: 152358 - DNA, 290 bp, Homo sapiens
aagccattctgtaacatagatcatctgtttgatggtttaaaaaaacaaaacaaaacaaaacataaacatgcgacttctccccaaagcagattcataaactgggcctgacagaagctgagtactcccctacagctgctaaaggactcttagacattgtcaggggcctcattctctagaggggtgacagcagtttgaccgatatgttacaagtcagcttacatcacacaatgaaacactttctcttgcctgtaatgctggcccacatcctttgtgcacagtaacagctcctg

SEQ ID NO: 152359 - DNA, 343 bp, Homo sapiens
tgtagatgatgggttgatgggtgcagcaaaccaccatggcacatgtatacctatgtaacaaacctgcacgttctgcacatgtatcccagaacttaaagtataataataaaacaaaagagttgatgtgaaacatgggtaaaaatagcaagatactgtctgtaatacaaagaaaaggatataataagaactgattttgataatcaaaaaaaaaaagaagatgcacacagccctaagcatctacattcaattttaactgaaccattgactcccttccccacctaatgaattcagtacagtaaaagatggaacaccacgtggttaagctttcaaaccccaagacatg

SEQ ID NO: 152360 - DNA, 438 bp, Homo sapiens
cacagctatgggggagagctgagggtatagcaggacagggccatggaggtaggaagagggcgtgccattcgaggacctatctgtagttcagcacggaagtacgcagggtatggagtggcaggaggccagagtggagcccagaaaacagaggccagatgaagaattggtgtgcgctgcatatgaatggggtgggaatgaatgctctagtgggactgggaaaagagaacctgagcctcagggatggtgatgagacagaggctggccactccaattgtggtggcaaggagaatgctgaagagtgaatgcagcctaatttcaaaccctggctccatcatttactgtgtgcccttggacagattccttagtttctgagtttctaatcacttgaatgaggatcataaaagtttcaacggctctggtgaggatgaaaacccatgg

SEQ ID NO: 152361 - DNA, 290 bp, Homo sapiens
cctacagaaccaacaccacctcacggaaagagatttttgagcagagaagtggggctgtagagcacactgcgccctacagtgacacatgaatcaactggatgtgccaaagcttcaacggctgctcccacaggggccaactgcggtcactgtcatctgatttttatccaatcaacaactactctgtacgtacaaagccaaagctccaaaagtctcctgacacccgctcgcactccctccactcccagaccccgtcctgacacccgctcgcgctccctccactcccagacccc

SEQ ID NO: 152362 - DNA, 726 bp, Homo sapiens
cccttccgccgacctggaggtccaggctggccaagtgaacgtgaaactcccggagggcccccttcccgagggagccggcttcaaagggcacctccccaaggtgcagatgcccagtttgaagatgcccaaagtggccctcaagggcccccagatggacgtcaagggccccaagctggacctgaaaggccccaaggcggaggtgatggcccccgacgtggaggtgtctctgcccagcgtggaggtggacgtcgaggctccaggagccaagctggacagtgtgcggctggagggtgacctgtccctggccgacaaggatgtgactgccaaagacagcaagttcaaaatgcccaagttcaagatgccgtcgttcggggtgtctgccccaggcaagtccatcgaggcctcggtggatgtgtctgcgccgaaggtggaggccgaagtgagcctcccctccatgcagggggacctcaagaccacggacctctgcattccgctcccttctgcagacctggtggtccaggctggccaagtggacatgaagctcccggagggccaggtgcccgagggagccggcctcaaagggcacttgcccaaggtggatatgcccagtttcaagatgcccaaagtggacctcaagggcccccagacagatgttaagggcgccaagctggacctgaaaggccccaaggcggaagtgacagcccccgatgtcgaggtgtctctgcc

SEQ ID NO: 152363 - DNA, 264 bp, Homo sapiens
ggaggtgccagaatggaagagggagctgggtgcaagagctgctgctctgaaattgtgcacactgcggaaaggtgccccttccaggtggccacagcctgcactgggcacatggcttaatgacagagctccttcctcagctgggagcccttgtgcaagacacagcctggtcttgtgtttggaggtccaggtctacgttacgttagaacatcctagaaaaccgcagcatggaagatcaggaaggtaatacgtgggacagggtgacat

SEQ ID NO: 152364 - DNA, 425 bp, Homo sapiens
ctgctaacacctcgattttagcacttctgacctccagaattgtaagatggtaaatgtatgttgtttaaagacactaaatcggtgaaaatttcttgcaacagccacaggaaactaatacagtacccgacctgtgttcctcatacctgaccatctctgtattatccaggaagtccaaacaccagctccaggattgcatttctgttttcgtgttttgttttgttttttgttttttgagacggagacttgctctgtcgcccaggctggagtgcagttgcatgatctcagctcactgcaacctctgcctcctgggttcaagtgattctcctgcctcagcctcctaagtagctgggattacaggcatgtaccaccacacccggctaatttttgtatttttagtagagatggggttttgccgtgttggccag

SEQ ID NO: 152365 - DNA, 440 bp, Homo sapiens
ttaggtcaaaagttataaaaatggttttcagagcctcaagtccaggatatggacagggaaaacaaccttgattaggattctgactcaggcatcgccggtgtcattggagcaggagccttctgtctttgagtcctaggtttctctgccatgaaattggagtaattacaatgcacctacctcgccaggttgttgaggactccacaaggcgtagcgtgtgggtctcctagcctagggtgtggcactcaggagtggcacgggcatgaatccagggagtgtcgccagaggagaaaagccaccccaccttcaggccaaggatggtgccaggtgccaggcacccacagatccctcctttttcaggtcttggctcaagggtcaagccctttgggaaggcctctggtcgggaagccgccattacatctctaggcccctggcttggctcc

SEQ ID NO: 152366 - DNA, 387 bp, Homo sapiens
gagacccccctcccaggccagctgatcttctgctctacagaccagagtcacacactgcctgccccgctttcccccacccctgccgctccaggactggaatggcaggcggcatcccggcctctcctgaagcgagcatgcagcccctttgccatttcctagcgaagtggctgctagctagtctcaggaaaccaatactgtgaaagaactgatgtgcaggcagtgcacagccatggggtgatttgaaagtctcgggggcaagggtccccactgtgagttcagcttggccaagggtggcagctacctccctcagccccacttccatcctccgggttctggcactcctgatagtccgccttcctgccttaacccaggccagccgctgctcca

SEQ ID NO: 152367 - DNA, 399 bp, Homo sapiens
tatttttccataagttattcaggtacaggtggtatttggttacatgagtaagttctttacactagtgatttgtgagatattggtgcacccatcacctgagcattatacactgcaccatatttatagtcttttatcccttatccccctcccattcttccccccaagtccccaaagtccattgtatcattcttatgcctttgcgtcctcatagcttagctctcccatataattgagaacatacaatgtttggttttccattcctgagttacttcacttagaataatagtctccagtctcatccaggtcactgggaatttgggttggttccacgattttgtgttgggcatttgggttggttccatgatttgcaattggggatgatgctgctataaacatgca

SEQ ID NO: 152368 - DNA, 655 bp, Homo sapiens
agtgcactgtgatttgctgagagacagagcacttcattctagatacagctatcacctggtgtttgctaaatcactgaaattcttgcaacagctgtttgttcctggggaaacattcacttcatattgcagcaataaactgatcattgccaattaaatgcccattaattgtgtaagcaaggattactgccagatgtttacattagaaagaaaaatatcctttgctatttattttccacttatggccatccctttacatgtagacaattatgtatataagttttttataataagccacaaatttcaattcagaaattaataaaataatctctccataggtttgatctaacagaagataggctaggataaatcatacatgtaattaaaaagaataaatttggacagaatcactttgcaatgtaaaaaatatgctcaacattacatagtgactcaaatgttttggtttgttttatttgctatattctatctttcctagaagttgtccttattttccctttattctatttggaataataagcctatgaaattgtattttttaaagttgaaatagaataaactctctcccatagtctattatggagaagaaaactttaaaaataaagaacccatataaaataaaggaaggtggtgttttgta

SEQ ID NO: 152369 - DNA, 406 bp, Homo sapiens
caatgcccaaggaggtttctcttagggagttgtttctgatagatttggagcaagcaggtgctagttctgtgaagtcaggctgtgattaacaggtggtctgtgccatccacgtgggtataagggtcagtggggcaagtcaagttggtctgtctagcttttccacagtgaggtcgtcaccaggaggcagctgtgtaagtcacatatgtgggttgagcacatgcaggaactgggaggaggtggataactggaaactgttgaggtcaagtgcagctttcttcttcttcttttttttttttttttctgagacagtctctttctgtcgcatgaccccaggagacgaaggttgcagtgagccgagatcacgccactgcactccaacctaggggacagagcgagattccatctc

SEQ ID NO: 152370 - DNA, 818 bp, Homo sapiens
agtaaggtttagcatacttttatttggattaataatatcactagaactgtctattgaattcaaaaaatgtattatctctatctataagctattaaaaataaagatcaagtaccagaaaacctgatggcttgaggaaacaccagagagaaattagcaggtctactgcccaggtaaattgcatgtattatcccagacagatgaggttcagcataatttaaaaggtacacacctccacaaccctagatagtcctcaagtgtttcatttttcattgtttaatcaagggagagaaaaaatgattatggaaatcaaatgaaccttcaaggagaaggagtaagaccttgaaaaaacattttgctgaaatctctttattttggaaattgggaaactaagatgccccacaggcttccatcttttacagcttgcccaagacaagatcacacagacagatgactgaagcaagattagaagctcaataccatcattctagaccaacattctttctctacatgctgcattatgtgtaacttactttccacatactacaaagtaaactattgtctttattctcttttagtttaaatagagaggaagccacctcacaccctgtattgatcagcttgggctgccgtaacaaaataccatagcctgggtggcttaaacaacacatgttaattttctcacagttcaggaagctggaggtctgagatcaggatgtaagcacggtccagatctggtaggggctctctttggggtttgcaggtgactgatatcttgttgtgtcctcacgtggcctttcatctgtgcataatcagagaaa

SEQ ID NO: 152371 - DNA, 517 bp, Homo sapiens
  misc_feature (42)..(42): n is a, c, g, or t
ggggtgcggcgatacgtcaataaagaagtgttggagtggttngtggttccggccgcattcgttctttattttggaaattgggaaactaagatgccccacaggcttccatcttttacagcttgcccaagacaagatcacacagacagatgactgaagcaagattagaagctcaataccatcattctagaccaacattctttctctacatgctgcattatgtgtaacttactttccacatactacaaagtaaactattgtctttattctcttttagtttaaatagagaggaagccacctcacaccctgtattgatcagcttgggctgccgtaacaaaataccatagcctgggtggcttaaacaacacatgttaattttctcacagttcaggaagctggaggtctgagatcaggatgtaagcacggtccagatctggtaggggctctctttggggtttgcaggtgactgatatcttgttgtgtcctcacgtggcctttcatctgtgcataatcagagaaa

SEQ ID NO: 152372 - DNA, 133 bp, Homo sapiens
ccaaccagtcaaagacattctaagcctctacttttgtcatgcccgcttacattccattttccaaagcaggttatgtggccaaatccgaatccccaggccagggaagtactgttttcccagctcttgttcactc

SEQ ID NO: 152373 - DNA, 468 bp, Homo sapiens
tacaggaagcatagtgccagcatgtgcttctggtgagggcttttggaaacttagaataatggcagaaggtggcagaggatccagcctgtcacatggcaagagagggagcaagagagagagggaggaggtcccagactcttttaaacgatcaagtcttgcatgaactcagagtgagaactcactcgttaccgcaaggatagtaccaagccatttgtgagggatctgctcccatggtccaaacacctcccgccaggccccacctcaaaactggggattacatttcaacatgagatttagagaggacagatgtccaaaacgtatcagaggggatcttgttccatttttacgatgctcttgtgaatgacaatcattattcccatttgaaattgacatgcctcgttgcaggaagtagagcaccacgtgccaagttaacagcttcttctgatggtgttaagatttcactaactg

SEQ ID NO: 152374 - DNA, 307 bp, Homo sapiens
aaactataaaaatcatagaggaaaacctaggaaataccgtcctccttggcaaagaatttgtggctaagtccctaaaagcaattgcaacaaaaacaaaaattgacaagtgtgacctaattaaactaaagggcttctgcacagcaaaaatcaactcaagatgggttaaagacttaaatgtaaaacctaaaactataaaatctctagaagatatcagaggaaataccattctagacataggccctggcaaagatttcacaacaaagatgccaaaagcaattgcaacaaaaacaaaaatcggcaaatggaa

SEQ ID NO: 152375 - DNA, 284 bp, Homo sapiens
tcgagtagtaaaaatccccagtgaggcaggtataggcctgactagcacccatctgctcctttccccattcctttgttccttctcattcttctttccacttccttcctcctacttttctttattttatccttctgggagatcattggtggtagcctctctgggcttctctgatccttcaattcccatgacgccatgccatgtatcagtgggcatttaatacagaataataactgtcattgctctggtcataagttgaccctgggtgtgactggatgccaagaatt

SEQ ID NO: 152376 - DNA, 1602 bp, Homo sapiens
  misc_feature (1529)..(1529): n is a, c, g, or t
ggagcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaagttcctggccatggtgttccaggacctgctgaccaacaaggacgactacctgcgggcctcgcgggccctgctgcgggagatcatcaagcagaccaagcacgagatcaacttccaggccttctgcctggggctcatgcaggagcgcaaggagccgcagtacctggagatggagttcaaggagcgcttcgtggtgcacatcaccgacgtcctggccgtgtccatgatgctgggcatcacagcgcaggtgaaggaggccggcatcgcctgggacaaaggagaaaagaggaacctggaagtgctccgctcattccagaaccagattgccgccatccagcgggatgccgtctggtggctccacactgtggtcccctccatcagcaagctcgcccctaaggactacgtgcactgcctgcacaaggtgctgttcacagagcagccggagacctactacaagtgggacaactggccacccgagagtgaccgcaacttcttcctgcgtctgtgctccgaggtgcccattttggaggacacgctgatgcgcatcctggtcatcgggctgtcccgggagctcccgctcgggcctgcggacgccatggagcttgctgaccacctggtgaagcgggcggctgccgtgcaggcggaatgatgtggaggtgctgaaggtggggaggacccagctgatcgacgccgttctgaatctgtgcacctaccatcaccctgaaaacatccagctcccaccggggttaccagcctccgaaccttcgccattttttacccttttattggaaggcttgggccctcctgcttggtcgttcgccgcattcaacccagagaacatcggcctggctgcgtgggaggagtacccgaccctgaagatgctcatggagatggtgatgaccaacaactactcctacccaccgtgcaccntgacggatgaggagacccggacggagatgctgaaccgtgagctgcagaccgcccagcgggagaagcaggagat

SEQ ID NO: 152377 - DNA, 730 bp, Homo sapiens
ggagcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaagatgaactgcaacacgcacggttccgaagacatggacgtcatctcacacctgatcaagatccgcctcaagcccaaggtcctcctcaaccacttcatgctgtgcatcaggtgcgtggcgagccggggca

SEQ ID NO: 152378 - DNA, 211 bp, Homo sapiens
gagagagagagtgggcccacatgaagggaatgagaggtcattaatggtccttaaagcagcatagtgatgcaaatcagatttgttttaaagggctctctttagttttggtgcggaaaataaattggagggaacagaagggaaggcagtaaagtcaggagactgtgtagtaacctagatgatgaatgattgtctcctttaatgactagagtgg

SEQ ID NO: 152379 - DNA, 334 bp, Homo sapiens
ctgcctcaacctcccaaagtgttaggattacaggtgtgaaccaccacgcctagtgcagactgcctaaccttcatagtcttgtcccaaactggttccatttcttccaactatttctcttccataaatcatcccctactagactgcgccctagacatccaagaccgtggcttactggcctgtgtataccagtgtctagctcttaactgttttgtttagtcgtgcatcaggcactttcgtgtgtgtgtttccctcactagaatttcagctgcatgagagtggcgacctggcgtgttttgttcattgctgtgaccctacagcctggcacacagtagtc

SEQ ID NO: 152380 - DNA, 1005 bp, Homo sapiens
aggcatgagtcaccgtgcctggcgtgatagttaagtatttttaaatctattcatttagtgcaccacatgcacagaataaagaagaaaaagtatgtgttcacctaaatagattttttaaagttaacaaaattttcaaccgacttaggttaaaaatgcaaactagggatagaaatgtaatcaggtgacagaaaccacacagtaatttgaacaggaaagttcaatacaaagaattactatttcaggggattagagtaatgagggcttggctagtgaaaagtaaagagaactctaaagaagaactctaaagcgtgcaggatagcatttttaaggtacagccactattccctggactcagatagaacacctaaaaaagagctcctggccctcatacctacgcacaccacggctgagatcaagacctttttggagaaggcacagacatggctcgccgcgtggcagagaagtcaccaaggttccatgctggccaaactcgctggaaacccaccttctgaatgttgggggaagccatccacggggaggcgctgtgtcttagaactcaccacaaagctgcctttacagagtgccaggggaaactggtcaccagaggagcctaactgacagcactccactgtaaagtcagctgagaggactgactgccgggttcggctgaccctctgcacaatgaggagacagatgctacagaagtcacctatgttgcaggagtcaggcacagggaaagctatgaaagcctgtgttgtaggagtcaggcatttaggaagtggtacccgcagtggcctggccagaggagcacaccaagtcaggatgagaagcacccttcccatgcagcgtccttccacaccccacgatgacaaggcttaccatcttgccagctgacaaaggagaaatgtttaccagatccatccccatgatcacaaagcaggtattgaagggtggattggaactgaaagatgataagttggagctgaaaaagttactccctgcata

SEQ ID NO: 152381 - DNA, 344 bp, Homo sapiens
cacttcctaaatgcctgactcctacaacacaggctttcatagctttccctgtgcctgactcctgcaacatagggaaagctatgaaagcctgtgttgtaggagtcaggcatttaggaagtggtacccgcagtggcctggccagaggagcacaccaagtcaggatgagaagcacccttcccatgcagcgtccttccacaccccacgatgacaaggcttaccatcttgccagctgacaaaggagaaatgtttaccagatccatccccatgatcacaaagcaggtattgaagggtggattggaactgaaagatgataagttggagctgaaaaagttactccctgcata

SEQ ID NO: 152382 - DNA, 333 bp, Homo sapiens
tttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttgga

SEQ ID NO: 152383 - DNA, 287 bp, Homo sapiens
atctcagtgcctggtacagggctcaatacataatgggtgctctgataatctattaaataaattgtctgtgttgaattatctcaaccttaaaggcaatactaagaagaagtgtgtgtgtgtgtgtgtgtgtgtttaacagagaatatggccagtgcgtgagttctttctccttctctctctctctttttttttttaaataactcttcggggaagtaggtttataagccttggccagggggtaactggtgtgaaatacccacgactaaatgtgctgagagggtaccgag

SEQ ID NO: 152384 - DNA, 331 bp, Homo sapiens
cttctaaaaattacctaacttacccttattaatcagtgttatcatttagtacatgttctatcaacagaaatagcagaattcaatctttgtgatgcaaaaaaaccaacttaataatgttcctgaatatattgccaattactaaattagtttttaaaaatccgaaagtattttaccattgattggtttcacccctcataaattgttggtattatacggctttctgaaggtgaaaagaatactctcctcagaaatatttatattgacagaattagctatttaataaatatttgtcacattatattgctttttgcgattcatcatcacatattgg

SEQ ID NO: 152385 - DNA, 485 bp, Homo sapiens
gtaatgagttcttgatagtcagtaaatcacagcatacatgcaaggaacaaaggagaaaatgaaatcatttacttggagatgagagaagtcaactttatcagtgaattcattctattttattttattttacattgtattttattttatttattttattttgacagagtctcgttccgtcaacccaggctggagtgcagtggcatgatctcggctcactgcaacttccgcctcccaggttcaagggatcctcatgccaaggcctcctgagtagctgaggcagaagaatctcttgaacctaggagacagaggttgcagtgagccgagattgcaccactgcattccagcctgggtgacagagcaagactctgtctcaaaaaaataaaaataaaaattagtcagattatgggcaagattactgtgccaaagtagaaatgactcttctcagtgctaccaaattaattctagtcagaatcagagtggggaga

SEQ ID NO: 152386 - DNA, 227 bp, Homo sapiens
tttgatctagattctaggggacttttaatttatcctagagatcatcactttggtctctggctgtgttcatttggttatatggaattttccattaaatttgatttggcaaacatatctctaagaattgtattttattctttgttccctttttgtatcagcctcatcatgttttaaacatgcagtttaaatatcctatgttttttttctcctaaggtcacatctccttg

SEQ ID NO: 152387 - DNA, 395 bp, Homo sapiens
gcacgcactcactgcacgaggctatagattatgcaacccctatgactccgagcttccatctgtaggatcaccctcagattatgaccttgaatcctactttactgagaaaactgaagcaattaaaagagatttccaaaatccaccacaaagtaatgttatacatttcaacaatgtgccatttcagcctaaactgaagactgatttcattacaactctgaaacacaagaaattaaatgcaatctggtattagctacacttttaaactaagatatttttggaatgagaaattaggaacatatctggcacatgaaacaaactcctgcctagctacatcatttgcttctcaatcaatgaaataaaagcactacaaaatatgccttttagcttaaaaaggg

SEQ ID NO: 152388 - DNA, 487 bp, Homo sapiens
gacatttttataacattgacttcctaatggggaagtttaaccaggtcttgtgcattcttcagaaatacattgcattttcttcataaagatctttaactttgttgtaaaatttattctaaggtccttataactttgtcacaaatctgagtggaattttaaaactccatttctttttcttactgttaattacttaatgaattaattcttactgttaattactgatatttttcaaaagctgttgatttcctaatatgaataactagcttgctaaactcttatcctaatagttcgtatttaatttcttaggtgtgtaggcgtaaacaagtaaaattttcttcttttctaataagtatattgtttctttgatttttatcttattctattattttatatccctaaaacaatattgaataataatgctaataccaggcaatatgtctttttcttgaatttagggggagaccttagtattctttcatcctttatg

SEQ ID NO: 152389 - DNA, 833 bp, Homo sapiens
gcacactaatatgcttgttgttcttatccgttttgtatattcatagaattcaattatttattgagcacctgccttttgcgacatgctacatgctattgtgtgtattcagaatacatcagaaaacaaaacaaaaattcctgtcctgtgaagcctacattttagcgtgtatgggacagaataaaaaataagccctgacgcagccaggcacagtaatcccagcactttgggaggccaaggtgggcggatcacctgaggtcaggagttcgaaaccagcctggccaatgtagcgaaaccccgtccctactaaaaatacaaaaattagccaggcgcagtggcacacacctgtaatcccagctattctggaggctgaggcaggagaatcagttgaacctgggagacagttgcagtgagccgagattgtgccactgcgctccagcatgggcaacagagcaagactccatctcaaaaaaaataataaggcgagttgcagtagcccacgccagtaattccagtgctttgggaggctgaggcaggaagattgcttgaggccaggagtttgagaccagcctgggtgagacaccatctctacaaaaaataaaaataataaacattatcacgaattatattagaaaatgttaagaaccatgtgaggatagggaaaatgatgggagattaagagggagtgcagttgcaaaatgatagagtggtcattatgggcttcattgaaaaggagttgcagatttgacttttcctttgtgaaatgagaagaatcagaaaatttctctcctcatcttttatgcaggggaaggatttgaagctgatgtaacaccatt

SEQ ID NO: 152390 - DNA, 336 bp, Homo sapiens
atccaagttatatatccaaaatatcttgtagacatgtaataaacattttaaagattattaataaatattttacattctcttttttcatactaagccttctaaatccagtttactcttgtagcacatctcaagtcagactaaccacatttcaagttccagcaaccagttcctagtggtcatggtggacagcacagtccttacagcttttttgtataacgtaatgtcttaagtattttatcagtgccctttaaaactttttagcatcatttttaatggctacgtagtatttcatcatttagatttactataacaatatattgaggtagttgtgttttt

SEQ ID NO: 152391 - DNA, 110 bp, Homo sapiens
ggatttatctatagtagctagccaataaactggatattggacaaaagtacaatttatacaggacagaagacaggaagtaataccaagttgcataaacatgtgtgaagtgg

SEQ ID NO: 152392 - DNA, 334 bp, Homo sapiens
caacctcccaagaatgaatcaggaagaaactaaaaccttgggcaaataacaagttctgaaattgaatcagtaattgtaaaaaaagaaaacctaccaaccaaaaaaagccatggaccagatagattcagagctaaattctatcagatggataaaaaagaaagagctggcaccaatcttactattacaaaaaaaaaaaaaaaaaaatcaaggaggagagactcctccctaaatcatgctacaaagccagcatcaccttgataacaaaatctgtcaaagacacagtgaaaaaagaaaactacaggccaatatccctgatgaacatagaagcaaaaat

SEQ ID NO: 152393 - DNA, 297 bp, Homo sapiens
tataagcattgtgtctcaaactgtagaatgatgtttcatttatttggctttttctaggaaaaagaaatgaaatatttttcctaagaagtgaaaagaacccataagagctccagtttgcaaaatgctagtctttttattgatccctttttttttttttttttgacatggagtgagtctctctctgtcgcccaggctggagtgcagtggcgtgatgtcggctcattgcaacctccgcctcccaggttcaaagaatcgcctgaacccagaagccagaggttgcagtgagccgtgatcccg

SEQ ID NO: 152394 - DNA, 487 bp, Homo sapiens
ggaatcgagctcggcccatgttcagataggcacaaacttctactatgttcagcctttgtcttacttcttctgaaagctcctaggtagtaggcattttgcatgatggacattgctcttggcagaactcactcttgcctcattttgcaacagcatctgtagctgagagcccagagaagaaaaaattcatgaaactttttgttttctgagagatataacagaggaaaacagacgtaaaaattgattctacaaaggttgtctaccagaaggggattcctagagcatagattatctttccttgttgtgagaaatttccatttgaatgctgaaggtggaagctcattctgatataaaacttaaaatgttagtacaagaagcccactcacgttgacatatattattccctatcatttgtgttactactttaacattattttaaaataaacctctcatttggtatgtggaaaagatacgacctctatctcatgtt

SEQ ID NO: 152395 - DNA, 157 bp, Homo sapiens
gtgccaagtttgtaccagtttctgaatcgtcctctgcacacactgctcagctgactgccttcctgcatgatgagcacagcaccaggggctgcagatgtcacagaaaaggtttgaatcaacatctaaagtcacctcagtgtggagcagaaattgagaa

SEQ ID NO: 152396 - DNA, 182 bp, Homo sapiens
ttgtttcatatacagtttgtttgttggttgttttaggcagcaaggtaatcgggccactatcttgtctggaagcgtaatacttgagctacttcttatgaaaaagaaaggctgactcagggttaaaacaagagcacagaggacagagaaaagagccacagaatcttctcaagaagcaggacaga

SEQ ID NO: 152397 - DNA, 263 bp, Homo sapiens
ggttcagaggatcccgaaaatgacatagagacaggatctggccatattgcccaggctggtctcagactcctgagatcaagcgatctacctgccttggcctcccagaatgctgggattacaggcgtgagccactgtgcccagcaagtagaggcatttttaaagttttaggtggagccttggcaagagatttctcttgtactggggtgacaaatattcatgcatttattcaagtatttactgagtacctgctctttgcaagtcat

SEQ ID NO: 152398 - DNA, 308 bp, Homo sapiens
  misc_feature (290)..(290): n is a, c, g, or t
atggggtggggggctgggggtggggcccggaggggagtggtgtgcttttcattttcatgtcctcaggagtcttgttgttgttgttgacctaggcaaatgagcttgtgtggtttccttgttagagtgcagggctggggtgtgagggctgaaggtggctcacatggagcccagttcctgccaggctccccaactcctagccacgtgatctttgctaagtccatgtacctctctgcatgtcacttcttcatgcactaggccgcaagttcctaaagtcaggactgcactgaatntgccttgatttctctaga

SEQ ID NO: 152399 - DNA, 380 bp, Homo sapiens
gcctcctgagtagctgggaccacaggcgcacactaccgtgcctggctaatttttcattttttgtagagacggtgtctctctatgttgcccagactggtcttgaactcctgggctcaagtgttgctcctgcctcagcctcccaaaatgttgagattacaagtgtgagccaacacgcccagcctttttttcttaagactatagattttcattggttgagaggacttggtaattttaacatggaacttctgaactgaccattttataagatatcgaacatatgatcagattcatattttaccctcattaatcaaaaaatagtaggaacttttttttttttgagagacctagtcttgctctgttgccctggctagagtgcagtg

SEQ ID NO: 152400 - DNA, 395 bp, Homo sapiens
atttatggcctagttcagatgctatcttctcctgaaaatgtctgattcccacaaagagaatcaattggtttccctcttccaaatgtcttggtttgaggttgcaaagcagcacttaccctatgctaccctgtaactgtaatagctgtttccacctttatgcccccaccaaggaagggctcactctttcttctgagcacgccctaccttcctcagagtgtgctgtgcttcataaaaatgtgttgaatggaatgaaagaaaagaacatgtttttctattaaagtcattttaaacatgctaatcagcaaggaatatggctgtgagcatttctcctcatcctcctagaatcatacaaaaacaaacaacgaagaaaataaaggaaacaccataaattccat

SEQ ID NO: 152401 - DNA, 209 bp, Homo sapiens
  misc_feature (168)..(168): n is a, c, g, or t
agtcgctgataaacgtcacgttcccatagacgtgctgcgggaaggccttgtcagcggattggctccctccgggtccagggactccggctgaagcgatctgcgacgtgcgcacgtggtacgggaagttcttgttggccgctgatgggcgggtcatgattcagaaacacngccatggcgcgtacaacgtggatccccagtctggtatgcca

SEQ ID NO: 152402 - DNA, 340 bp, Homo sapiens
acagaaagtacttagaacaggaccttccacatagaaagcactatgcaattattattattctacagcaaagaaatatatatttgaacactgacttagattacagctcagaggattgggttttactgctgttggattgtgagcagggctttgctctacattccaggtctcttgaaatctgacttgcaaaattaattcaaactggccttaggaatgaatatccccatggggcttaaaagagataaaaaattgtaaacaaagggcaaagagacaggacatttgtcagaatggcatttagtagcagggccactgttctttaacattagtgaggtggacaagaggt

SEQ ID NO: 152403 - DNA, 195 bp, Homo sapiens
tgccatgcacacaagtccctagacttccaggtttcagaccacacccagtcccttgacgttcagttcatgcccacccccggaggcctaagctgctttgaagcagaacagcctcaagataccaaagacgccgttcaggaggattgcctcatctctgaatcacttttaccctttcaacttcacccccaaacattccac

SEQ ID NO: 152404 - DNA, 332 bp, Homo sapiens
aagtgaataggcttggggcaaatagtggaggtggagcctacaggcctcgctgataagctggacatggaattctggatgcagaaaagacgaatgatttctagttttgggagtgagcaacctgggagctaccagtggtagatttactgagctacaaaaacagggttttttgatttggaggagaggtgaagggatactggtttgagctctgttttgcgtgtatcaggtttgaaatgcctccagcagacatcctagaaaagtcatgggggagattgggattatcaatctggagctcagggcagcgggcagaaaggatgcagatttgggagttgaac

SEQ ID NO: 152405 - DNA, 487 bp, Homo sapiens
cgtttatatggaacagcatcataatgtttatacagaacaaatgtttaaagacaatgttattttgacaagaaatatgttttagttatcagactgtaccatgaaactgctgaagttgctgccccgaataacagactatgctggcttttatatgggagaaaggcttactatgcattgtataatgtttaatattacctaaaatattgttattattcacgtacatgcattacttttcaatttgaaaaacaaaactagtgaagagcatatcgcaatgtgggcagaataatgatacacaaatctggaccatatctttacattcaaaataatataaagaattaaggtaattcatttttaatcaggtattctcaaatgactatttctatctgtatgtataagaaataaaaaaaaccatttcaaccccagataattcttaataattcttataagaaatcaaaaaaaataccatttctaccccagataattcttaaat

SEQ ID NO: 152406 - DNA, 505 bp, Homo sapiens
agggccggccaagccggtttgctagatttccctagagaggagagtggctagaggtatgtggcatatccacaccatggaacactactcagggaccagaagggaccagctacccgtgtacccagcaatgccgtaaatgcattatgctgtgtgaagccagattcagaggctgtggactgtaggattccatttatgtgacattgtacaaatggaaaaccatatacagaagacagatcagtggttgctggggtcaggacaagagacaaggatgaacaaacgggcttcaaaaacttttaggggttacaggattgttctaactcctggggtcaagcaatcctcctgccttagcctcccaagtagctggggctacaggcacacatcaccacacccggctaattttttttttaagagacggggtcttgctatgttgcccaggctggtcttgaactcctgaactcaagccgtgtccattctcccaaacagttgccccctcttggggggtacagca

SEQ ID NO: 152407 - DNA, 368 bp, Homo sapiens
gaagctgatgatctggatgagcatttatctgtacaatttgggttttgggaaaagtcactctactcctaagagatgaaatatatgggaaatccttagcaggtaatttatttattattaacttattgtagttgtattccctctaataaaactacaattttctactatattcctacctatggattggaatctattaggagaaaatcttctgtttgtagaacaagccagtgcaagtcagctcttggatctgtttctctgcctggacaccacaatgaaatggtaattgtccacatttgcaattgtccagcagtagccaggtcattgagaagttttgtgggcaggtggcctgattgatgtgcacaggaagctga

SEQ ID NO: 152408 - DNA, 315 bp, Homo sapiens
aattaaaactgtgccattggaacctagaatagtgtctggcgtataagaggacctcaagaaccagttatcaaatgtgtagtctatctccattacaaagtaagctctttaagggtaggggctttcttgatgccaaaggtcctggcacctagaacaatgtatgacacatggaagatgctcaacaagtacctgctaagcatttgtgaatatcttatagacatcacaaactgcatttcccaggtttatctaacatttccggccggaacacttgttgattactttggaaggcttttgaacaattgtggtattccggccaca

SEQ ID NO: 152409 - DNA, 460 bp, Homo sapiens
gcacagtggctcacgcctgtaatcccagcactttgggaggccaaggtggacagatcacctgaggtcaggagtttgagaccagcctggccaatatagtgaaacctcgcctctactaaaaatacaaaaataagccaggcatggtggcacacacctgtaatcccagctactcgggaggctgaggcaagagaattgcttgaacctggaaagtggaggttgcagtgagccaagatcacactactgcactccagcctaggtggcagagtgagaccccatctcaaaacaaaacaaaaaccagatgcaatttctttcatattctctcctacctctgtccctccaccagtattagcattattctgtacacagcacacatgcattttcttcttagatttctttccatggcaatacaataaatctgcttcagtcttttttaacctgctgaatattttcctggccccatggg

SEQ ID NO: 152410 - DNA, 841 bp, Homo sapiens
agttttgctcttgttgcccaggctggagtgcaatggcgcaatctcggctcactgcaacttccgcctcccgggttcaagcgactctcctgcttcagcctcccaaagtgctgggattacatgtgtgagccaccgagcccagccaacctttatcatttttaaaaaggtcccttagagccttaggctccactttcttcctcagctgccacatccaaaccatgggtaagcgatgcttgatctgcctccaagttcaagcagtccaggaaacagcccacttatgttcactgtccagtccccattcttggtccaggccaccatggatggctcctggactgtagcaacagcttccatgtgtgtctgccttgactgagtccctggcgtcctcaggcttcctgccacactgcagttggaggcttcttctaaaatccagtgctttctgggcaatttaaaacctgtgactttccaagtaggatctagtccccatgtccttaacaagaagaggtaacgtatttccctatgccactgcccacttatttttttattgttgagatgggatcgtgctttgtcacctaggctgggtggagtggtgtgatcacagctcactgctgccctgaattcctgggctgaagggatcctcttgcttcagcctcctgagtagctgggactacaggcaagagccaccacttatttttgaattttttgtggaaacaaggtctccctatgttgcccaggctggtcttgaactcctgggctcagcgatcctcccacctcaggcccctgtgctgggattatagcctcctgtgctgggattacaggcctaagccactgcaccaggcttttattt

SEQ ID NO: 152411 - DNA, 301 bp, Homo sapiens
aattgacacaattttatctatcatggtgaaaacaaaagtaatcagatatgaactactttatatgcctaccaaaaatgcatcaacctatgaccatccttattcatgatcttccattccttctttttacagtgtaagaaccatcctagatataattttagctcaattccttctctgctgccatacagcacagcctccttcaattatccccattatcaatattttaattcctctttactgagttattctcatatggaatacaacatacggtaaaatttcctatatgaacaatgtcctttcatac

SEQ ID NO: 152412 - DNA, 139 bp, Homo sapiens
ctgaatacaataaaaagcagagcggggcagctcttccctcacacacagggaggaggcatggacccacaggaccaccagcacctccggggccacgcgccctcgccagccacacccgggacaaattgggacatcactgaag

SEQ ID NO: 152413 - DNA, 286 bp, Homo sapiens
agtgggcccgggggacggcgcttagcatacggaggacccggcactggtctctgagttccctcagtatttactgatcactatctctactatctcggtgagggggatgtggcaggactataggataatggtggggagagggtcagcaggaaaacatgtgagcaaaggtctctgtgtcgtaaataagtttaaggaaaggttctatgcctcgatgtgcacataggccagatttatgtttgactttacacaaacatctcagtgcagtaaagagcagtattgcctccagcat

SEQ ID NO: 152414 - DNA, 326 bp, Homo sapiens
caaattgagttataatattttgcatgtttcttacctactaatccctctgtagttttttaatattttaactttcattttagtttagtttcagaggtatatgttcaggtttggtatataggtaaacttatgactcaggggtttgatgtacagattattttgtcacctggatactaagcatagtatccaaatttatttttctaaacctcttcctccttccaccctcctccctcaagtaggccccagtgtttgttgttcccctctttctgtccatgtgttctcattatttagctcccatttataagtgagaacatgcagtatttggtttt

SEQ ID NO: 152415 - DNA, 209 bp, Homo sapiens
cagggagagaggggaaggacccagggggcagcagcccaagcagggaaaacccataagctacgtaggtcaaaaacaaaccacccgagaccaaacaggaaggtaaggagacctgcagagattagaatacctgttactgccctacctgggggcttgagtccaaagcgcaaagacaatttcacaggtgacttcctctttcccctcctccccag

SEQ ID NO: 152416 - DNA, 173 bp, Homo sapiens
ccaaatacagatgctagctctgaagtgtgtgctcctaaccatcacattaggccacctctcttgaagccattactctttacaaagaagtattctagggattatatagagcatctccatctaaaaaagtttttgttcaagtgttacatgtataaagctacacaagatacaggtgt

SEQ ID NO: 152417 - DNA, 188 bp, Homo sapiens
tgagccactgtgttgagcctggaacctgaattttaataaggcttccctctcatgatccttacgcatatgatcccaggacaagatgttgaagaacagaccttgggataacatgcagtctcattaatttactgtaattctcacaatttggcatcagccttcttttctgtgctcattttctacattttttt

SEQ ID NO: 152418 - DNA, 324 bp, Homo sapiens
atgaggactagatttccagcagttcattcccaccctttccaccactcagttctgcatttgcaaatgtccacatgtatttctagaaagatccacatggtcctcacctgccctctgcagaaggagaggaaacttaaagaacccaggacagggaacatgcttctgctccaaagccaccagctcttgcctgtccccttcactctttctagatcattccttgcactctgctctatctttagaggtcactggttcaagtaagtcatcatgaaacacctgcaaaaaaactgccccacctggtgcctctagtgcctgatgactgaactgacc

SEQ ID NO: 152419 - DNA, 382 bp, Homo sapiens
tatgtggtggccacgcctccatggaatcatgtacaaacaggccaatcaagccccacattgactcagtctggaccttcgagaaggtggctgatgccatgaaacagatgcaggagcagacggtccaggtatgacggcataactggacctatctaacttcatttctcattcattaaataacccctagttgaaaaatgaatactctaccatgaccattctaatttccttccaatagctctttatggaagcattttccaaaaatcctctactccactgttcctcacagccacattagctcttcacattagctcagccaatgagcaacaataacaaagatcaaagctgaatagcatcagagcatcaaacagttttcatgaaaataaag

SEQ ID NO: 152420 - DNA, 140 bp, Homo sapiens
ccttccttctgattgattaactgattgattttgagacactttctttctgttgcctaagctggagtatagtggcacgatcatggaccactgcagcttcaacctcccacctcaaccccctgaagtagctggggctacaggtg

SEQ ID NO: 152421 - DNA, 321 bp, Homo sapiens
actggaaaactctaccaagcatttaaggaagaaatggtagcagttctctacaaattcttttagaaaataagcagagggaatacttcctaattaattcaaagtattaccctaataccaaaaccagacaaagatactacaaataaaggaaaactgcagaccagtatatatcatgaatataaatgcaaaaatccttgacaaaatattagcaaatcaaatctaacaatgtacaaaaagaattacacaccatgatcaagtgggatttactccaggaatgcaaggctggctcaacaacttaaagtcaataaatgtaatccatcataa

SEQ ID NO: 152422 - DNA, 263 bp, Homo sapiens
ctacccgtattttggggtttgtgtggtgtgatgagtagagattaaataatggaactaacttggttatagatagttctggggactaggagattaaagacaataacagatgtggggaaaaattacttttgtagaaatattcaagagaaattatttcagagaaataaatgtatgtttcatgtttagttcaatgttattttcaaaggattatgtacaagagaacccccactgtattttttccggagtgatgatgttcctgataattt

SEQ ID NO: 152423 - DNA, 220 bp, Homo sapiens
cataggctatttcaccattgtgtgagcctgctgcttctgaaagatgcaaagagtacatgttaagatcaaagaagcccttggttaccagccagttgcctcacttttgttgggaagtgattttattcatcagtggcactaagtggaatatcacactggcacacagggggcttgtacatgacaggtggaatagcctacagttgaggggcttggaggtgctcct

SEQ ID NO: 152424 - DNA, 316 bp, Homo sapiens
tgctgggattacaggcgtgagccaccgtgcccagcccattgtcactttttactgagcacctgctatctaccagggagtgtcaaatgcgtaaaaatgctatcagtatgccttccaacaactctatagagtgggcattatcacccatattaacagggaaggaaaatgagggttttttccttttttgtttgtttgtttggttttggttttggttactgagacagggtcatactctgtctcccaggctggagtacagtggcacccctcatagctcactgcagcctcaacctcccaggctcaagtaatccccccaagtagc

SEQ ID NO: 152425 - DNA, 163 bp, Homo sapiens
agcctttaatgatctagggcagccattctctctgaaggctgagggagcctggaggggcaggagaggcaaggcaggtccctgtggtcagagagcgccttctggatacagccacggtttgctttcattatgcaaggcacagaggaatgtgatgctagacacagca

SEQ ID NO: 152426 - DNA, 583 bp, Homo sapiens
  misc_feature (395)..(395): n is a, c, g, or t
  misc_feature (424)..(424): n is a, c, g, or t
  misc_feature (508)..(508): n is a, c, g, or t
  misc_feature (522)..(522): n is a, c, g, or t
caaacaggaatcctgcagctgaagaatttaatgtataaaatataaggtacaatagagagcatcaatagcaaacttactcaagcaaagaaagataaagagttgtttggaattaccagtgagagaagaataaataagaatgacaaggagtgaagaaagcctaccagacttattagataacatcaagggaaaaaaatttcatatttttagagttccagaaggcaaagagatgacaaaaggcatagaaaatatatttaacaggtcgggtgcggtggctcacacctgcaatcctagcactctgggattacaggcgcgagccagtgtgcccggccaggacattattttacacagaggcaaaactccaagtagtacaaacttagctcaatttggacaaattngtaagatcagataaatatgtccagagatntggagggcataccccctcctttcattacaaatctcagattttagtcccttttatttaaaccagattagcaaaactgagaaagtnatcagaacgcgggnggtatcctgagaaccagcaacaccattcatgcgttggatatgcgcatcaggtttcttcccc

SEQ ID NO: 152427 - DNA, 503 bp, Homo sapiens
tccagggccaggagtcttgtgtgtgggggccttcattctcccagagacttagaccctgcacgctgttggccccatatctgggttcccagaggaggagtgagttggccgaagtcacacagtcaggagggatctgggatctgaatccaggcgtgcttggccccatggcctgtgtgcatcccttcagccagggtttaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccg

SEQ ID NO: 152428 - DNA, 736 bp, Homo sapiens
actttaaagggtgagggaaaattgaaatagaagttgggcaaatatagatttgccctttacccagcaataacgtacgtaaagtgggagtgaatagtcttgagtgagtctctcctattcagagagtgagctgggcagagaaaagttggttgaagaagaacagggtggtagtctagggggactgaagatggaggtccaagaaaaaagtgtgtagcgatgagtttaaatcatttttgtgtgatcccaatgtaattttatgaattgcaggggaaaacaatgaattaattttaaggtcaatatgttttagttcaagatattgaaaaagctttctaattactttttatttcatagttttttttctaatagaagcattctattacaaaaaggaaggtggtaatcttttttcaccttttaggacagcctcctaatgtttgtgatgtatttaaatcttttgtgtattttcaatctatgttaagtccccttgttacatattccagttatacttattccagttgtaatttactttgtaattatttattgtctatctctcttcccagaatgtaagttctgtgagggtcaggggtctctttccgcttctccactgtatccccagtgcctggcttagtgccttctatatagtagattgccaatgtttgtttgttgattgaatgaatgaatcttaggattggtactttaaaaaatgctaagaatacaattaaataaatcaagaagtttaagt

SEQ ID NO: 152429 - DNA, 269 bp, Homo sapiens
gagccaccgcacccggccgtgagtctcctatattatattttaactgtgttaaagtttcaaacacaatatatatgtggacaagtcatgtttttcttactaattgattgaaactaaattatacagcaaacctttcttttaaatgagcaaaagaaagaaaattatctttatattctataaataacattaaagattgttttggattttattatatatcttttaaaaatagagacagggtctcactatattgaccagtctggtctcaaactcct

SEQ ID NO: 152430 - DNA, 313 bp, Homo sapiens
gagaaaacacagaaaaagaggagaatagaacaagcagccagcaatccttgctgcatccaagttcacaaaaagtaacctaaagataactgatactcctgcgggcagctgggttaagaccgtggagaattgtagtaataaagatgattttggatcagacccaagttcatatggggcttaaagagaaatattcaccggagatactaccagaagcctggggacacctgaggaaagaacaggagtggacagttacttccagtcataaatccttgagtgtttccaggctaaggaaaaagaccgcctgcctgcctgcctg

SEQ ID NO: 152431 - DNA, 434 bp, Homo sapiens
aacacatcttaatccttccctacctcatatcctctgggccttatgcccataggggaaatatatagaaatattcttttacgaatacactgggttttttttttctattttagatacattctttatattgtactgaaattgattatagtcagcctactactaacataaacacgtgagaatgtaaaacataaatcaaaaggaaaagtcagaaaagacaggaagacagaactttaccagaaatccatgttaagagggtgacagtatttgagcattaaatttagctatgacctttctggagggcaaagttctcatgactttctgtttttcaaagtatttatcccttggcagtataatcatttgttactgtagtatctttactcagggagggtgcaaggatggttcatttctgaatcttcccccagcaatccccacatttt

SEQ ID NO: 152432 - DNA, 260 bp, Homo sapiens
aaatggatgtgggtgtagaggaaggggtgcaataggcatggggctggcaggcctgcacggccgtcatattccctgggcacattacctcatctgcatgcctgagtgtcatagccctgggtcgggactgaaggtcggtgcatgctgagccaaacagtaatctcctggggtgggtatgagcatccagggataaactgggaaggagtggaaggtactcagagggcatcggaagatgtctgggacctgaccttgttccctgacct

SEQ ID NO: 152433 - DNA, 133 bp, Homo sapiens
tgctggaattatagggttaagccactgcacctggccaggagattatattttaagatatattaaggcatctagcatggtgtctggtttttcttctttgggtatcattacctaaaagtttcctgacctctcttta

SEQ ID NO: 152434 - DNA, 125 bp, Homo sapiens
tgtaaggacaatggcaggggcaacacagagctcccaggtctggctgcccctctctcagtgctctgactgggattccaaagcaggacgctgctcactctcacagcaaacatcaccaagtgtgggtt

SEQ ID NO: 152435 - DNA, 120 bp, Homo sapiens
gcccatgagagatcctccagtccctcctccccagctcctgaaagatccggccttaggttctaggtactgagatcctacaagtctgtgcagaggagagtcccggtaccgactcacaatgaa

SEQ ID NO: 152436 - DNA, 532 bp, Homo sapiens
ctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaatta

SEQ ID NO: 152437 - DNA, 292 bp, Homo sapiens
actgtgccactgtactccagctaatgatgaaggttcaaattatataagctatttaattacctaactcaatagttacacttatttcattaaaacaaacaaaatcacttcaataaatggtgatgtttcaagcgctcttttcacttaaagagtcaaaagagattgactcataatttcttaggcaactagttttatggtggcaaagtagtgagtataacaataattctaccagcagacagacaccctgggccaccttccctggttgcagatcccataaatgtatgactagttctga

SEQ ID NO: 152438 - DNA, 3080 bp, Homo sapiens
  misc_feature (12)..(12): n is a, c, g, or t
gctgcaaaggtngatcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataataaaaattcagaggaaagaacaacctatgactgggttttgttctgctgtgtccagatcatcctctggaagtcttgattgttgcctttctgctgctgtgctgtacgtgcaagttcctaaagccagggacatcccggagatgagctgtggatatagagtccgcacagcctgcgggagacagaatgtaattccttccaacacacacacacaggctttatggaatgccagaaaagcttcctcttggatgctgcctggagtaatgactttttgaccctcccctcttttttggagcaagcactatctttccttgtaaagaaatttggacaatttgagtagaaatggtgtggtatgtgcacatagaaactctcagaaaactgtcagatgagctagacagttgtcctctatctccatgggtcccgcatcccaaggatcgaaccaacaacagatcaaaaatacgtgaaaaaggaattgcatctgtattgaatgtgtacggactttttttcttgtctttgttccttaaacaatgtagtgtaacaactatttacatcgcatctcctttgcattcattattataagtaaactagagatgatttaaagtgtatagaaaggctgcgtgcagtggctaatgtctgtaatcccagcactttgagaggccgaggcaggtggatcacctgaggtcaggagttcgagaccagcctggccaacgtggtgaaaccccatctctactaaaaatacaataattagctgggcatggtggtgcacgcctgtaatcccagctattcgggaggctgaggcaggagaatcgcttgaacccaggaggcagagattgcagtgaaccgagattgcaccattgcactccagcctgggtgacagagtgaacctccgtctcaaaaacaaaataaataaataagaataaatt

SEQ ID NO: 152439 - DNA, 5689 bp, Homo sapiens
agagatattcatagtgcgcccgttgtaattcaggcggggcagtgttcatttgagttaggttctgcgtatatcaattaaccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagagggggcttccagagtcaatgaacgtcacccttcagccgacggataccgggagcgcttgggcaaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcacgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgctgctactttaagagctgagaaaaacattccaatgagatatccatagctaacttgcttgctcagaaaaacataagtaacaaagttgagctttcatttttaaaaattatattttactttagaaaaatatcaccttttttcttcctcttccttacgtgtagatctttttttttttttcaaatggggtcagtacctgaaagcccgaaaccccataccaagcttatagttaggacctttgcatttgataaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgaccccccacggccccatgctaggtgcaccgtcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcatctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagct

SEQ ID NO: 152440 - DNA, 4063 bp, Homo sapiens
ggctattcgattggtcacccacgcgtcgcaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagagggggcttccagagtcaatgaacgtcacccttcagccgacggataccgggagcgcttgggcaaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcacgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgctgctactttaagagctgagaaaaacattccaatgagatatccatagctaacttgcttgctcagaaaaacataagtaacaaagttgagctttcatttttaaaaattatattttactttagaaaaatatcaccttttttcttcctcttccttacgtgtagatctttttttttttttcaaatggggtcagtacctgaaagcccgaaaccccataccaagcttatagttaggacctttgcatttgataaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgaccccccacggccccatgctaggtgcaccgtcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcatctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagct

SEQ ID NO: 152441 - DNA, 4931 bp, Homo sapiens
  misc_feature (12)..(12): n is a, c, g, or t
gctgcaaaggtngatcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagagggggcttccagagtcaatgaacgtcacccttcagccgacggataccgggagcgcttgggcaaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcacgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacatgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagct

SEQ ID NO: 152442 - DNA, 2379 bp, Homo sapiens
  misc_feature (2144)..(2144): n is a, c, g, or t
  misc_feature (2175)..(2175): n is a, c, g, or t
  misc_feature (2187)..(2187): n is a, c, g, or t
  misc_feature (2194)..(2194): n is a, c, g, or t
  misc_feature (2227)..(2228): n is a, c, g, or t
  misc_feature (2231)..(2231): n is a, c, g, or t
  misc_feature (2233)..(2233): n is a, c, g, or t
tggccttcttagaacgtgttcgctttgcgtttgccttctgcgtgattgtaagtttcccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataataaaaattcagaggaaagaacaacctatgactgggttttgttctgctgtgtccagatcatcctctggaagtcttgattgttgcctttctgctgctgtgctgtacgtgcaagttcctaaagccagggacatcccggagatgagctgtggatatagagtccgcacagcctgcgggagacagaatgtaattccttccaacacacacacacaggctttatggaatgccagaaaagcttcctcttggatgctgcctggagtaatgactttttgaccctcccctcttttttggagcaagcactatctttccttgtaaagaaatttggacaatttgagtagaaatggtgtggtatgtgcacatagaaactctcagaaaactgtcagatgagctagacagttgtcctctatctccatgggtcccgcatcccaaggatcgaaccaacaacagatcaaaaatacgtgaaaaaggaattgcatctgtattgaatgtgtacggactttttttcttgtctttgttccttaaacaatgtagtgtaacaactatttacatcgcatctcctttgcattcattattataagtaaactagagatgatttaaagtgtaaaaanaaaaaaaaaaaaaaaaaaaaaaaaaaaaaanaaaaaaaaaaanaaaaaanaaaaaaaaaaaaaaaaaaaaaaaaaaaaaacannaananaaaaaaaaaaaaagaaaaaaaacaaaaaaaaaaaaccaacaaaacacgaaaaagaagaggagggaggggcgggacgacgaaaaaaaaacgagagaggagacaggaagaaaaaagagcaagagagaacaaaaaagcagacacagaag

SEQ ID NO: 152443 - DNA, 2014 bp, Homo sapiens
tggccttcttagaacgtgttcgctttgcgtttgccttctgcgtgattgtaagtttcccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctggagtctggcatcctgattcaggaactgacccagcagtccgtggcagttgctggtcga

SEQ ID NO: 152444 - DNA, 615 bp, Homo sapiens
aggctgcagtgagctatattgcaccacccaatagatgggtggcagaggcacattctgaccctcattgagtttagaagacatttgttttagagatccggagcatgcatccttccagcctctgctatcataaacataaaatggtgctaccaaaataaaaatgtctggtgtgacaggcaggctttgtttttgttttcatttttttcagttcgtggcttcagaagggaagaacagattttttcaaatgtcatgaaatttccttttgccagcatcctggaactataataaaaattcagaggaaagaacaacctatgactgggttttgttctgctgtgtccagatcatcctctggaagtcttgattgttgcctttctgctgctgtgctgtacgtgcaagttcctaaagccagggacatcccggagatgagctgtggatatagagtccgcacagcctgcgggagacagaatgtaattccttccaacacacacacacaggctttatggaatgccagaaaagcttcctcttggatgctgcctggagtaatgactttttgaccctcccctcttttttggagcaagcactatctttccttgtaaagaaatttggacaatttgagta

SEQ ID NO: 152445 - DNA, 2919 bp, Homo sapiens
tggccttcttagaacgtgttcgctttgcgtttgccttctgcgtgattgtaagtttcccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaa

SEQ ID NO: 152446 - DNA, 6290 bp, Homo sapiens
  misc_feature (12)..(12): n is a, c, g, or t
gctgcaaaggtngatcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagagggggcttccagagtcaatgaacgtcacccttcagccgacggataccgggagcgcttgggcaaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcacgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgctgctactttaagagctgagaaaaacattccaatgagatatccatagctaacttgcttgctcagaaaaacataagtaacaaagttgagctttcatttttaaaaattatattttactttagaaaaatatcaccttttttcttcctcttccttacgtgtagatctttttttttttttcaaatggggtcagtacctgaaagcccgaaaccccataccaagcttatagttaggacctttgcatttgataaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgaccccccacggccccatgctaggtgcaccgtcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcatctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagct

SEQ ID NO: 152447 - DNA, 6402 bp, Homo sapiens
  misc_feature (12)..(12): n is a, c, g, or t
gctgcaaaggtngatcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcaggacattggtttctccctcgctgtccaaaattgggttcccaagggctatttggatatttcatgtgtaaccttacaggtgcacgtgtaactggaaagggaaggcaaaggccaagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagagggggcttccagagtcaatgaacgtcacccttcagccgacggataccgggagcgcttgggcaaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcacgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgctgctactttaagagctgagaaaaacattccaatgagatatccatagctaacttgcttgctcagaaaaacataagtaacaaagttgagctttcatttttaaaaattatattttactttagaaaaatatcaccttttttcttcctcttccttacgtgtagatctttttttttttttcaaatggggtcagtacctgaaagcccgaaaccccataccaagcttatagttaggacctttgcatttgataaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgaccccccacggccccatgctaggtgcaccgtcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcatctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagct

SEQ ID NO: 152448 - DNA, 3782 bp, Homo sapiens
  misc_feature (12)..(12): n is a, c, g, or t
  misc_feature (3547)..(3547): n is a, c, g, or t
  misc_feature (3578)..(3578): n is a, c, g, or t
  misc_feature (3590)..(3590): n is a, c, g, or t
  misc_feature (3597)..(3597): n is a, c, g, or t
  misc_feature (3630)..(3631): n is a, c, g, or t
  misc_feature (3634)..(3634): n is a, c, g, or t
  misc_feature (3636)..(3636): n is a, c, g, or t
gctgcaaaggtngatcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccagggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaataaaaaaaaanaaaaaaaaaaaaaaaaaaaaaaaaaaaaaanaaaaaaaaaaanaaaaaanaaaaaaaaaaaaaaaaaaaaaaaaaaaaaacannaananaaaaaaaaaaaaagaaaaaaaacaaaaaaaaaaaaccaacaaaacacgaaaaagaagaggagggaggggcgggacgacgaaaaaaaaacgagagaggagacaggaagaaaaaagagcaagagagaacaaaaaagcagacacagaag

SEQ ID NO: 152449 - DNA, 2086 bp, Homo sapiens
tggccttcttagaacgtgttcgctttgcgtttgccttctgcgtgattgtaagtttcccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtaagttctaccttccgctgcagcatctgggcaaggaccaggtaggtactgcatccccctctgttcttcagatggatgtccagtgatccaagggccaccttacagacgctcagtgagtatcgtcagtggttaagggaagcgcactgcgctcctggacttatgcatccgactccctgctttatgacaagtgccgtgtgaccttgggcacatgccttgggagttgtttcccttgtaaaatggagataggaacactctcttggcctcacagagctaatataaaatggatcaaatgaaactggttatgaagttgttttttaaatgctgaagtgctttagaaatccgctatgtaggctgggcgcggtggctcatgcctgtaatcccagcactttgggaggccgaggcaggtggatcaccggaggtcaggagttcaagaccagcttggccaacatggtgaaaccccatctctactaaagttacaaaaaaattagcccggcatagtggtgggc

SEQ ID NO: 152450 - DNA, 207 bp, Homo sapiens
gtataaaatatattaaatatcaagaattctgtccctaaactcaccaattccaaaacttgaaaaatgcctttttacaatagaggaatttttttaaatcttgcaaatgttgattttcaattgaaaatattcagaccttatacaaataattatttctaccttgagaatatttaaaatatgaccatgccggccaagcacagtggctcacac

SEQ ID NO: 152451 - DNA, 384 bp, Homo sapiens
agaacccactgaaactgtaccctttaaaatggtgaattttatgttatgtgaatcacatctcaattagaagaatcgtaaccagaaaaataaaattgacttctaaaaaaatatgtcattcagtaaattgtttccttcagtctcagaaatcctgacttgcgctcaaactggcagaatttctctctggatgaggtctctgccttccaacaagccttatgcctctattgggccaatgttcaattttctgtttataagacatgttgaggccatgacaaagcaggtgtgtttaaggccagggcaaactgagcctgaacgctgatttgccacttaatagctttgtggcctgcagcaagctgtgtgaatgctctgcacagtgtcctcacgtat

SEQ ID NO: 152452 - DNA, 589 bp, Homo sapiens
tcatttcttggtcattctggaagcagcatggtggtgaaatgggagagttccctgaacccctttgcctgatgtttgacaggggtgtggcttgtctgtttggtcaccatcccttcaaccccttacgggatggggagcaggcagctggacaagtgcaggagcccaagtgggcgtgtgttacagtgtgcccttttagccttgctgtccacggatggcttgagtgttggccagctcagtggaccctctgcctttctgtaagggcagagtgccagtgtgacagctctctgtatcccaaactcttgtccagcatcctgggagaagcgggtcacacatgtacttgaatgtaaagaagtgactttggcttgtttttgactcaaatctagcatgaagcttggtttcttcgaagacacaaacactttaaacatgagagatattcaataaagatgagtcatctttccctggatctttatagtttgtcctccataaacatcaccttatttgtatatgaagctttattatctgcactaaattcactacagattgtttccatttttctctctttaagacctgagattatcctcaagtacaatta

SEQ ID NO: 152453 - DNA, 352 bp, Homo sapiens
aatgaaagggtgtgggccattagaggaaataagtgccttgcccctggaggcctcaattagatgtcagacatcatttcctgggagggctgatcagcagattcctatatctaaggagaaagttgggggagatcaccttagagttctttacaactctaaagtttctttggttctatctatgatgtagggctgagtgatccatctcagatgagctactccttcttaggccccatttttcaaataaggaaactgagatgtttgaaaattaacaaaaaggtcacagagcatgttagttgtggaggtgagacagaagaaactcagatcttctccagccctgctagtttcactccctctc

SEQ ID NO: 152454 - DNA, 521 bp, Homo sapiens
tgtcgtcaaggttctgatgaggaaaaatttctaaaatagttgggaaaaaatacagattgagcatcccaaatcgaaaagtgctccaaaatttaaaacatgacactcaaaggaaatactcactggaacatttcagatttctaggtccaggatgcccaaccagtataatgcaaatacaggtattccaaaatctgaaaaaaactgaaatccaaaatacctctggttccaagcatttcagataagggatactcaacgtgtatccccaaaatacactcttatcagcatagaaggatgcacatactttttttgaattaaaaaaaagtgaaagtacagctgggtgcagtggctcacacctgtaatcccagcactttgggagactgaggcaggcagatcacctgaggtcaggagttcgagcccagtgtgaccaacatggagaaaccccatctctactaaaaacacaaaattagccaggcgtggtggcgcatgcctgtaatcccagctactcgggaggctgaggcaggaga

SEQ ID NO: 152455 - DNA, 410 bp, Homo sapiens
tcttttccacactgttttccatagcagctatactagtttacattcccaccagcagtgtagaaatgttccttgatcactgcatccacagcaacatctactgttttttgagtttttttattatggcaattcttgcaggagtaaggtggtatcgcattgtggttttgtctgtttgtgctctttcagactttttgaggtaggcatttagggctatgaactttcctcttagcactgccttagctgtatcccagaggttttgataggctgtgtcattattgtcattcagtctgaagaattttttaaatttccatcttgatttcgtttttgacccagtgctcattcaggagcatggtttttttgttttttttgtttgtttgtttttttccgaaactccatctcaaaaaaaagaaaaa

SEQ ID NO: 152456 - DNA, 699 bp, Homo sapiens
ggaggacaagcagctctgctcaagatagataaagccaccctcttcatactgagcaaaataaacctgttattactggtattattgggtgtctcatgtctcagatacccaggaacttgtaagttaaaaaaagtaaaagtgattctcatatgacaccttagttgaaaatcattgcccttgtgaatttatagcatttgatcaaatgtttcccgggaataacaaccactgcataaagttatatactcgcaggttactctgagacataaattaggagattgtcataagaactcatatatcttaacatacacgactgtgtcagaagaatgtgttgtataggaacagcagattttcttcaaagaccagaatgattagacacactggtcaaacatattgaagaattaagtgtttatcatatgggtcttggatgtaaaaacagagcttcagaatcctgattatactatcagtatactccatcggattcatttttgtattacttactttgttgtcttctgttatcaaaacatgttgcaattggggtgatctaaagaataaaatcaatgacatctattcctacagtgtttttacttttaaaattcttgctctttttgacttcataaaacttcatggataatcaccatggctatcttatagagcagagaattgaaatagaaaatcacactattttttaagctgataggatgt

SEQ ID NO: 152457 - DNA, 844 bp, Homo sapiens
  misc_feature (83)..(83): n is a, c, g, or t
tttgtgtgttgcccactgcctgaaggaagtaacaatgtggattctgctgatccggaggaggatgactcggatgtctggtgggncggagcagacacagactatgcagatgggagtgaagacaaagtagtagaagtataaagcgttgagctcaacgctttatacttccaagatagataaagccaccctcttcatactgagcaaaataaacctgttattactggtattattgggtgtctcatgtctcagatacccaggaacttgtaagttaaaaaaagtaaaagtgattctcatatgacaccttagttgaaaatcattgcccttgtgaatttatagcatttgatcaaatgtttcccgggaataacaaccactgcataaagttatatactcgcaggttactctgagacataaattaggagattgtcataagaactcatatatcttaacatacacgactgtgtcagaagaatgtgttgtataggaacagcagattttcttcaaagaccagaatgattagacacactggtcaaacatattgaagaattaagtgtttatcatatgggtcttggatgtaaaaacagagcttcagaatcctgattatactatcagtatactccatcggattcatttttgtattacttactttgttgtcttctgttatcaaaacatgttgcaattggggtgatctaaagaataaaatcaatgacatctattcctacagtgtttttacttttaaaattcttgctctttttgacttcataaaacttcatggataatcaccatggctatcttatagagcagagaattgaaatagaaaatcacactattttttaagctgataggatgt

SEQ ID NO: 152458 - DNA, 644 bp, Homo sapiens
caagcaattctgcctcagcctctcaagtatctgggactacaggcacccgccaccacgcccagcaaatttttttgtatttttagtagagatggggtttcactatgttggccaggctggtctcgaactcctgaccttgtgatccacctgccttggcctcccaaagtgctgggattacaggcgtgagccaccgcgcctggccaggatttttatttttaaattatgaatgggtgctgaattttgtcagataccctctctcctttttggtatttacagagaatgccaacccatggtataattctggacagcagttctttcccctgtgtatgttaggacctgggccgtggcttcagttattgcccctcagtagatgctctgtgatgtctagctctgggtgagaatggctgaatccaaagccgctggtgacaaagtggggtgaattgaaatgaaccagctcccactgaggccaactggaggtagaaaggaagaaaaatgcctaagacaaggggaacgtgcaaagggacaaaacatagaggggtgagggtacagtgtgcccaaatgtctttattgatatctaacaccttttcaaaaaggattcgaggtcgtcggtggacatggtggggtggggagtgctttccaagtcagta

SEQ ID NO: 152459 - DNA, 583 bp, Homo sapiens
catgtttgttcttcagagggatcactcaatcagctgcaaggaagatgaatttgaaggggtaaaatcagaggcagttatccagttcagaaagctcctcactcacaattacagagaaagataaacaaggcctgagaaccgaggcattgctaagacaagagaggcgcttacctgaggaaattaaaaggtaggattttaatgctgttttacagtatcttaatgatgtgctagtaaaccttacctatgaatacaaataaatggagaagtaaacaggaaatggatagaatacagtccttacaattcttcagtgtagaggccactttatttcaataaaccccattgaaactctatgcgtgcctgtgtgtgtgtaacagacgcagttcatttaagagttatttgtgttgctgtccagctaaggagtgtttattccctagggatcaaagtacccaaatctggcaaactccaaagcagtgagaaggatgaggactgcttggtgctcaggtgctcatcttggagcctcattcttttttttttatgggggggcccctcaaaatccacccggagggtttgaaccttgggcttggcc

SEQ ID NO: 152460 - DNA, 300 bp, Homo sapiens
ccacatcagcctcctgagtagccaggactacaggcatgctcctccatacctggccagtattccttttacctaagctaacacttgaaccctccttattgtttacctgggacactgaactttttgtgtcatctcccttcctctctggctgttccttctcaggctgctttactggttcctccggcctccctgaactctgaacagtccagggccccacgctcagtcctttgtcctctcctctgcagtgtctacgcttgctcgctaggtgagcccctcctgtctcatgtctccctgatgatgacc

SEQ ID NO: 152461 - DNA, 420 bp, Homo sapiens
ccaatgatgaaaaattataagaattcctttttaagtcatgtcaagaaaaaaagtacctcattactgcttctatttgatacttccctggaagtcctctcaaggcaataagaaaatgaaaggaaataaaaggtataaaggctagaaatgaataaacaaaaacagtatgatttgtagacaatatggctgaacacatagaatactccaagaaatccacagattgttagaattaagaaattcagcaaggttggtgaatacaaagtcaatattttttaaatgcccattcttagttagcaacaaaacctaattagaaatatatcttttaagaatagagattgctttgataaaatttattcgtgtaggtatttcatttgatatctgtcattttaaatatattggtatgaataaatttaattcgactgt

SEQ ID NO: 152462 - DNA, 332 bp, Homo sapiens
gtctggggcacagtaggtctttaataagtgtgtttttatttttgaggtgaaggtatgcaaacttccacgctgaatgagcatggaaatagacctgaaagcaggaaacattcccgagaaatagtggggcttggcacagaagcaagggatggacaagacagcctcctagtcatcctccttcatgaaagctctgtcctctctctaagtgactcttatttcatacctcccaagatgcttcagagaatcttccgagttctggcctatgaaccagcattccatttggcccagccagcctcccctcaatgctccccaaccccacggtgcgttggcccaag

SEQ ID NO: 152463 - DNA, 138 bp, Homo sapiens
ataccaaaccatcagccagcactttcggccgtcctcaccatcccaggtgaggacagatcatggggtagcacagagacttttccgataggagaatcttaatgaagcgagcatgaaacagaatgtgctatgcgccaaatt

SEQ ID NO: 152464 - DNA, 196 bp, Homo sapiens
tgcgctccatccgtgcccacagacgccaacctggaaacctgtgtgtccaagggcagctgctgccactcactgcagccaggcccactctgacatggagggagccactgaagaactgagaaacactcaactcgcccgaggtcctgagagggccgatgcctcatctgagaccacggagtcagacggtgacctgaccctg

SEQ ID NO: 152465 - DNA, 348 bp, Homo sapiens
tgacactagaggatcccctaacggtgcgtatgcaggaggctagagacacggcacagcggcgcagctcgcctcgctatgtcctttaggttgtttgagggacattcatcaaggaaaccggagaaacttaaaatgctcttccgcttctttggaacagtcacagagaaaagtgaactcctttcattcttgcagtaatttttcttgctgatgggaacagttcaagtcaagtgacatgtgaggaacattttgtgtttaacgtaaaccttcctgtcccaactacattgaaacagtaatgatgcgacaagttctttgtagaaatacagtacaacattgctcttggtctgcagtatg

SEQ ID NO: 152466 - DNA, 265 bp, Homo sapiens
gtaagtaaaagctaaagttattacaatgatagaagaaaatatagaagaaaaatcttcggggcagaaacatttctacaggatagaaaaattttaaaaatggatgaactggaattcatcaaaattaagtatcactcatgttccttgaaagacactattaagaaaatacaaagatgagccacaggcaaggaagaaaattctgataacacatgtatctgacaaagaacttatatccataatataaaaggaattctcatcactaaacaag

SEQ ID NO: 152467 - DNA, 192 bp, Homo sapiens
ttattatcctgcaacaatatattcagaacatattattagtaaagagcataaccccttctttgatttgaaaagtcaccgcaaaccttgtcagacacatgaacttgtgctgtgtgtcagggccccagctaccctgcaggaagtggaggggtggccccaggccttcaggccagccaggcaggagtctcttctcct

SEQ ID NO: 152468 - DNA, 560 bp, Homo sapiens
cacaaaagtaaccatgtctgcaatttccgcagtagtttctggtttctctctgcccttcctctctgggaacccagctgtcaggcctggggtctatccgtcggaattaggtagaagaatctccaccaagattctgaatgtttccaacacatttcagcagcagttccctcaccacactagttattctctcgattctcttttcccaaaccctcaattcataagttgtaccagtttgtttgaagctcatgttaagcactttttcccactcttgggggacccataagaattgtaacataaacaagaaccatcttttctctcccttgtgccacacccaccaaagcaaatggcctgggtcacgtcctgcacaccccaggaaattcatgtctgggagatgctgggggggagaggcgccagggaggcagagaacattattatgtctgattcatttacactgcaatctgtcagccaccatgctgtcaaggctgggctgaagccaagaaattgaatttagagggtgatttttcttagaacaggaagttccatttggctaagagagaacaaac

SEQ ID NO: 152469 - DNA, 449 bp, Homo sapiens
ccagaactgaaggaggagaatttttagactgaaagggttcactgagtgtccaacacagtggatgaaagtcagctcacaccaagatatctcactgtggaacttcaaacactgggacaattcaagatcctaaaagctttcagagagaaaaaaatcaggtcacacagaaatgatcaggactcagaatagctccagacttctcaccaatagcactggaaacctaaaagaccatggtgcaatgccctcagggatttaaggaaaattatttctgacctagaattctatatccagcaaaactacctttaatcaagtgtagggccgaataaggctattttcagacgtgtgagattttagaaagctcatttccttcatggtttctttctcaagaagctactggagatgatgttctaccaaaatgaggtgggtagaccatgaaaaggaagacgcggtat

SEQ ID NO: 152470 - DNA, 494 bp, Homo sapiens
tttagttcatcaggaaagaaagggcagtgttcagaatggtagagaaaatatctacagtttataaaggaaaacagaaactgctttcccaatgtagcaaatcctcatcattaaaaaatcactcactccagaaggaaaggtccatggtagaatactgtttttacctatcctttttcacttcgtcacccagaagttacctattaataatggcagagtctcagttgagaaaaattcaaaaaattgggcagaatttttaaaattttctctcctatcctttcagctgtctgcccagaatttgaccgtaattggaagcaagttctatgtttacagcaatttatctttctacatcacctgtttctaggtgataaatatgccattttaaaattagtgtggcatttgtgcagttaattatatgcattagaaatcactgcaacaggaatgtaattttcaccccacacatacgaaagcagaaatcttccctaaacacacaactccca

SEQ ID NO: 152471 - DNA, 350 bp, Homo sapiens
agcaggtatattgcgggtgtgtggctgggatgagggggactagctgggggatgaggctgccgaggtggctgaaagtatgggatggaattagagcttcagaccttggccgtcatcctgggccagcacagtgctgcgaggagccactgtgtgttgacacttgagcaggcctcagggaagagagctctaaaccaatggtcattgtccccactggcctggagcaattgggactggttcctgagctctctgatgctgctccgcagggaacaggtgctatgtgtttgagccaatgtgcccaggcccctcgtctcagtctacgctggctgccatcacaaaacaccaggtggcttaca

SEQ ID NO: 152472 - DNA, 134 bp, Homo sapiens
gactctgcctcaaaaaaataaaaataaaaaaggacattcctatttcagatatgttataaaaaatatgcatctagaattgatgaaccatgatagcatgttaacttttcagtgatattttatactgatggtggggg

SEQ ID NO: 152473 - DNA, 527 bp, Homo sapiens
atagctgttccagatgtagacctggtaattcgtcgagttctgtttctctggagaaccctgactaatacatcacctctaccacctccacaccctgtcatcacgacaaacaagaaaacacaacttgtgcatatgaaaaccttatccctgtggtctccttgacaggaacaaggctacctctcaagagtcagtgaagtttttgttcatatgcacaagtctactcaatttaacacatacagttattcaatgatctctgggggcagctggccccactgagccatgagtccaggtggtgttaaggctcactggtttcgtggagactggtccttctaggaacagcttgagaagttgagctttggacagggattcaaatgtaatgcagaacttcaccacttcagctgtggggctatgtggttcttcagagcaagcacatctccttctgtgagtatcttcaaggacaaatcaacactcatccccactgtcctggccaggaaaacatgactgcaaggagtgaccacacaggctctgag

SEQ ID NO: 152474 - DNA, 357 bp, Homo sapiens
agaatcacttgaacctgggaggtgaaggttgcagtgagctgagaccgcgccactgcactccagcctgggcgacagagcaagactctggaaaaaaaaagaaaagaaagaaagaaatataccttattagtaataataatgtatagtgacagttcggctgtagtatcagtgtaattagacttacatcttacgatttgatattttcccctggttcactcagtctttttctgttttctacaggacgttgacagtagtgataggaaaagcccgacagggcaagacacagaaatagaagatatgccagaccccagttctcttgcttacacacccctcgctgctccacacctgcctcgcccttgg

SEQ ID NO: 152475 - DNA, 456 bp, Homo sapiens
atatttttagtagaaacagggtttctctatgttggtcaggctggtgccaatgctgcctggcatcctcacaggaattttctgttgatcaactgttcctctttttcacccataggattaacaatgtgtcttcgtactagggtgcaataagcttttcttgcatttaatgttactatcccctgaacaagtttctatattggtacttatagctgtactttatttattttaaatgcctcagttttatcattgagccataatttatttaagcggttcttgtacatatatattggtgtgcgcttgtgcaagtacacctgtaaggatatatttccagcagtggaatttctaggtcaatgtgtatgatcttttttattttgataaacggacacattgcctatcaaggaaacatctgaggttctatgacagtggatacagtttatcattgaagttctcagaatcctc

SEQ ID NO: 152476 - DNA, 132 bp, Homo sapiens
gtgtgcgtgtatgtgtgtgagagaggcccagggcacaaagcctgggtgcgtcatggttgctgggagagtttgacgagtctgactcagtggggacatgcggcaggaaaggaagggagagcgcagtggcatttg

SEQ ID NO: 152477 - DNA, 380 bp, Homo sapiens
cacagtaagagagtaacaacagtagtaataaagtaggccataaccacatgccagcatcactacttttgtgctttgggattactagcactgtgataccaaaacagtcaatctgaaataactagcgggtggaaagcacacacagcgtggagatgttggacaaagggatgatttcatgtcccaggcgggacgtgagatttcctcctaatactcataaccgcacgcaattgaaaacttatgaattgtttatttctggaattttccacttaagattttcagaccaccaggcacggtggctcacgcctgtaattccagcactttgggaggccgaggcgggcggatcacaaggtcaggagatcgagaccatcctggctaacatggtg

SEQ ID NO: 152478 - DNA, 335 bp, Homo sapiens
cctctcagcaagcaagtttcctcaacttaaaacaatttaccttttgtcctatcatccacccaagtgatgttctaactttcttcccctaacaatagacttttaaaacaatagtctacatttgctgtgtccagtttctcaatcgtcattccctccttagccacttatccgacttctgcccctgccattgtatttgaaacggaaattgccctattcccattccttcctaattttcaaatgcatcgctctttgtagccctaagtatttgattaccccttcttctcacagcaggaatttatctccctggttctttcttggttctttattcatccctgata

SEQ ID NO: 152479 - DNA, 473 bp, Homo sapiens
gtgtaactggttctcgatcccagagagaagaccctcagatggcagaccacccgaggtgacacatctaaaaggactgcgcagggcccacccgcaaggttccaggacatggaatagaagagtgtgcaccaggcatcctatgcagggcatcagctcatcctcaaattccccaggacagatgcagcgctggatgtgtggaatatttaaaggttcccttgcagctgaagtaccttggcaaaacctgtttttactgactccagatatactggcttctacttctgttccagagtcagtgataaacccccaagaactcattagtactttctagcatgcataaaaggacagtaagcctttgttttgctgattagggaggccacatacatttttaaaaacggattattaagaaataaattaccgatcgcggcctgatttattgtctgattactaatattatcggtcacatattaattgtgatc

SEQ ID NO: 152480 - DNA, 305 bp, Homo sapiens
gggagccaagtgtggagtgagcacgaggaatagagagagaccagataaaatagaagggtgtgagttggggttgggttagagatggaaaacaggtaccaagaaaaggctgtctcttattaacacccattcttcaggatggatacaaacagttcttcaggatttcaggtgttccctgaaacccttgcaaaggacgttttctcgatttcatgttgattcagactctgagtcattctacggcacccaaagtctagatggacacttttgatgagttcttaccaactgaactgaacttttttttttttttt

SEQ ID NO: 152481 - DNA, 162 bp, Homo sapiens
tccagtggcggctggatgggagaggagcaacaagactgctgccagaagaccacccaagggggggtatgctgaagggccacgagaaaggtctccaaacaccccaaagctacagacacttgttccactgcattattttcatagccatatcaggtcgccctgcag

SEQ ID NO: 152482 - DNA, 431 bp, Homo sapiens
ctgcaacaaccaagcagtggtattgtccatgagagctcaaggagtggcccccacactccaggtgccgcccgtgagagcttgagggaggggcccccacactccaggtgccacccatgaaagcttgagggaggggcccccacactccaggtgccacccgtgagagctcgagggaggggtccccacactccaagtgccgctcgctgtgccccgggcatgtgacaggggggacatgagagctcaagaaaggggacagaggctggccccccaaaggccaaggtagatgggagcgcagctgcaggcaggtggggggcactgccttcctgccacagcccacctctaaaatcgctgtcagccagcccctccctgataactctgactggggactgggacccagggaacggaaaccgccaatgaggccctggagctccctg

SEQ ID NO: 152483 - DNA, 266 bp, Homo sapiens
caggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcct

SEQ ID NO: 152484 - DNA, 475 bp, Homo sapiens
catctgaagtgtggctcagctttggaggtgaactggttacaagttctgggcttgtgtgtaacatgtctgtggtcgttaccgggctagaggtgagaagtgaagtcacaggaagaggagaggaggagatagtcactggtaatgtggaggaaatgggaggaggtgaggttgtggcaggtaaagacagcagggaagggagagagctgggattttccagagagggagagctttgccatgacatatctccaggacctctgctcatgagagtggtcatctctgagtgtggaaatctctgagtcaaagttgaatgagtctttgcctgggactttgtggtggatgtgtccaaggtaagggtatcctgtgaggtagacccagaaggacctgtttgagagaggttgggcgggactgctgatggattcttggtgagagaagcttctggtgtagttactgagatggtagatatttctaggtctttgag

SEQ ID NO: 152485 - DNA, 425 bp, Homo sapiens
ggagcacactcgagaagccccccaggcgccatataaccactgctacaggcagtgttataatctccatttctcatgagctaaagagactaaggctcagagacgtcaagagacttgcccaaggtcacacagcaactgagtggtagaggtagtcagtccacaccctcccttcttccctctgtgctggcgctcactccctccccaacactcccctgggagcccagcaccagtccttggagtgggatgacgcagcctgcagagaagctttccttccgagcgtctggaagaacccgaggctggcacagcaccatcagcaaataaaaccatgtgacttaaaaaggtgaacgagcggacatgattaaaatacttaacacaaaagcgaattcccgcctggtggcatgttatcagcagctgacaggaatagcctg

SEQ ID NO: 152486 - DNA, 275 bp, Homo sapiens
caggagttgcctgtcacagtaaccaaagttcttgggaattgatgttcacatagaaacagaagattcagacctagaactacataaactagagaaattgaattgagacctccccttcttcataaagctggagcctcagagagctatgccctcagtgaaagggtggacaagaacaatctttaccaatcttgtctgttttgttttctcttaagctctggatgaaaagtaaaggttttcctggggaattcataaccattaggcgtgctgtcacataggtt

SEQ ID NO: 152487 - DNA, 350 bp, Homo sapiens
attagtggcactctaacgctaagcaagtgggcacttacaggtcccccagcttgcccccgcttcactctccctgttaggaggccagaacgatgggggccttccaagtttctaacttgctgacaagcaccgctactaaccaaaatgaaagtctgggtggctctgcctcagaagccgccgcttagaaacccaggggcacacactccactcaagttcagcaggcctaccttccacggtcctgcccaggccgcccgctgtgggttaaagacttgatttacgcacgctctgggggctcagcatggaccaattccagacgtagaacagggccttaaccaggtgcttaagatgcaggg

SEQ ID NO: 152488 - DNA, 285 bp, Homo sapiens
ctctgtttgagtttagccaggtctgtcacttatctggccacaaactgtactcatttatactttttctatctctccctgcattgaactggcacacccagtgcactctcctcaccagctaagcaaccagttgactgatccatagcattgttggttctgtcccaccttccccagcctgtaggctttctttgtcttggtgaccctcaccaaagctattctcaatcattttatctctggcacaactgctttcccctctagaactctgttaactctggtcatggtcctctc

SEQ ID NO: 152489 - DNA, 445 bp, Homo sapiens
ctcaacactgtaacaggaacattaattttaaaaaatctaataactattgaggaaactaatagtagcatacctttccttatatacagcttttaaaatatgattctgagtgaagaacaggcaaaagagcctactctgcctactactctgttgtcctcaggaagccaaaggagtagagagaagaggagatatacaccattatcgcttttgcccatgaaaatggtaggccacctaccattctcatttttgtctattaattttgacattgaaatacattctagatttttaaaagtgagtctttttgaaataatagagaatcagtttgaacacatttgaaatatgtatttcagtgtacactcagaatattttaaatagattataattaaaatccaaaattttaatatatcccaaacttaatagtttataagtcttttataagtcaaacaaa

SEQ ID NO: 152490 - DNA, 248 bp, Homo sapiens
ctaaattataaattttaaaaaagtcaaagaataccatatgattatatgaaactttccattttcatcttctctaaggcatgctgatctctccttttatgtcttttactgcttattccaaaggatgtagtaggtattatcattttctctaatctttttctgcatcatctttataaatccccaagttgtaaatccctgaaggacaggagtcctagtctttcttttttttttctgttttttctaattccagg

SEQ ID NO: 152491 - DNA, 140 bp, Homo sapiens
aaggaatgataacattttgagggacaatagacacatcaagtttttctgccattcagatttacctaattaacaccagcacttacctaatctgaattaggtaaattcagatttacctaacacccaagtaatttaatttacct

SEQ ID NO: 152492 - DNA, 274 bp, Homo sapiens
tctctcctctactcctgtctccaatttaatctccctcacttcccctataggaacacttttctctggccaaaattggtggacttgtccactgtccctctatgaacccacctccgtgcctgatctcacgctcacttaaaaccaggagtatttttttccactttccttcactggacacctgtctcaaatttcactttctccatgaagattggcaatcccagcagcttctatttccacacaaaaagactgcctggaaaagctggggtcttgacacaca

SEQ ID NO: 152493 - DNA, 242 bp, Homo sapiens
tttgggaaaatagtttgcttttataatattagaacagctattaccatgttaagaaaggtttctatcctgactcttctattggtaatgtttgtgggtaggggagaaggaggccacatatggttaaaacaaacaagtgatcctaatactctgctgtccccatcagctggttcttggccagcaagtcagcctagttaatcttggttttttaaccagtacatacttagttgcctttattaagcgta

SEQ ID NO: 152494 - DNA, 287 bp, Homo sapiens
taagctttgactgaatacacaaaggaaagagcaggagggcagagtgtccttggtgaagggagattaagagtctggtgaagcctggttatttaccaaaaacttcatctacttaactccaatgtcaggcctgcaaaaatattttcccttcctatttcctgttgccctggggaaagttgctgttaccatagaaaagggagtctatgtgtgtaacctatgcattcctttctaggggcagacaaaagacacattgtgagtgaatgactttcacagctcttcagctctagacc

SEQ ID NO: 152495 - DNA, 294 bp, Homo sapiens
tgtatttctaggttacagggattaggacgtagatatctttgggtagggttgggggcatttttcagtctaccagagtcttccctttgacccctaaagattcacatctgtcttttgtaaaatacattcagcctatcccaaggtcccacaaactctgaacccattgcaaaatcaactcaaaatccaaaatgtcatctaaatatcatcagcccctaagtcccatttcatcatttaattatctaaagctggtttatgtgacactctgggtatgattcatcctggggcaaaattcctccc

SEQ ID NO: 152496 - DNA, 458 bp, Homo sapiens
aacctggggcctttatccgacatacacgaaaagcttcatcatggacaagagaataaggacctgctgcaaccttggcctgaggtggaggacacggcctaggcagactgcagggtttccagatgtgagactacagggactttgaatgtggctgaagaaataggccttagtttatcctgggtttttaattccgaacttttccaaacatacagagaagttgggtgaatagattgattgcccgtgtatctccacctagaactgttaacatctcacctatgatatttaaggaaccaagtgtaccacctcaaaatatcataagaaaaacacaagggaatttggagattgggaaaaacagaatcaatagagctgcacagtgcagaaaagcaaagaaagattaagatagcaattaacaccacctctgagactgtaaatcaaccagctattaaggctctgattctacg

SEQ ID NO: 152497 - DNA, 293 bp, Homo sapiens
gagaaacaaaaaaagtcacctgtagggggagcccaaatggatttcagcaacatagttctagtaattgcaattaatttagagaagactttcaggtaaagatagcaactgtagattatttttcacggccttaaagttcttacctctccatgtcattaaaagtattttaaaataactagtaattaatttacgtaagtaaaaattttcaataacttattttcttgagttttaattgacaagtttttcagctcagtggaaatatcactttttctgaagatattgttacacaaacactt

SEQ ID NO: 152498 - DNA, 231 bp, Homo sapiens
caaatgggcattcgggggggcctgtgggtggtcccgattctgttcttgggagcgggagtgaaaagcaagcctgtcgtggggaaactggcaccttcactggtggccacgctgctggggctgggcgtgaagctgcctccggcccttggagaggagtgtgagggaagggaggcggcagtgctttttatacacaggagctggaggagggtgatggcagcttggaggaagtcatca

SEQ ID NO: 152499 - DNA, 401 bp, Homo sapiens
gctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggc

SEQ ID NO: 152500 - DNA, 305 bp, Homo sapiens
aaagtgattcttcatggtggcctaaaaccaaagactaaggaagaccaccatgatattataagtaacaggtgccattatcaaggtaaattacatttcacatttaagtgttttctaatttataaagcactttcagatgtattatcacatctgactttcacatcagcccagtgagctaaggaacaggactgaatattacatattatagaattattagctgtttcctaatatgtaaaatgagaataaaaataatattattacactacataaatttatacacatacacatatgcatgcacacatgcacac

SEQ ID NO: 152501 - DNA, 406 bp, Homo sapiens
gactggtcagggatgccctgtgtggctgctccaaggactgaaggcatcgatagttcaggcacgactgtaacccatttgttgcataggttacagctggtgggaagccctggtctttggttcggggttagacgactagtggtaaaatctagtcctgtactggtactttgagattttcatcaaaatatgagggaacacagaaacttgtattagatgacacatcaaaagcttccacagagggtgatatacttgatagataatcatgaggaacccaagtctcccttctacttcctacttagctgggcctgcagttgccagctacagaatccagcctaaagggaagataaatgatagaggaagaaggaaccacagtatatatctaataaggtgtgagtatgcctatatgtca

SEQ ID NO: 152502 - DNA, 634 bp, Homo sapiens
ttcaccaggaggcagagctcggagtcccgattttctcctgtagctgtggcctggacatggcggctcctggccctgtgactccagaggtcccctttgaaccatggaagcccccagtcatttaggggtttagctccactgtttacagcaatccagagagtttcaaggaaaaattccttcacaagacccgcgagaaccacatggtacccaggttgcctaggcatggcgaccgccctcacctacggcctctactgcttccaccagggccacagtcagcgctctcagctcatgacacgcacccggatcgctgtccagggcttcacagtcgcagccatcttgctgggtctagtcacaactgctatgaagtctcaatcctgagcccatggtctggccttgaaagctctgcagagatcattccaaaacccaggagcaaccactggccctgccgtgggacttagtccttcctcccctttcagaggccccagtgtcgttgggggtggaagtgatcctttgtgtacccgcaactaaaatactttttcaaaaatcccagattctgttgtttgaatgttacatacctctatttgtgccacatctcttccactcccctgcttaataaactctaatccacttataaaat

SEQ ID NO: 152503 - DNA, 119 bp, Homo sapiens
attagctagaaaccactgaaaataaaaaccttcaggaaaaagttttccttctcttaaccaggaagaaaaggaaataacactaaaattgacaaccttaccagcttcagctatcaaaaggg

SEQ ID NO: 152504 - DNA, 584 bp, Homo sapiens
ccaattgtagaaacacacatccaaaaataaagtgatgattaccgtctttcttttttccattaaaaatcactttaagcttttcttatcaacttaattatttacatgcacattgactaaatcttaacaagctcttaaatgctagttgccctgttgcctctcagcactagccttcccagtgccacacacgtgccatttgcctttgtgctctgtgacaccaccatctgggtgtctggtccaacaagcgccttcttgaaaaccttacataactccccttttcctgtgccatgggcttcacctcaccatatctaatgggagctctggcctggactctaggaatgtcattccagataggcctgacgggtctcactgcccattaacatgagctcccccttccctgctgggaagccagaatgccgtgtcttcctggcacgtccacgtcctgccaattcaggagacaaaaccattagtctaccatgagaaatctggttttctctccatggccagaaaaccttcagttttcagtaccagtaaagcctacccttctaaaacatgcttacactgaacatcaataaactctttgataa

SEQ ID NO: 152505 - DNA, 382 bp, Homo sapiens
cgaatgactttgatgaagatctaagaggcttgctttaaaatccatggattaattgaaaagggatagctgttagaaataggtaacaatttagagttaacatggtttttaagtgggctgcaatgctgtgctgaaagcaaaaaaatattttatagtagtaaatgcatcataattcattggtatggaagtatggagatgactttgtatggtggcagttctttaggaaaatgaaggttaatatgaaccagtggcatgatatggttgcaaaagaaaaaaaaattagttaggttctggtagtagtatagtgtccatatgtcacaaaaattaatagtaccctgctctaatcaaccacatctgtagtattgtgtccatttctggctgtcac

SEQ ID NO: 152506 - DNA, 400 bp, Homo sapiens
gtgtactgtgactatctcccattctttgatttgcctattaattttattactgatgttgtaaactaagaataaaatcctaagtcccccgccgactgaacgagctccctcttggtcaaggggaccccagagaaaccttaaaaattgagtttccggccataaaaggatgggaggttggacacacctggttatactgccaccctttttcagtttagacacaactgaccaacattagtgttaaagtggagatcacgagactgacagactctgcggcaataagacgccgagttataatcaggacctaaggccgtgccaggccggggttaagtcacacacccttacagttaaagaataaggcttgggttttcttttcctctagcagttaagcaggcactggcctgag

SEQ ID NO: 152507 - DNA, 375 bp, Homo sapiens
ttcattcattcaacaaatccgtgtgagtattctgcctctggattcacagccaggacagaatgtagttcccaaatacctgccccaagcccacagacatgtatccccagcatatatgggccaggatgtctctgtattctcgaagttctctcacagctaagaccttcctaaactgcatttttaccagcctcctccacctgcttctcatctccctgaaaaggcttcactagactctgagacctacaagagatccttccgagacactccctctctcctttcagctgcatctaagatggatccacactgggcgcttttgggtctaagaccatcccctatattgtgagggtacaaggtttccatggtgaaggaggcattctg

SEQ ID NO: 152508 - DNA, 323 bp, Homo sapiens
atagaagctagccagctggggtaagagatggggatgagtcagaaagcaacaagtacaagagcactgagacagagagagctttgtatgttcaaggaaaaggggaaggccatagaagctatggctggtgtgctatgtggacagtgcctcaggaccagagagacagcaaaggacccagattatcaggaagacatggaagcaatttgaggaaagcaaagatgtcagacagatgcagaaatctaccaagagatcagcattgccagctggtgtcctttcaacatgggcaagtgatcatgtatttgaagagtaaaaaagaaggttttgag

SEQ ID NO: 152509 - DNA, 1189 bp, Homo sapiens
atctcagctcactgcaacctccgcctcccaggttcaagcagttctcctgcctcagcctcccaagtagctgggattacaggtgcccgtcaccacgcctggctaatttttgtatttttaatacagacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaaggttcactgttgtcttgttcagtgttgtctggtaattgagagaggtgccttcgagtctgcagagagtcttcagctttcggaagttaatgaagccgtgaaggttgatagccataggggcccacgtgaaaggcatttacataaaatattcactttaggtaattaatttattcaacaaatatgtacattgaatgcctattgtatgtcaggagactgagaccttactgttgaaagaagagagaacatttagaaaacagatgaagagaccaccagtgaataatagttccctgttgactaaaacgaattcaacagccagtagcagggaaatatggtctttcaaggcatcagaaactcatttacaaaaattatagagctgccaggaaaaaggctgcacaacaaaaatagttgagtaaactagaaacatacactgggaagagagtatgggggcaagttgttagctggatagataggactgtgctttgacacctctgtggtctatgatctctgaacctggaatagggttcattttaatagcgataaagtcattatcccagtgcatccaaattgattagttcatgctttattaggaaacagaagttacccaaaacttagcaaacctaagtaccaagtatccaaaacattcttttcctacacaatgtttggggtattgtcaaagttggattgattcaccagccagtcttaattggctactacggttcagcctgttttctcct

SEQ ID NO: 152510 - DNA, 502 bp, Homo sapiens
acttccaactatgtggtcaattttggaataggtgtggtgtggtgctgaaaagaatgtatattctgttgatttggggtggagagttctgtaggtgtctattaggtccgcttggtgcagagctgagttcaattcctggatatccttgttaactttctgtctcgttgatctgtctaatgttgacagtggagtgttaaagtctcccattattattgtgtgggagtctaagtctctttgtatgtcactaaggacttgctttatgaatctgggtgctcctgtattgggtgcatatatatttaggatagttggctcgtcttgttgaattgatccctttaccattatgtaatggccttctttgtctcttaacatactgttattaaccaagccactggatcaacaattcttggctgactcattccaggcacctctccttccttcgtctcatgtctgagagtccccagaagacagggttgaggacacagggaaaagatcttccagatattca

SEQ ID NO: 152511 - DNA, 143 bp, Homo sapiens
ctttggacttcatcacagctggggccttttgtgtcacttaagatctaaacttgtaaccatgctagatgtgtttctaatgtgacaacatcacgaaccacgagtccagaagcctaatccttaatcctacctcctcatgatgaagt

SEQ ID NO: 152512 - DNA, 206 bp, Homo sapiens
gggaacagatattttagcataagaacttagcataagaacaaactaaaatgattagtattccaaaggtacaaaatcatatttggccaaaatccttcaaaagccaacgtaccactactacagacagatctgggtgacgatgcgtgcttattgcaacagtgaacttctggaccttagaatgtgccctgtatgtaacagcagacgctgaa

SEQ ID NO: 152513 - DNA, 226 bp, Homo sapiens
accataatcactacttctaccatcaccaccactacagtcagcaccctgattaaccagtagagctattgcaaaaggagatcaaatagttacagtatacttcatagctattggaggcatgtgttaacacaccagatattaataatgttccaaaagaacagtttaagtaaattttaaaaattagtgaataacagaagataatcaagtatccattaagtatcaataaaca

SEQ ID NO: 152514 - DNA, 398 bp, Homo sapiens
gggctgcagccttcgggatctgctgggtcacagtgggtgttaccctaacaagtttcctagagggatgttcattagaaaaataatttattttatggtataaaaattagcaatgacaggctgggcacggtggctcccgcctgtaatcctagcactttgggaggccaaggcgggcagatcaccttgaggtcaggagtttgagaccagcctggccaacatggtgaaaccccttctctactaaaaatccaaaaattagcccagcatggtggtgcacgcccgcagtcccagctactcgggaggctgaggcaggagaatctcttgagcctgtgaagtggaggttgcagtgagccgagatcgcgccattgcgctccagcctgggcaacagagcgagactccgtctc

SEQ ID NO: 152515 - DNA, 459 bp, Homo sapiens
tccggttacacactgcacatggttggttggtttctttctttctttttctttctttcttcttttctttagagatggagtctcactctgtcacccaggctggagtgcagtggcgcaatcttagctcactgcaacctctgcctcctagattcaagtgattctcctgcctcagcctcccaagtagctgggattacaggcacacgccatcatgcctgggctaattttttgtattttttgctttatgtaaaatgtcaatggtttgctgactctttaatcttaaaattattttacatttgaaccttgcctctagccccaaatatttaagtactttgaatacacatgaataattttagttgaccattaacaggtgtgggtgccaacatttcttaacctactgtgttattttaatttattttgagagatggggtcttgttctgttgcccaggctggagtgcagtggtg

SEQ ID NO: 152516 - DNA, 1056 bp, Homo sapiens
ggtgtgacttttttctttgaaactaatattcaccaattataacatatgcacttgtcaatctataatataccgaacaaataccatgtgtatatttttaaaggagctaatttgaggctttatgtctgtcaagaacaagcaagtaatgttagtggtgtttgatttttgttttgttcatgtcactacaatacatactgttttactcccagctttcacttcgtccaagtatttcatccttttgagtgtgtctttacagttcatcagacagctgaatgtagaggtgtaaagatttatactggaaagatttcatgtaataacggctgatggcatttgtgaaactgtccccagagaagtggtgtgtgcgcacagcaccctcctgcctcctctccaaacacaaaattcttttttccaaaggagttgatttcactctttctttgcttagcagtgggcattcagtatgtgcaggttttaaaatattcctttttctgcagctgttatccccaccttgtctagtgaacttcaacaaaaacccaaggcaggtactgtccacatcaacaggacttagtataaggtgtcagtcaccttatatcagtagttgtcccatcagtgttcataagatcattctgatctagttgccagatgcctgtagtttctctccttagagcatggcttggataaatgcaaattagatgaatatagttgttgcatccctgctcctgctgaatggggggagggcaggggctacaaagtgcttcccagcactgtccttctaggcgacccatgtgcatggtggatcataatggaaagtaaatggaaaatgtcatttatctacttactcaaccggcagagctctggtaagtgtttttaatggttagtatttgaagaataataagacctgtaatggaaacggaagaggatgtcttcaattaatttttgttctgtgactgtgccttctgaatggtaggacagatggacaaaatcaaggcataggggaaaaatagctgaaaggtatttagagggcttttcaaagagattcatgaagaaacaaaaagatgtgct

SEQ ID NO: 152517 - DNA, 349 bp, Homo sapiens
gactcggaccgggttactagaagataagaggcagtgagaagaggtgatgagtctttctttttttagagttagtctactttgtgttccctgctagtgagtctgtgcctatgggcttacatatggacataagtttgtgtaagaattatattttgttctatcctaagtggcagctctcaaaccttttcagccagggaccctttttagcatcgccaatccttctggcttgagaattttctatgtgtttctttagtcaggatttttttcccattctccactacccacattaagaaatagaaatagaaaactccctgtgctgtattattctctgagcccctcattttcatgcatc

SEQ ID NO: 152518 - DNA, 492 bp, Homo sapiens
ccactgcgcctggctgttagcagtatagtttcttaaacttttacaaagtatcctctagaacctctagcctccacattagccattatctgaaatgatcatctctagaacctaatttgtgtcctggttatcagagaatttctctcagactgtgggtgctacaaggacaaggaacatatcttacttttcatctctatagccctaatgcttagtatcccatcatataggacaggctcaaaatgcactttagacagatgtgtgaatgcgactgaatacttcagtttcataaaaacgtgaactgagtgagatgtttgccccattttctccttttctcaaagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctc

SEQ ID NO: 152519 - DNA, 453 bp, Homo sapiens
gaaggctaggtcagcagctgccaggcaggaaaggtagtcacataaggttcatgtgaatcctgttgcttcagactgtcccagtgagaggccatcatgcctcttaatcacatgggcaatgactaggagggtagggggaggaggttctcagcaaaaataaccatcaaaccttttaaaacacagatgctgaagatagccacatactacttgtatttcaaacataaagtcggggcctgtcgcatggaagggtagacacgagtagatgtgtcagtcaagtttctgtgtaacaaccaaagtaggccagggctccccagcctttccttttcagggcagtaatggaaaatagtacagttttccatatgttgggtaaactaaaggcaatggtgagggcatctgtgttgaacttagtgaaaaaaaaatcatttctttatattacatgattaaaagaaaactaaa

SEQ ID NO: 152520 - DNA, 560 bp, Homo sapiens
cctcactgctggggggcctgcaggtctgggtgcaccttgttacccaggctagccttcctctgcagaggtgtgaactctgccaccaccccgttctagtcaagatgggaatggaatctcagaaaggaagccatctaggagaaaaatgaaagaagtgtttctcttatgtttgctgccgtcaaagttgctactttaggagctcagaaaaacagttatttgtaagatggattaagtaagtagtttagtaagattgcccaaaaccacctcccagagttagtgggaagcgcctgatgctggggagaaaagcccgaggcctgagctggccgacctgcattcagtttcctctgtctctagcttctctctgatggtttagaaatggtactaagggattcctaagtcccttttgcttcctgtggtcaaccaacatgctaggctaataaattactcctgaagttcactttcattttggcaacattttctggttctttcgccaactctaatttcttttctttaaaagatgctttaattttacttgtattcttaataatatatcttatatatac

SEQ ID NO: 152521 - DNA, 408 bp, Homo sapiens
taatttgtatactgtctccttattttgaggatcgcctcatttatatttggcttagtttcttctcatacttgatttcttctacgcttcctccaaaagattatactattttatctttcgatctgtgatgccatcttaggatattaaatagatttcaatattatttcattatatttgttgtattagttttttagggctaccataagaaagcataccacaaacaggctggcttaagacaacagaaatttgttctctcatagtactgaagaccagaagcccaaaattagattgttggcagggccacactctctgtgaaggctctggggaaaaattatttcttgtctccttcctaatttctggttattgatggtcattcttattatttattgacttgtagctgtatcattctgg

SEQ ID NO: 152522 - DNA, 435 bp, Homo sapiens
ttattttcagctgcccaacattcgcgaatcaccttctatgtgacctctgttttgtcagtacctctttttagcacgtggatgggaattgagcacagcaccctccagtgcagtctctgccgtttgtccatgttatcactcttttctcatctgcaaccaaatggaaactcccagtcctgctgcatcacagatttatttgtaccattagctttttgaacctaaaagctacactttatatggatccttgttcaactccatcttttcagttttggcccagtattgcattctgttgagaactttaaaaataatgacgtatacctataaagtttactttcaatgtcctcagcctttcaaaaaaaatgaagaggaaaattgcataaaatcccatgcagaaagtattctgtgtatccgtaatatttcatttctttttgacttgac

SEQ ID NO: 152523 - DNA, 239 bp, Homo sapiens
tgagaggctggggtagagctgtggaaatgtttgagggactattttaagaatgtgtaatattcaacttaaaattgttttcttctttccaacttaggtcccgcagaagaagggtgggaagaagaagggggccattcagccatcaatgaggtggtgacaccatcaacattcccaagcacatcccattgaaacggacttcaggaagtgtgcccctcgggcactcagcaaagatatctggaaat

SEQ ID NO: 152524 - DNA, 442 bp, Homo sapiens
cagaccaatcaggcaagagggaaaaaaagaaaaggcatccaaattagaaaagaggaagtcaaactgtccccctttgctgatgatatgatcttatatttagaaaaacctagactccaccaaaaaacttagttctgctaaataaattcagtaaagttgcaggacaaaatcaacacacataaatcaatatgcatccacctgtgaagtagggagtgttaagatgttagatgaaatgttctgtaaatgtctgttaggtctatttggtctgatatgcagtttaaatccagtgtggctttcttaatttttgtatctacatgatccatttaatgctcacagtggggtgctggtgtccctaactattatcgtagtggaatctatctctccttacagatctaataatacttgctttatatatctgggtgctacagtgttgggtgccttatat

SEQ ID NO: 152525 - DNA, 436 bp, Homo sapiens
tgagggtgggggcagggatgccgcagagagtcactgaagaaagcctgaagagagtcctcatcctctttttctacttcccttttctcaaggacatcagctagacctaactataggaggtaggatcaaaccataggtagcatgagatactgtgatcagacttcagggagcactgtttgctagcaaggtaaccaggggaggagagcaataatagtctgtgttgcaggtcttaaaaagaggggaaatggggaaatgaatgaatgacctccgggtcccctgccatggcttaaaggtggctggtgggggtcttagaagacctattatgaatgagagctgatgatttcaggaatctctaaaacatcagcttgagcatgttatacctggtgactcatgggttctgtcaatgttccatatatcccatgctattttatgccttttc

SEQ ID NO: 152526 - DNA, 568 bp, Homo sapiens
taggatgctgtgcgtttaaactgtaaaccgcttgctcttacaggcttgccactctgctgttcttaagtcttcctacttcaggggtcttcaacccacaggccacagactggtactactccatgacctgttagaaaccaggccgcatgagcagtgaggaagcctcatctgtatttacagccactccccattgctcacattactgtctgggctccacctcctgtcagatcaatggtggtattagattctcataggaacgagaatcctattgtgaactgcacatgtgagggggctaggttgtgtgctccttagaagaatctaatgcctgatgatccgaggtggagctgaggtggtgatgctagagctgaggtggtgatgctagcactggggagtggctgcaaatacagattaacattagcaaagaggtttgactttacagagatgataataaatcaattgcttgcagactcatcaacccctatctgtgagtggcaagtgacaagctgcatctggtggcaggctttatagtggcaagtgagttggtgtacttcagttgtacagctgtatctgg

SEQ ID NO: 152527 - DNA, 221 bp, Homo sapiens
gggaagcaggtcagaggctcctgccacctgcccgttgacctcaggaggacattgtgcttgcagcagctgagtggcctgggaagcctgcctggaacctgggactgtgatgggtggagtctccaggagggctagggaggcggggaggagcaccctgtgagctgcaggcaccgctgtgttgcagtcagcaaacactggggtctgggaacccactttcatgtttg

SEQ ID NO: 152528 - DNA, 166 bp, Homo sapiens
caggtccagggataagagcccagaaggaaacctgagtccttcagcagtgctgctcaaggtcgccaatgacccgctgagcctgtgacccagggcccaggagcaccagccaccttcctgttcccgtcgcagctccgccaagcctcccaaccctgcctgccttggtgcc

SEQ ID NO: 152529 - DNA, 445 bp, Homo sapiens
ctccatctcaaaaaaaaaaaaaaaaaaaatgaaaccagtagtcaaattactatttggtaatacatttttgacatgaacttgcagctcccttggtaagtctgttgaagagtaaatgaagttttactacctcaggaaaaacatagttgtaattttatttaaatatcaaggttgctataataaaattcctttcagaatcatgagtttaatatgaaacactaagatttgaagagtttcattctggggataaatggtgaggcatttaggttaaacgtttaataaaggctaagagagaagaacattcgcaggtgtaatagtttgctttccacttggaaagaattagttttattctagaagttatattttagagccatctgaatagatgagtagctaatttatagttggaaattagggatcaggagttgggatagtgggtagacacattttc

SEQ ID NO: 152530 - DNA, 283 bp, Homo sapiens
taagctcctctctgggtgtccacctgtagggacctcaaattagaacgtcagctcctcccagagtcttcagctgcatgaccctcaatctttaacatcagctcctctccgggttgcagcttggtgacttctctgaatagaccttcgagggcactggggggtgattgttggagggcttggggagctcaggcagcacttgtgtgggaacgtggctgttacaggaactgcagaaactgggactgggttcctggggaaaggattgggggtgttggaggcgctggcaggg

SEQ ID NO: 152531 - DNA, 180 bp, Homo sapiens
cagcaatagtaatttgggattgtttctaatgcctgtatgagacccacatagggcctcataaaaagagggagtgggtctagggactcagtaaatgcttaacacttagtttcaaacctctttcttgggggctactttgcttttttatgccaaattttcaatgttatatatagcaatgttttg

SEQ ID NO: 152532 - DNA, 468 bp, Homo sapiens
tctactaaaatagccctgaaccctatacataaacctaaaaaataatagttgctcaataaatatttattgaatgaaaggatgaaccgttctactttctccttaactataactctgtattatctgtcctgaatgagattagatttcatgctcaaagataagtattggtttatctcagaactaaacttccttgctcagccctccttttgtcacacctgcatggcatgactgcaaataagcatggcttagtgctgtttaagaacacattccaacacattgacaggggtacgatataaatacattttgaacgtccatagatctttcaccactgcccctagaaatcctattttgtcttcttactcagctcacacagccattctctaccagaaaactgtcaaaccatttccacaaatcattccacctcctgaactttatcctcagtatctagcttcatctcacaacacaaaaagt

SEQ ID NO: 152533 - DNA, 245 bp, Homo sapiens
aagctaatagcctaaagtgggaagcagctaccatggggggagagcttgcctgtgagtgatgctatatgcatttgtgtgagacatacagaatgatggatgagaattatttctgtgtacttggatccagctgtgcatgctctaaaaaaacttactcgagccgataattaccttttttgctcaagcccatttaagttgggtttttattacctggaaccaaaagttttgactgacgctgtttttttttg

SEQ ID NO: 152534 - DNA, 421 bp, Homo sapiens
aacgggtgatgcggttggcattcatttctcccctttcccaactgtagggatctttatctgggatctgccagaagggctggggaaccccagcttatgtttagtttatagctcattcaggagatgaacccggatagctggaatataaagagggccacagaaagataagcacccccttcacttccagaatatcctggcctttaggaaaggtggctttggcctggcttgccccaggacatgcagtgacagcccacagtcatgcctcctgcaaacattgaactgtaggcttgcactggcctacagaacaggaccgggatcttctgatcccgcagccctgcaatcgcctcttccctgccgctagagaatggccaagcagggtcttgtggggggagcactgtgttggagatcctggctttggtcaagt

SEQ ID NO: 152535 - DNA, 137 bp, Homo sapiens
attgtctagttactttgttgttctgattgcaacgttctgtgattggattagctgcaaaaggtatagcaagcctctaaggaccatcatcttgctatcattttataccttctttcttgaagtcctttttatccaaaacg

SEQ ID NO: 152536 - DNA, 488 bp, Homo sapiens
ccaaccccaccccttcccataagggaaattcattcattcttgttacatagccgcttgggggtgggggtggaaggaatactacataacctttgaactaatgcgcaactaacatgccattaaaaacaaacaaaaatcaaccagtctcctttcaaataaattttcccaagtaagacttcagcttataacaatccagtttcttgttttatttattatctgcttccagttatcttactcctggtgggaaataaaatttattgtgcattaaaatgacacatttggagaaaagaggctggaaaatgactttttgctctaagtagctaagcagtgctcaaatacattcacagggatatctggttaaccctgaacaaattaccaatatttaatgggacagtttgagaactgtctacaaatatcttcaaaacatttccatataatgaactgcaagtccaagctttcagagaagaaaaaggtaacaccacacaagattc

SEQ ID NO: 152537 - DNA, 250 bp, Homo sapiens
caggcgtgagtcactgtgcccggcctccatgcccacttttaggggaaaagtttagaagatggagacaaaaccaactatccttctgctatctcttagattttcatctctttctattctgtagcctacaatcgtaatgtagaccaagattaggctgaagaataaaatattccttaatgtatctaatatttttatagtattgaactgtaaccccataatgaatttttttggggaaagtcagattatttggtta

SEQ ID NO: 152538 - DNA, 505 bp, Homo sapiens
cctcctgcctcagcctcccaaagtgctggaattacaggctttagccactgcacccctctgactatgtttcccgttgtgtgttaattatggtcagtgtgaggcccaccctagcctcccaaagtactgggattacaggcgtgagccaccacacccggtggatgtagaattttatcaaatgcttttctagcatcgattgaaataatcatatggtttttgtccttcattctgctgatacgattttatcacattgattggtttgtataagttgaaccatccttgcctctctgggataaatcccacttggtcctgatgaatgatctttttaatgtattgttgaattcagtttgctagtattatcctccttattgaggatttttgcatcaatgttcatcagggatattggcctatttttgttttttcgatgtgtctttgcctagttttggtatcagggtaaaactggcctagtagaatcagtttggaagtattctctccatgtctgttcaga

SEQ ID NO: 152539 - DNA, 282 bp, Homo sapiens
aactgtcattgctggggacctaccctcacagcccaatgttgaatcatgaaaggattcacactttgaagtgtgacaagtatgatactgtcaatagccctcttgtgaaaaatagcactgtttcctcaaagtcaatccaatgtgacacacttggagctaaatctctgaccctatgtgattaaaacagaatttcaaagccacacacatatcctgcttcttggtattttttggttctgccccttgctggatagaaataaatttaatccttgcattagtttcatctag

SEQ ID NO: 152540 - DNA, 304 bp, Homo sapiens
aagtgaaaagccagaaggaggtctgaccggtcagtttgaaacgctgtcttctctgccctgtatgaccttgaagtaggcttcctgcctatgtgaatttgtgacattgtgtaagaataaacaataatattgagcatttccggtgcattttgtggtatgtgctgtcctggtgttttatttaacctgcccagcagctctgtgaggcaggtggaattatagtcctcattttcaaagagtggaagctgggacttagagaggtcaagtaaattcgggtcacacaaccagcaaatggcagaacatgaatata

SEQ ID NO: 152541 - DNA, 461 bp, Homo sapiens
ggctggtgtcagccggtgctgttcaacaactcctaaatacagaatgctgcggttgctgagcctgtgggatctcacattgttagaaggtggttctgctcttagtaactgaggggggcctcctgggtcctgcctactgactccactttctgcctttggagttaaaagaagcctattttattctacacagctgcccttcatgtttttcaaacagataacatcctttccaaggcttctcccagctaaataaatgtccaatcccctctttctcttgtaacagaccccttactactctctctgtcctatgagtactcactagtttgtcaatgaccttcttagtgtgcagtgctcagggttagatacagttactttgatggattggaatgaggaagataaagcttaatagaaacgttaaatgcttcatttagattaaaaatatttgacaatgtaattaccacattccc

SEQ ID NO: 152542 - DNA, 501 bp, Homo sapiens
atagttgagaagcttaatctagactttggttttatttgtgtataattcatattcatcagtggtgtaatgaatcacaaaagtagcattgtgaatatacatcctgtctttgataggaaaaagcgaaagcactaggtaatttcatcctaattaacccaggcttaggtcaactgctgctatgtatctggagagcaggaaaagggcagagtgaaatgatctctacaaagcaggacaaatctaatactgtcaggatgggtcactagactcgtgttcctggagttacaggtggaaagtagtagcttctttttatagaccactaaatgcctacttactaaaatctgccaggaaaggaaaaatcttgtctgacaaattattttaaaatgtggattgatcctggagaagacagaaagccacactaaaagtataatttgtcagtatcatctagcacagcagttttcaaactatgatctcaggactcctttacaatcttaaaaaattttcaag

SEQ ID NO: 152543 - DNA, 352 bp, Homo sapiens
agaggcaggtggatcatttgaggtcaggagttcaagaccagcctggccaacatggtaaaaccccatctctactaaaaatacaaaaattaacagggtggtagtggcgcacgcctgtaatcccagctatctataggctgaggcaggagaatcgcttgagactgggaggtggaggttgaggtgagccgagatcgtgccactgcactccagcctaggctagagagtgagacctctcaaaaacaaacaaaaaaactggaaataggtaaatttctttttctgtacagagaacttctttctatgttaaaggtagaatttcctattaaacagataggttactgtattaaagttttctgat

SEQ ID NO: 152544 - DNA, 417 bp, Homo sapiens
aaggtcaaatgttaactgtgttactaggcaacattatggcataaatgactgctgattggtcaactgtttctgggctggaagagtgataaatgcctggtaggaagctgtatcattggacttctgtgactgtagtgaaacttgtgattcagcatgctccttgacacatcaaagattgatctattgagttactggagatattggttcctttgaggcacaaggcttttaagccagggtaagttctgaacctacctaaagtagatcactttccttgcactggagatgatttggggaggagaggctcaggaggacagcagtgtggacggctacatggacagttgtgaagattttcctaaaggggaaaggctgatgttgccttgctggtgactctaatctgtgtatttctgaagtgattctggt

SEQ ID NO: 152545 - DNA, 296 bp, Homo sapiens
catcactttttgtgtgatcttatgatctacctctcagtgcctctgtttacttatctgaaaatgatgacattagtaagatctaacccacaggactactgcgaggattaaatgacacaatgtaaataacatacttagcaggtgccaggcacacagggagtgttcagtaagcattagctattattatgaatactatcattgctactaagtctatagggtctatgttgccccaagtgcaccagctataggcttcttgggccagagtgactggtgcaagattaactcgtttgtcctctgct

SEQ ID NO: 152546 - DNA, 720 bp, Homo sapiens
tggagacagagtttcgctcttgttgcccaggctgaagtgcaatggagtgatcttggctcactctaaactccgcctcccgcgttcatgccattctcctgcctcagcctcccaagtagctgggattacaggcatgcggcaccacaccaggataattttgtatttttagtagaggcagggtttttccatgttggtcaggctggtctcgaactcccaacctcaggtgatccgcccgcctcagcctctcaaagtgctgggattacaggcgtgagccactgcacctggctgctttgttcccaatcttaaagaaaacatttcagtcttccaaggattggttttgagctgaagctgctctccttggcttgcagatggctgcccccttgctgccttgtcacatgattggccctctgtccacttgtagctctcggtgctttgcatgtccagatttcttcttataaggtcaccagtcatattggactagggcccaccctaacggcctcattttgacttaatttcttctttaacggctttgtctcctaatacagtaacattctgcagctctggggattgggacttcaacatgtgaattcgagggaacaaaatacagcccataacaatgaagaaatggatccatgaagggatggaaaggagggctcacatgcagctctgaggggaaacgaggaggccatgaccacattttctcctaaaaataaataaataaat

SEQ ID NO: 152547 - DNA, 406 bp, Homo sapiens
ccttcctggaaggctcttccttctgaaccccacagcgctggttccctctcctcatttcagtctcagctcaactgtcacctccttaaaaactgctggacgccaggagcccagtccgcatcacacggccttgcttttttgtctctactgttcaatttttcagccaagttcaaatacaagaagcctcttatggccaggcacagtggctcacatctataatctcagctacttgagaggctgaggcaggaggattgcttgagcccaggagtttgaggctgcactccagcctggacaagagagcgagacttcatctcgttttttattatgaattacccatcccccagtctcagacatatacacaaacacatgcacacacgtccaaaaaaactgcagagatcttagtagaaat

SEQ ID NO: 152548 - DNA, 407 bp, Homo sapiens
tgggaagggagaggactggattagaaaggaggcagttaatggaaaatgaagagggaggggagaggtgagttacacgctgctccccagggcagtgacttccgagctaacagcaggtggagttgccctcctccctcgctgttggtggggttcgcttagggacggagggagaaggaggctggcagagggcatagccccacttcccaaccctgatttgagttatcttccccagggggcctttctccctatctgtcctccaagccccagcagtgtgatcatcagaagaaagcactggaagctcttggaaacgctggagtccacttcaggacaatttgttttcctttcttttttttcttgtcactgactcgaagctcatcaagacaatttctaagcagcttcttaggttaatg

SEQ ID NO: 152549 - DNA, 602 bp, Homo sapiens
tggattcaagtgattctcctgcctcagcctctggagtagctggaattatagacgtgtaccactgtgcccagctatcattatataacatttttgacatcttattttactgtttgcttctgcctactcttgtttatcttctattccctttattatctgttttacttttttttttttcttttgatctttgtgtttcataggcttcctcgagcaatagatgatccttggttgtctccccacttgaatgaggcaatacagttctgatggaagattctgtgcttctgtgtggggcctgttaattgttgggcattgctttagatcagggattggcaaactggcccatgaactaaatacagtcaactgtatggttttgtatgacctgtgagccaagaatgatttttatattttaaatagttgggaaaaaagaatattttgtgacacatgaaaattattagaggccaggcagggtggcttacgcctgtaatcccagcactttggaaggccaaagtggacagatcacctgaggtcaggagttggagacaagcctcgccaatgtggtgaaacctcatctctactaaaaatacaaaaaaaaattcgctgggtgt

SEQ ID NO: 152550 - DNA, 493 bp, Homo sapiens
tggattcaagtgattctcctgcctcagcctctggagtagctggaattatagacgtgtaccactgtgcccagctatcattatataacatttttgacatcttattttactgtttgcttctgcctactcttgtttatcttctattccctttattatctgttttacttttttttttttcttttgatctttgtgtttcataggcttcctcgagcaatagatgatccttggttgtctccccacttgaatgaggcaatacagttctgatggaagattctgtgcttctgtgtggggcctgttaattgttgggcattgctttagatcagggattggcaaactggcccatgaactaaatacagtcaactgtatggttttgtatgacctgtgagccaagaatgatttttatattttaaatagttgggaaaaaagaatattttgtgacacaaaatattcttttttcccaactatttaaaatataaaatcattcattggctcagca

SEQ ID NO: 152551 - DNA, 434 bp, Homo sapiens
acaaagaagaagaagtagtagaagtagtagtagagggaagagggaagaagaggaggaggaagaagaagaagaggaggaggaggaagaggaagaagaagaggaggaagaggaagaggaagaagaggaggaggaggaagaagaggaagaagaggaggaagaggaggaggaggaagaagaagaaaaaagaagaagaaggcggcaaataatacatgtctccttttactactgtgatcacaattccatagagaattgcctggtatagcaggaactcaataaatgtgtgttgaataaatgaatgaaggaagtcggagtgactcaagagttgatacagagaagccttcttttcccaaatgatatgaaatcattcaccttcatggcttttaaatactaccaatatataatgttgcccaaatttgtgtctctgtctctgatgt

SEQ ID NO: 152552 - DNA, 621 bp, Homo sapiens
gaaggtgaactcccgaggagcagagatcacatgtaattctgctcttacttatcaggatgaagaaagctgtgcaacaagtttggctgagttattttagaagagatacatattttctaaatgagatttggataacagcctacgtctaatcctctggtgactgaagatgcaaagaattgtcagagcagtttggctcatcaagctataaagtacaaaattattatgacactcagttggcacatgtgaaaccaaccgaactaaacccttaatcctgtgtagtccctcaaacaggatctgtttctaagaggcaagcagcagttttgtggattatatatatgttacatgattggagtgagttaaaagtaaaataatatgaaggccagtatcagcaacccattgctttgtttttatttagtttttggtaatttcatggcttgaatattactttccacttctgtctactcatacataggaagctattttaatgttgctaagattaaatattgatgcttatgtagtgagcaatgatggcttttaagacctgaatttatgttaattttgatacatccaattatcatgcatgtaatagtaagtaccattgttcttttgctcaaactatttata

SEQ ID NO: 152553 - DNA, 461 bp, Homo sapiens
ttttgttgctattgttttaattcattttctgattggttgctattgtgttggaaagttattgagtatatattgattatatattcaatctcctgaatgtcttatgacgttctgtttttttggttcattctgtttaattttttaggtgatgtttcatatcattcatgcgtatatttgctttgcatctttcttgtctattttctgcatttttttttctggtctaattacattgtctaggattacaatgtttgttcctatttttaattgcaaaggtttttatgtctttaccatttagtgtcacgtctgttggagatttctttcgtctattctgcatgtcagtttaaggatgtctctattcctggattgttaagagtgtgcacaaaaagaagatatagttatttaattttaagagaataccaatactgtaaatagctttatgccaataaatatgaaaagctggatga

SEQ ID NO: 152554 - DNA, 612 bp, Homo sapiens
gccactgcacctggccaaaacttttaaattatggtaaagtctaatttattatttttttcctttaaggatcatgattttgatctcatgattaaaaactctttgcttaacccaaggtcatgcatattttgtgtgtattttcttctgaaaggtttatagctttacatataggtcaagggtccactttgggtggattttcacatgaagtgtgaggtggaggttgtgggtctgttgctcatgggcggcgaattgtcccaacagctgcagacacaactcttctccttctgatttcctctcatgtttgttcatacaccatagacagaccgtgactgtattttgagtgagtttgcaaaaatatggccagtttgttagaacttgacccaccatctgctcacttatcagtttcagggtttttttgtttagtttttttagtgacaaggtttcgctctgtcgcccaggctggagtgcagtggcgcgatctcgactcactgcaagctccgcctcccgggttcacgccattctcctgcctcagcctcccgtgtagctgggactacaggtgcgcgccaccatgcacagctaatttttgtatttttagtagagacggtgtttcaccgt

SEQ ID NO: 152555 - DNA, 389 bp, Homo sapiens
gggaacctgtttaagattttctatcatctggtgtcagcctgtatttccccttgcagacaaaaagtgatgtccctcaggtaccctatttccctctggaatctaccagcttacgttttttatgaatgttcaaagatgtcccaaacatttataatgtgcagatttaccagaattttcattcatgaatgtttactggttttattttgtaggtagtttagagaaagtactcactggtaatcatcttgacccctaagggcacctttccgttttttatctccacatctttgatcatctcttttgttctaggctgccagaaatgccatccttgtctacccacatttttaagactcaacgaaaatcccaccattgtgacaaaggcttctcacagtacc

SEQ ID NO: 152556 - DNA, 188 bp, Homo sapiens
cattgaaataagatgaataagaaagaaaggaaagctcttccttatacgtagaaagctaactaatgaatgtagaaaaaatgatgaattaggaaatcatcatttggcagctactgtaacaataattgtttctggtaagagtcattaatgattagcaaaaccagttagtggaaatttaaggagtcaaatat

SEQ ID NO: 152557 - DNA, 352 bp, Homo sapiens
aagaacacagagttactaagatattttttaaaataaaatatataactcaaattacaaataagagtcactacggtttgcttttacttattatttccttatctttgggtcaaccctcactcacaagtaattcaattggtgtctctgtccttatctttcttctcttattttcacataatatttttgctaccagaagccgagacaactatcctatgaaatattatttgactcttcattatgataactcttcattatgataatctattttttacagtttatttccattttagttagcagatactttatttcttattaacatacatttgttcttgcctgtgattttgtattgctaatt

SEQ ID NO: 152558 - DNA, 355 bp, Homo sapiens
gttcaaatgtccacaattttaactatgagatattttgatatcatgagctattaagtgttatatgtagtatggtaatatactaaataatggctaacaatcacaaggaaacatagcccaaggagattacaatataaattggtcataagtgtaattcagaacagcaaatgaaggctaaagcagcagagaagatactatctttctggcaagacagatttgttgttgttgttgttgttgtcaataattagtaaagtctgaatgaacatcctagttctagattatggaaaataagtttttaagttgttctctctttgataaaattgtctttacataagaaaaaaatgagtgctcatctgag

SEQ ID NO: 152559 - DNA, 649 bp, Homo sapiens
tgagggtggagtgggtactggacgtggcaggagaagagcttttggggcgccttctgttatcttggagtgaggcagctgatgtgatattttaatagggaactcattttaatagcctacaaatgaggagtcagagacaattaaaattcatttccaattaattgttttttcttctctcattaccaagagttgccagtcagacaccgacaaagccttcaaaacaaaagcagctcccagcctccgcttcaatcggacgccacctggaaggaggctccggagagtgccagcatctttgcttcaaacttctctcccttcagcaaatgacttatccggcccctttgtgggcaagagatcgctcaaatcttcagaagctgggaccttctaagccgtgaagtcacagacaagtttattaccacggagctgcaggatacttttttatagttttaatatggtttatttgctctcctgaggaatggtctcagcaactgcatttcttgagactgatttagcttcctgtctttcccctgctgcctcccttctatgctgtggccaaaaacccaggctatgacaaacagcctgagatgacagagcctcacctgagcctggagccggaagcctcggtgcccccaccgctgaattgctgagtgacgtt

SEQ ID NO: 152560 - DNA, 784 bp, Homo sapiens
taatataccccacccccccatcatgcgtgcatgaacgtacactaaagtagatgaaactataccagagtattaatttactctgggtgatggttttattggtaaggattttgtttgcaggtttattgtttctgtaacaagcacacattacttacataactaggaataaaacatttattttaaagggttaatgctacttaattgcagttttttccccaacaagttaatagttaagaaccctgatctcaactcttcgtttttccaggttatttatttcataagatgactatccataaatcttccgatgaacgaacctctttatgaccagagctcctggggttaaaggagaaaggttttataatggctgtcttaatttgtttggtggttttccaggtattaatgccaaatttgcctttgtttagtttctgtttcttatcacactgttttcaggttacatcattatcttaaaaaggcagaggctttattttcttcgttgtgatataacctaattcttagaggtttcttaccaagatcactttgcttgttttgcttaattttattttctaaattttacaaattaatattttccaccaaaaggtggaacgaaacaaagacagcaaaatatcaaactgtttagtaatagttaaaaaagtcaagtgggaaggaaggttgaggctgaggcaggagaatcgcttgaacccaggaggtggaggtttcagtgagctgaggctgcgtcactgcactccagcctgggtgacagtgagactctgtctccaaaaaaaaaaaa

SEQ ID NO: 152561 - DNA, 518 bp, Homo sapiens
gattatgggtaatgcctcttgggagatttatgtgcaagtctgcatattaaaggtttgggtaagtgctgtttgtttgtttgtttgtttgtttgtttaagcccatttagctttaaactagcatttcccaaacatatctggccaagattctctctttttaaaaataaaatagagcttttatcttcttaaaaacataacagagcttaaaaaaagaactaaaaaagaaacacacaaaattagtgactagtagaccgtaagttggaaaagactaggttacagttttcaccccatcataaaattctgaatagacttttacttacaaaacgttctacatggcatagggaagaaagtaaataagcatgacttgagactgaagacctccaatatagagtgagataaaatataaagagcatcttcccttaaaaatagaaaaatataaagtaacctgggaaagaaaaattattttcctctttttcggttcttctccaaataaaacacacaacataaagcatagcataacc

SEQ ID NO: 152562 - DNA, 473 bp, Homo sapiens
agccaccgcatctagccaagagttttttcaaaataatatttttctggatttttctggttacatctggggttttatgacttctgacagataagggtggaggaggtaatttacgaaaagaaacatctctcttgatccatatttacattccataagggagtgagtttggcttttggattctcctcccaggcctatcagggggatagaattcttgctcctatttgatgagatttatggggcaatgaggtctgtgaggctgatgctacaccacctgcttcacgaatacggcccctccatttgcaaagtgctgacttggaacatttgtatttttcccttacaaatcaatcaatctatctatcggtctgtctgtctgtctgtctatctatctatctatccgtctgtccacccatccgtctgtccgtccatccgtccatctcactctgttgcccaggctgtcacacagtggcacgatcaca

SEQ ID NO: 152563 - DNA, 389 bp, Homo sapiens
atcccacttaaatgtgaaatctaaaaaagttgaactcttagaaacaaaatataatggtggttaccagaagcttacgtggatggggttcaaggagatattggtcagaggacatgatattttagttagactggagaaataagttcaagagatatgctatacaatatcatgattacagttaataaccatgtattatatgcttgaaaattgccttgggtgtacattttcagtgttctccccacacacacaaaaaatatgtgaagtaatgcatatgttaattagcataatttagccattccacaatgtatacatatttcaaaacattatgttgtacaccataggcaatttttacctgtcattaatgataactcacacacacacacacacacacg

SEQ ID NO: 152564 - DNA, 955 bp, Homo sapiens
gaggaacggggctggggccggcagggtggacttgggtttgaaggacactgcctctctctgcccataactggggtttccagtttccctctcagtcctgtctcttcctggccccagctaaaggatctcatacgttgatggacatgtggggattaggccttccccaacccagagctttcccccggcagccgacactccctgtccagtgggcaccgccccccatcgcctcatccctcccatgggcagtctcatccctgtccccagctgccactccctgtccactgggcacccccacctccccatcacctctcatccttcccatgggcagcctcatccctgtccccagctcagctgcctccatcgcggttgctcccttgcagcccaagtgcatgtgaagtttctgaccctcaaaccccctgaacttgcctctcccctacttctccatgtattgctgtctccccccttcacagccagttttccccaaaaagtcacctctactgtccatcttgtctcccgtcccccaccggctcctcagcctgcggcagacttcctctctccatacccaaattgaaactgctcccaccagggtcaccggcggcctccagggccttcctccccatggatgcatggccagcactcctgctgacctcagctggcatttggtttctttgctccttcttccgtgaaacgctcctccccaaagctttaggacaacacttactggttttcccctcctttctcagatggcacctatttcaaccctgccgccccagcctcccaaatatgggaccttttcaaggctgtgtcttcagcctccttcccctctgtgcctcaccactccccagccaccatcacactccacactcaccgtctcctttcctgacccagatggggacatgtaacaagccctgcccactgtgcatccctccagacatccactctcccgtcccctgcccac

SEQ ID NO: 152565 - DNA, 491 bp, Homo sapiens
cccaggctgcctaggctgcctctagctgctctgtcctcctgtcttatctggagattaaagaattcctttgttgacctctgcagggaacactctttgccttttaagagagaacttatgggacaaggcaatgcttatttaaggataatggctcataaatgatggggttttaggtacagtgcaagctgtcaaagggaaggcgtgaccttctcagctctcttcaaatgaccatccattctgtgtctatgcaggactcaccccgagaggaacgtggggctttaggaagctcagggaaggatctttccaaatgagggtttggggaggcttccagagtccttccctcagtataggacctcctggggcgctcctctgctcaccctcagatcccaagggccaggtctttaatcctagtgatgctggggtcagaaaagtgcagagacaatcaggactctcccagaaacacacatattctgtcacacacacacactttgacc

SEQ ID NO: 152566 - DNA, 386 bp, Homo sapiens
ccttcctcctccacatctcttggttggccaccttccggcctttctggctgtggctcagctcctccgtcacccctcactgcactgatctcagtggtcttttgattaccctgtcccttggcctctttcatgccagtatgagctcaccactctcctacttaagaaccacttagggccatcctcctttgtgtaacaaattcaggtggctaaagaggggagtcgcaggggagaaggtatgcaagaaggcttcaaatgttactgtttctcaaaatgatttaatggtgaaggtaggggtgtccctcaaagagaaagaggccagagggagcaagacatgacactaggggtaaactgaagaaattgcccctagaactgcccctcagcctgggtcc

SEQ ID NO: 152567 - DNA, 494 bp, Homo sapiens
ccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggaca

SEQ ID NO: 152568 - DNA, 191 bp, Homo sapiens
acaacaacaacaacaaatgtatcatgaacatttctctgtatcatgaaatattcttcaatctaactttttaggccaggcgcaggggctcacacatgtaatcccatcactttgggaggctgagctgggaggactgcttgggcataggagttgggagaccagcctgggcaacacagcaagaccctgtctctacc

SEQ ID NO: 152569 - DNA, 427 bp, Homo sapiens
gtcacctattaggatttctgcttcccgagggaaggtgcatgcctcacttggatgcatggcccatccccttctgtgtgcagttggttcgaccagcctttgaagatggtctcacatgaaagtcttattgggctcccattttggataacacgttcgcgagctaccgaaggtgttataatatgaaggttctgtcagtcacgtttattagagtatgacttttgagttatttgcagaatgactttcatctagcctgtcttattggtatgtatttatgattgtagtagttatccatcgttatgtaacaaatttaccccaaattttaacagcttaaaataacaaacatgcagtatgattttatacaatttgtaagggtcaggaatttaggagcaacttagctgagtggttctggggttctggttcaaggactttc

SEQ ID NO: 152570 - DNA, 716 bp, Homo sapiens
ggagttaatttattttttcctgggagatattcttttcaattaggatgtataatcctaacttttattcagtatgcaaggataagtgacttaatttttacagctgatcactgtgcattctgttagtgcagttaaaaattacagttctctcagaactttaaagcaaatgctacatcagtcaagattgggtgtctttgtttatctttggtatcaaagacccagagaatttggagaaacatcacacagcttgaaaagttatttagacaagctataatatcacatgactgccccctgagtggtaagacattgcccagtggatctgaaaacacttttaagtacttaatcatcatcgtatcttttttaaattttttatttcttatttatttatttttgagacagagtctcgctgtgttgcccaggctggagtgcagtggcacaatctcggctcactgcaacctccgcctcctgggttcgagtgattctcctgcctcagcctcccaagtagctgggactacaggagtacaccaccacacccggctaatttttgtaattttagtagagacagagtttcaccatattggtcaggctggtctcgaactcctaacctcaggtgatccacctgcctcagcctcccaaagtgctgggattacgcatgagccaccacgcccggtcccatcatcgtatcttcatgagatagtcaggaatggaatttgaatact

SEQ ID NO: 152571 - DNA, 124 bp, Homo sapiens
cactgtgcctggcctaaacttattttttttatagagacagtgtcttgctctgttgcccaggctggtcttgaacttctggccttaagcagtcctcctgtctcggtctccaaaagtgctggattac

SEQ ID NO: 152572 - DNA, 644 bp, Homo sapiens
ggacacacttggttgatagcgagcttttcatatatggattttgctgctgaaagaatatgaggtgatgctaagttaaccaaaagatgcataagactgtcagtagtttatagcttagaatctcacatttgaaaactttaagttatacatttgctcacaaacatactgaagtatgtgtgtgtgtgtttgtgtgtttacaagtttgatacctggaaaatacagtagagggaaaatgtgattctaaagaacacattatcagagaatttgatggattatttctcttggctagtctataccatttctaaaacatactgtaaaaattcaaagactaaatatcttacataattttagtagtattatcataaggtcagttgtcagtaggtaagcaaaggaaacacaattcttgtgtactgctctaatttgaatgtagatcctaataaggacctttttcttggagcactatatctctgaagtcttaaatgccacaaataaaaaacattgaagaagtagaataaagagtttcattttttctcttcctttgacaaagtcagttaaactgggatgcaactctcagtgctaaatttaaactaatatagactatcactgagtgttttcatttgtagcatttttgagacaaatgtggtttt

SEQ ID NO: 152573 - DNA, 130 bp, Homo sapiens
cactctgggccctcttcctctgtgtagccagagtaccaagtctgaaccacgtaatctgatgcctcactttcttctttccacccagagtttcacgcgtaagtctcacctctcctgctagattttaagctcc

SEQ ID NO: 152574 - DNA, 385 bp, Homo sapiens
attaagccatgtctcaaaacacataaacataccaagataatctcaatttgaaattaagaggaccctaattagacctcttaggactatttcattaccagctaaccttgacttgtatctatattctccatgtctagattggataaaagcacttgtgtgaatggaaaagataaggctaaggaagtctgtggtaggtatctcataaagtctcttcaatatttgacttctcagctttttggtccctacaccatctgtattgataaagctattaacaatagggcaaatatatctgctagccactaaattcttaaggaagttttaaaagaaaggaaaatagtatttactatctatgtgtcaggtactaaactaagcaatgctaggtactttg

SEQ ID NO: 152575 - DNA, 541 bp, Homo sapiens
tgagaagtcatttagaaatccttatacattctgaaaagtggctatttgtagatgccagtaatatggaacatcttgattttgaaccagagcaagacttttaggaagagtatcattgaaattcaaagaggagccttagttcaagaattcttagaaaaataatttccttaacattgccaacctcattgtgatagacagggcaacacaaagccaaagttaacgaggctctgacatttttaaagaacatattctaactttagctgacatttaaattagaaagcccagcagtgtagcggggagctgattgatttggaaagcatggatccaagataatgagggctctgccatgctcttcctagtgatgggtaataaatgagctcttcctggccaaaagcaaaggagatgaggcagttcctgcatttgaactgcaggcatttgcactgcattgagacgaaaagtcattcagatactgcttttcttctgctcactatagcaatattttcatattagccttcataatgagcaggaaaaagaccctggtaga

SEQ ID NO: 152576 - DNA, 375 bp, Homo sapiens
actaatgaccctagccttccagcagtcgtccctggaacctctgtaccacataccgtctcccatttcatcctctcagagctgtcctcggtgctttgcctttgtaattcttgcctctatctaaaaaacaaagtcttggccaggcgcggtggctcacgcctagaccttcttcttataatacatattaaaggatcaaagtagttctactataaaggaactcatttaactttgcttaacccaacagctcccaatgtaaaacagatctattaatattctgaggaaccacgttgtatgggtcaccagactaggaaacaatagtgttacaggaaaaagttgtgcttcttcactctctgatgattacacagcagcaaagcatga

SEQ ID NO: 152577 - DNA, 122 bp, Homo sapiens
gagcatgggggcagctggttgcctaaggagaaggcacctcagggaaggggactgtattcatttgttttcacactgatgtaaagaaatacctgagattgggtaatttataaaggaaacaggct

SEQ ID NO: 152578 - DNA, 701 bp, Homo sapiens
gtgccttctgccaggaaagaagtatctaagcacatgactgcagtatgaaaagaaccaagaatttacaactgtgtgaaaacacagcagacctgtaagtcagctggaaagaagttttggggtaccttgggggtcttcagagcatgacagattgagagtacttgggtgtaccaactgggtagctgagcaagtggctgatgggcaggcagtgactccagcttagagtgatgccagctctcactgcacagggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtaggtgtgtcttgggcagaatgaggacatgacacaagaaacgtgttcatctccattcttctcacttcctccagggggccaaacctgcaggttgcatttgagaccattccagaacgggtacctcctccagctcagtcttcagaaaagattctggccgagaactgggacatctttactgggacccacaatcaaacatgttttcatgaagttagaattctatcatcctgagtgcttccattagctccctgtttgctctgcatcccagaacctgtg

SEQ ID NO: 152579 - DNA, 4200 bp, Homo sapiens
agcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcaatctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaaagatgggtcgcttactggaaattattgtattgtctttattttattaaagcaactatgttttaaatgcaaaa

SEQ ID NO: 152580 - DNA, 5899 bp, Homo sapiens
agcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcaatctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaaggtgattccctggccatgcattgtttggtgtcctgtcccagggttgtcccttcagtggctgggttcctctggaggtccagcaccacatacctgggcaaagtattggggactgactttgaatggctgcatctccagtcacagccagattctaggggggtgtcatctctgggaagtgtctaggagctcctctgttagaccctaacttctgaagacccacgtctctctgtctttctgtctgtctctctcacacacatacacacacagacacctctttcaggcacacacacacatctctcttcctcttcctctcttttatacatgcacacacacatgtacacacacataccttctctcctcaagagaccagtggagagtcccaagtttcacaaggaaggattacagcctctgtgctttggccactggtcctcctaagcagggcaggggactaagctaagcactctaagcaggcagccagtagctaagaacatgtgctctggggcagatggcccaggagtgcattccagtcctactgcttcctgactgtgtgaccttgggcaagccattgaacctccttgttcccacggggattggaatagcattgaatggatgctactacagatttgtattgatgcttagataaatgagcctgcagagagttggtgaggaaaagatgaaaaacatgagaaataggttgagccagtgaagggagccatgtgatttagggagggaagagggtcactctggccctattattgagaaacagttcttccagggaccaggggctcctcaacaaggccagtcagcaagagcgcaatgagatgggccaccttcggtgcccagcacatagtggtgattattagtccatctcttctgaccataattcagtggcttccttggctgccaccaaggctcagagaggctctatagaagcaggagtccactggggtgggggtggttccactggggtgggggtggtcccaaccagcccaggagggaggatctcccagatggaagcagaagagagggtgaggctgggttcctagggccatgtatgtatgaagtcgggtgccagtgtcatctgaggacatgcactgccttggggaaatcccactacactgaacaacatgcaggtcccaaggagtatgaagttaagttttcaatggttttagtggtgtccttttttatccttgaagtccaagaacagtgtcattggcacaccccaccctggtagataaggtgctactgctcttggctctggggaccatgcctccatttgccccaggactggggatccgctgctgcattgaagtccctgggcagtcaggcacagcccctgccctcatggaaagggacatgaggtgcaaaccacatcaacagtaacaagggagctcaaatctcccatgtgggctccaggagactgatgcagatcttaccagccacgggtcctggggatccttcctgaggctcagtttcttcatgtgtaaggtatggaagacaatggccctgccctcaggcttgtgacagtgccatgaagtggtgtctgtcacacaggcaggcaacaagccagcgctgaggcaggagtcctggcagatgctggtgccactccgagcacacacactgggccttgctttaaggggcctggctttactctctccctttgatctgagcagccccagaaggtaagggccattgatgccacagtcccttccctatggggagagacatctcacagtcttatcctggagcctttcctgaatcctgctccctctcttcctcctgggtggtagggtcaggaagagggtggttctcccacttcacccagcacagggcaaggaagggagtggcccccaccaggaggaaggaaaggcccctacgtggtgggtatggtgtgcacagtcttagaaactaggctggcctcagtgttttgagtcaacaagctgcaccaggctctgtgccaggggacacacattgaaaggggcatggttttctctactccatgggaagaggctagggtctgaagagatggaatgacttcaccagcataaccagacttggaatgaggtctgggcagctccaaatcccgtgctgtgagccatattccagctggggctgggggtggctcccagagtggagctgagggaggatgggaattgtgcctccctgtgactcctgccccggggcccggctacagtgggtgctgtccttctgtgcataagttcaagtccagtgtgtctgcctgtcactcctgcccagggcccagctgcagtgggtgctgtccttccatgcttaagttcaagtccagtgtgtctgcctgtgactcctgcctgggggcccagctgtagtgggtgctgttcttccatgcataagttcgccatactaactggggtgtagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaaagatgggtcgcttactggaaattattgtattgtctttattttattaaagcaactatgttttaaatgcaaaa

SEQ ID NO: 152581 - DNA, 6590 bp, Homo sapiens
agcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcaatctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaaggtgattccctggccatgcattgtttggtgtcctgtcccagggttgtcccttcagtggctgggttcctctggaggtccagcaccacatacctgggcaaagtattggggactgactttgaatggctgcatctccagtcacagccagattctaggggggtgtcatctctgggaagtgtctaggagctcctctgttagaccctaacttctgaagacccacgtctctctgtctttctgtctgtctctctcacacacatacacacacagacacctctttcaggcacacacacacatctctcttcctcttcctctcttttatacatgcacacacacatgtacacacacataccttctctcctcaagagaccagtggagagtcccaagtttcacaaggaaggattacagcctctgtgctttggccactggtcctcctaagcagggcaggggactaagctaagcactctaagcaggcagccagtagctaagaacatgtgctctggggcagatggcccaggagtgcattccagtcctactgcttcctgactgtgtgaccttgggcaagccattgaacctccttgttcccacggggattggaatagcattgaatggatgctactacagatttgtattgatgcttagataaatgagcctgcagagagttggtgaggaaaagatgaaaaacatgagaaataggttgagccagtgaagggagccatgtgatttagggagggaagagggtcactctggccctattattgagaaacagttcttccagggaccaggggctcctcaacaaggccagtcagcaagagcgcaatgagatgggccaccttcggtgcccagcacatagtggtgattattagtccatctcttctgaccataattcagtggcttccttggctgccaccaaggctcagagaggctctatagaagcaggagtccactggggtgggggtggttccactggggtgggggtggtcccaaccagcccaggagggaggatctcccagatggaagcagaagagagggtgaggctgggttcctagggccatgtatgtatgaagtcgggtgccagtgtcatctgaggacatgcactgccttggggaaatcccactacactgaacaacatgcaggtcccaaggagtatgaagttaagttttcaatggttttagtggtgtccttttttatccttgaagtccaagaacagtgtcattggcacaccccaccctggtagataaggtgctactgctcttggctctggggaccatgcctccatttgccccaggactggggatccgctgctgcattgaagtccctgggcagtcaggcacagcccctgccctcatggaaagggacatgaggtgcaaaccacatcaacagtaacaagggagctcaaatctcccatgtgggctccaggagactgatgcagatcttaccagccacgggtcctggggatccttcctgaggctcagtttcttcatgtgtaaggtatggaagacaatggccctgccctcaggcttgtgacagtgccatgaagtggtgtctgtcacacaggcaggcaacaagccagcgctgaggcaggagtcctggcagatgctggtgccactccgagcacacacactgggccttgctttaaggggcctggctttactctctccctttgatctgagcagccccagaaggtaagggccattgatgccacagtcccttccctatggggagagacatctcacagtcttatcctggagcctttcctgaatcctgctccctctcttcctcctgggtggtagggtcaggaagagggtggttctcccacttcacccagcacagggcaaggaagggagtggcccccaccaggaggaaggaaaggcccctacgtggtgggtatggtgtgcacagtcttagaaactaggctggcctcagtgttttgagtcaacaagctgcaccaggctctgtgccaggggacacacattgaaaggggcatggttttctctactccatgggaagaggctagggtctgaagagatggaatgacttcaccagcataaccagacttggaatgaggtctgggcagctccaaatcccgtgctgtgagccatattccagctggggctgggggtggctcccagagtggagctgagggaggatgggaattgtgcctccctgtgactcctgccccggggcccggctacagtgggtgctgtccttctgtgcataagttcaagtccagtgtgtctgcctgtcactcctgcccagggcccagctgcagtgggtgctgtccttccatgcttaagttcaagtccagtgtgtctgcctgtgactcctgcctgggggcccagctgtagtgggtgctgttcttccatgcataagttcgccatactaactggggtgtagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaaagatgggtcgcttactggaaattattgtattgtctttattttattaaagcaactatgttttaaatgcaaaa

SEQ ID NO: 152582 - DNA, 440 bp, Homo sapiens
cactactacacccactactcctcggccatcatcgtggcctcctacctggtccggatgccacccttcacccaggccttctgcgctctgcaggtgagctgctgccactctctgtacacacacacacacacacacacacacacatacgcctgtatcacaagactaagacctgtgcttgaacaaagacaggatgcctctgctaaaaactcagtcattagccagtgattcccagttgacattggctccaggattctggctcaccagccaaggcaggctgttcttcctcagttacacctgcacatctgcccaacaaagtcttgcaaaatgattctaaaaaataagaaatgagacatgaaaaaaatgatttaacataaataagatttagtggaaaaagaaaaagcaggaaacttggagactagaaaggcaggcggtcaaggattaga

SEQ ID NO: 152583 - DNA, 434 bp, Homo sapiens
tcaaccaggcatggtgacactcatggacatctggacaaccacagcatactacatttacacagacggtgtcagtcacaaagacactgttaagagactcaatgtttgtctcctaccaaattcctatgttgaacccctaatccccagtgggatggcacttggacttctccaagtgcctttgggaggtaattagggttagaggaggtcatggagggagggccatcatgatgcgattagcgcgcttattggaggaggaagaagctgggtgcagtggtccacgcctgtaatcccagcactttaggaggctgaggcaggaggatcacctgaggccaggagtttgagaccagcctgggcaccatagagagaccttgtctctactaaaaataaaaaataaattagcgaggcatggtggcgtgtgcctgtagtcccagctatta

SEQ ID NO: 152584 - DNA, 593 bp, Homo sapiens
aagggctctcacgaagagcttcctgcagacactgggccaaggggagggaacagccagtgagaaaccatgccaccaaagggctgtccagggccaccaattattcctcacattccagttggagtgtgctgggggcctaagagtaaatgaggctgcagccaggccaggagcttcctcacacgttcaggaagagtccagactttgctcctgatgccctgagaactactgatggagttttcaacagagagcattttaatatgcttgtcattttcacatgattttctacagtctgagacaaggaaagcagtcagaactttgctgcagataagtaataatttgcaagtgccctgcatattttttgtagcatatgtatttgctgaaagcttatcagataatgtatgagggagtggactataaaccaccaagcctcccagaagcatgcagagttgttctcacattgaagctgagcagcgtccccggatgccactagattagaacagggtatcccaacatcagacctgagattaacagtaagccaagcaaacaaaaatctcggtctaagatccaagagaccagattctagacccaactcaaat

SEQ ID NO: 152585 - DNA, 428 bp, Homo sapiens
gcgttgatgatgctaagtttgatcacttgatgaaggtggcatccaccagctatttccattttaatgactagtatcttttcaagaatgtgtggccttttgattggtcctgggtgcccctgatactttgtttatggtagcctttcagctagctgtttgacaaagctggcaaaggagaagtaacttttgatcagaaagaggatggtaccagcagtctacaggtgtcatcccagtcactgttccctggtcccaatggtaacaactgacatttatcaccatcaattggtttttcctgtttttaaacttaattggaactatacagaatgtactctttcagtctggcttcttttgttcaacatttgtgagatttatccatgctgtattttttatttttcttcactgtatagaattccgttgtgtgacagcatatc

SEQ ID NO: 152586 - DNA, 133 bp, Homo sapiens
attctgctggtttggctgtttgtctgcttctctgcaaacccaggctctgaccttgaccaggcctccagcacagctggccatgtggccttacagtgtcatcagcctggaatttaatcttgatagtgaggaccca

SEQ ID NO: 152587 - DNA, 594 bp, Homo sapiens
tatgtcatctcagctgggtctcatcctctaaggcaggcacacccacgaatgctccatttgacagatgcgtaaaccaaggcttagtagggaatggacagtcaaaggtcatgtgactaagagtgacagtgtgagaggaccaggatccttgaagaccttcaaacactacaatttttctttcattccagtaacttctagagcacagcctgaagaactacttagaagtctgaggcagaggctccctagaatcgtactcacagaatcttggaagttagaccttgaaggccaggattcctagaggatactacttttggtcctagcacccacaggaattgtttcttcctcctcccctcattcttcaccatcatgaccattgctagcattgattcagtcccatggaccagacacaatgattactcctccccctgctctcatttcacgctcatgaccatgctataagataattaccattatacccattttatagatgggtaaaccaaggctccaggaggcttgaacaacctgcccaacatcaaacaactagttaagagatggagataaggccgggcgcagtggctcacacctgtaatcccggca

SEQ ID NO: 152588 - DNA, 587 bp, Homo sapiens
caaacaagtataaatattgacaacaataagaacaacatttaagctattcattctataatataaagttaatgcaacaaggcgttcttgtatttttaacttttatttaatttctaaatggcagaccaaagaattcccacaacgaaatgatttcatgttgctgtttttctttgtaaattagacttactaaaactgaagagaaatcatcatctttggcattttttttaatcaaggtagcaaatcagagttccaattgactttagagtttatctgtccaatttcctcattgcagaaatgagcagaggccttgagaatttactgaatgccttttcctgggtcatacatacaaaattggaattccagtcacctttgttcttttaacaaaacacactgcctcttaatgcctccatgttatgtcaattacttcatttgaacttgactagtgtgtggagcaacctctagagacaggcagatttaaaaatcatttaggtgatattctaataacttacatataaattccctgatactagtagtttatacatatttttgcgaagtttgtataaaaataatgaaatcattaacaaaaatac

SEQ ID NO: 152589 - DNA, 391 bp, Homo sapiens
tatgtatcccagtggtctcaaactcttggctcaagtgaacctcctgcctcggcctcctaaagtgctgagtttataggtatgagccactgagactggccgctctaaccatctttccttctgcctatacgctgcatacttagggtggtggaggggaagggtaggtgcacgcacacggacacacacctcggctatcctgcgtgtttatcacctcagctttccaccctccaggcttgtcacaaatggaaaaggagcgaagatgctcagaatgctgagaaaccaggacgccaccaaccacccccagcattcacagccctacagcagtttacagcttatgctgcggaggccctgctttctcttggtcatttcttgctccgacccttcagaataggta

SEQ ID NO: 152590 - DNA, 283 bp, Homo sapiens
tattcaggattgacacagttccttagggtactgaggcaacagagggtcataataggatcttgaattcagttaccattgaggcctgatctagctttgccacaaaaaaaaagaaaaaaacatattatctgacaaaggacggacatccagatacataaagaagttctggccaggtgcaggtgctcatgcctgtaatcttagcactttgggaggccgaggcaggtggactgcctgagctcaggagttcgggatcagcctgggcaacacaggaaaccccatctctact

SEQ ID NO: 152591 - DNA, 167 bp, Homo sapiens
tacgccggtcgcaagtcccgggatcacagataagagccaccgcgtccggcctccagttcccttttcaaagcaaggaaccagaaatccagagagccagctagaattccaaattccatccttcctttatgttatacatttgaccaagttgagagtttcagagtatcttc

SEQ ID NO: 152592 - DNA, 469 bp, Homo sapiens
cagtgggtgctggctcctcaccactcagcctggcacacactgtctctgagcagacctgggagaaggcatgtgaaacccacctagccctggctggaagagaagtgggggagtggaaatgaaaagtggggactgggaggagctgcccacgtgccctccatggttccaggatggcactttcatgctgggagtgagcttgccctgtgccaggctgtcattgagacgttttccattcaacaactgtttctcagacaaggcacaggcaggttagctctcccaggccactcaagtagtaaggaaacagatttaaacccagacaatttggctccacggctaaggcccagagaggggtggtgacaagcctagggtcacacagccacagccccagagctaggaactgctggctagggcaagcagacagctgaatcctagccaactggaggtggagcagaggtggagccagggagaccca

SEQ ID NO: 152593 - DNA, 191 bp, Homo sapiens
tcaggtactgtcagcttctggaagcctcccagttacactctcttccctacctgaaccacctcaggattttgttggtgtccccttgatggcattgtttgtactctgaatgatattgtagttcattgtaagctcttctcacctctttgcttttccctgctagagggttatctccctgcaggcatggacttgtg

SEQ ID NO: 152594 - DNA, 424 bp, Homo sapiens
cagcctctgcctcctgggttcaagcgattctctcaaaggagaatctttttatgttatttatttattttgagccacggtttcactctgttgcccaggctggagtacagtggcacgatcatagctaacctgcagcctcgatctcttgggctcaaaccattctcttgcatcaccctcccaaatagctgggactacaggtgtgcaccatcatgcctggctaaagttttgattttttggtagagatggggtcttgctacactgtccaggctggggaatccttttatttaaaaataatggtatttcttcaaagaatagcttcagcttggaccaaaccaattttccaagactgaacagagacaaggaggagtggcagccaatgtagggaatatctggagctggaaaaagagcaatgttttaagtaagggct

SEQ ID NO: 152595 - DNA, 207 bp, Homo sapiens
gtagaggggagcagatgatgtggaaaggaaactagcttgtgatcaaaggttttaggatggaggggagaagaggacaagacaaggaaaaaaggatagctgggaaaaatgacaaagaaacagaaagagatggagggagagacagtgtcacaagaattattcagagaaaagaaaacagatcttctaggccaggcacagtggctcccgctt

SEQ ID NO: 152596 - DNA, 251 bp, Homo sapiens
gagtctaggaggatccccatcgcggtgagccatctgatgagcttatgaaaacaatttttgaaactgagtagtctaagccaaaagtgttcaggagtaccaaatctctcacaaaaagtgtcaatcttagaaaccttagaagtattctgagatgcaggaggtaagaattaacggacaagaagcagaaatattaaaacactaacactcttggtttgagtttgagctgttaaacttcttgcaggcctggcacggtg

SEQ ID NO: 152597 - DNA, 399 bp, Homo sapiens
ctgtgcctgggcactggagggtatggagaggaaagacaacacgtgaggcggccatgctgctgtccccatgccgatgatgcccctgccaggaaggccctctgccctgctgggagcctcactttcctctggtctgtccactgcagcctttaaaactatctgttctcctcattcatccctcgtcctcactcatagctgacgactttgcttccaatttcagaaaacagaatgaaatggaagagaactttccccagttccctccacaactcacctgccagcctctgtgcacagggactcaaggctgttccagcttctgtccgggctgactcccaccatccccatccttcagtatttccccccaccccacagttgggcccttcctctccctctcgatcagcgttc

SEQ ID NO: 152598 - DNA, 337 bp, Homo sapiens
tatattcttaatgtattagtctcgtgtgaacactaagagtgtattaaatctggccagtataaaaaggcctttgttatctggcagaaaaatgtttttaaaatttagtatgatatattaaagacatataacaaagcatagtaaataataagataaattcctgtgtatctaaccagtactgagaaaggctttctgcattctgccaccaaggtaatcaccatccagtattggtctgtatcattcctgtctatttagttatattttttctttatgtataggtatcccttaacgcatgctattgcagtttcaaatattttatgtagatggtgttctgttgttt

SEQ ID NO: 152599 - DNA, 616 bp, Homo sapiens
actgtctgtcttctctaataccgttatcaaaaggaagaatcactatcagcatattgtcatacgatctgttaagttgctacagaagtacctggaagaacatgtaaagactatcagaaataatctaaaaaaagatttgttacttcttggataatcatgaaagtaaataaaattttaaatacctcagcgtcatctctttccaaagtacttcgttgttgaggtattttcatggagtgttgtttggtgcattgtgtatcatgcctttcctaactcaccattaattttcccttaaattcaaggtatcatggagctttttttttttgagacgaagtctcgctctgtcatccaggctggagtgcagtggtgcgatctcagctcactgcaactgccaccttccgggttcaagtgattctcctgactcagcctcccgaatagctgggattataggcatccgccaccgtgcccggccaatttttgcatttttagtagagatggggtttcgccaggttggccagactgatcttgaactcctaagctcaagtaatccacccaccttagcctcccaaagtgctgggattacaggcgtgagccaccgcgcccagcctggagcttttacttc

SEQ ID NO: 152600 - DNA, 1103 bp, Homo sapiens
gaaaaggtcataattgacaggtggttcctggggtcctgagatccagcccaagggatgggacgacatgctaggaaggggaaagtgacagaaggttcatatgcatcacacaccactttgacaaacccatacatagcattcactatagtgaatagaaaaactcacgaagcaccatagttccagcactttgcaaatatcccccacccaatacctttgaggtgagagttaccatcattgcctagttactggtgagaaaacagaggttccatgacgtgcctgaggcactgagggggatgatgtcagcacttgtggccgcacgtgcaggcacacgccctccatgtcacaccagtgcactcactttgcagatgaggagcgatgcctgagcactgggatggcatcattggcttgtgttggacagtgcctatataggagtccagcttctacccacttgttccagtctatccacattttccaccaacagaacgagtttactagaaacctctcctcaaattggtacaaggactacatgacatggcatgtgatgacacacacacagaggagatcctttttccagcatgcaggaagaggagatcccatacatgggcttgggggtggcttccctcactgcagtgtccggtcccccagcagctctgggagcaggagtgactatctccgttttgcagatgaggaagcagaaccataaaggtgaccttttttctttttcttttttacatttaaagttaaattggtctcccctcaaaaaatgcttagacttaattattttaattatcctcacatatactcctccggcttctttactgaagtgtaatttacacaccataaaacttaccatttgaaaacgtgcaattcggtaatctttagtatattcataaggttgtgcaaccaaccaacaccattatctaattttagaacattttcatcaccccgaaacgaaacccatacccatcagcagtcactcttcgttacctggtagtaattacctacccctaccctcagcccttggaaaccactaatgtactttctgtttcttcagttatgcctattttggatatttagtataaatgggatcatacaataaatggcct

SEQ ID NO: 152601 - DNA, 598 bp, Homo sapiens
tctgcagccaacctgaaagaataacaaggaggtggctggaaacttgttttaaggaaccgcctgtccttcccccgctggaaaccttgcacctcggacgctcctgctcctgcccccacctgacccccgccctcgttgacatccaggcgcgatgatctctgctgccagtagagggcacacttactttactttcgcaaacctgaacgcgggtgctgcccagagagggggcggagggaaagacgctttgcagcaaaatccagcatagcgattggttgctccccgcgtttgcggcaaaggcctggaggcaggagtaatttgcaatccttaaagctgaattgtgcagtgcatcggatttggaagctactatattcacttaacacttgaacgctgagctgcaaactcaacgggtaataacccatcttgaacagcgtacatgctatacacgcacccctttcccccgaattgttttctcttttggaggtggtggagggagagaaaagtttacttaaaatgcctttgggtgagggaccaaggatgagaagaatgttttttgtttttcatgccgtggaataacacaaaataaaaaatcccgagggaatat

SEQ ID NO: 152602 - DNA, 167 bp, Homo sapiens
ttctatgctggggtcttctgtcataaaagactgaactccaggccaacttccccttcggccttgcatctgggcaggtcaacagaagactaagaaagcctgagtgctccctcctatggcccagggtggggttcaaacctcacaaggcccagcccagcacaagaaccaca

SEQ ID NO: 152603 - DNA, 331 bp, Homo sapiens
tctcctccaccttctccattgaagaatctgtctcaaattcaactataagccaattcacattacgattagcacttcagaaatttctgtacaataaaaatattgccaaaggcagctaatgtatttgcttattccaaaacaagcaaactattaaacaatctgaactttattacaactttcatttcatttaccggttttcatcattccacaagcatctacagaacgctaagcttagtatatgccgatcattgggaatacatgaataaattagggctgctgccctggaaaaatttatataagcggagaaaactgacattttaaggatttcaaaatc

SEQ ID NO: 152604 - DNA, 484 bp, Homo sapiens
agctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataattttatctctcataaagacatagaagcaaaatatatgcctatttccacttaggaaaggcttgggtgaattcgcgaagaatc

SEQ ID NO: 152605 - DNA, 315 bp, Homo sapiens
tagtgtccagaattatcactaaccaggcttggcaaggttatgacttgaggtgctctgacttgtagctgatcatatcacgtgtttaacagacgaatgtatctgagtcgtgggttttctactctagcatttccagaacatgaatcagccatcacagctcacgagatctgttagtgactgggcatctgtgtagcaactgcatccagcttaattctagttactcctctagcttgtactccacagcattcagctgttcagctgcacagcattcttttgtctcagttaacatcatgttttgtaattattccaatacttgtt

SEQ ID NO: 152606 - DNA, 269 bp, Homo sapiens
gtatgtgtgcaatatgtatgtgtgtgtgtatgtatatgtataggtgtataaaggtgtgtgtgtgtatgtatgtgtataaaggtgtatgtgtttgtatgtgcgtgtgtatgtatgtgtataggtgtataaaggtgtgtgtgtgtatgtatgtgtataaaggtgtatgtgtttgtatgtgcgtgtgtatgtatgtgtataggtgtataaaggtgtgtgtgtgtatgtatgtgtataaaggtgtatgtgtttgtatgtgcgtgtgtatgtat

SEQ ID NO: 152607 - DNA, 648 bp, Homo sapiens
ggttctgtgcagtcccatgtgtttgagctttctggcgatctggctctagaaaactgaagtgtcattgcaaaatagattgggatacttggtgtcaaaagcagtatttcttattctttttaaacctatacccctttgatagatatgaaaatctcataccatagctgtagtaatattgaatatgattttttcaaactacatatggtttatattcccctacccccacctacggattctcataggctcctctacatagttatgcccttaaggaagagagtcattactttaaagaaagtagcaaaatacacctgaaatgttgatttcttcatcatttctatatgggaatgtaggctactagagagaacttttacctatttattcattcagcaaacatggattgagtatactgtatgcaagctctttatggtacaaagataatgatgataggccacgcaaaaacttgtatgagagtgttaacagcagcattatttacatagtttaaaaaactagaaacaattcaaatgtctgcagactgaagatatttaaacaaaatataatcgcttctcggccttttggctaagatcaagtgtaaacaaaatatatatccacagaatgaaatactatttggcaataaaaggaactcagtataac

SEQ ID NO: 152608 - DNA, 578 bp, Homo sapiens
cctctttagcacctgcaactcttaccaatagataataaataaatgccattatcctgctcatttctgcctctactggcaaataaaagtgtccagcaggaccatatgaaatgctgaaacccatgatcctaaccggtcaccctaacccacctggacacacacactattgatgaacccctgtccctgtggctgtatctgatttttgttaacccattgaaaatatgtggctttcttcctctccatactaatctgaatccattctgtaagatttcatgagacacgctaactgctttctaatatctatgtggtattgcctcctggacccaattctgtaaggtgtttgcaaatgctattatacttgtccgacatggtttgttctcaataatctcagagctttttaatttatttattggaatgccatggcccttgtttgttttcttattctttgcttgtttatcaagtgcacaaagtatctttttcccccacagccccagagtgctgtgcagttgatctccaggttagggaagagcagaggacagagccgaaaagcaaggaaggctgcacacgggagagtgtaggaa

SEQ ID NO: 152609 - DNA, 194 bp, Homo sapiens
taggagctgcatgttctcacaagactaagttgctcagagttaagattaggtttagagcgcattaactccagcaccgaggaacactccattgtggactgagtagacactaccatgagctcaagcgcccaagtggaagaaagcgtgtgtggatgccatgtgtgcatgaacatgtcacaccttacatgatgacttgc

SEQ ID NO: 152610 - DNA, 407 bp, Homo sapiens
cggtgtatatcgatgcacccattccagccaacctgtgactagtacctccaaatttagaaaatgaataaaatgaaacattcacaagaaaaaaaagtaatatcaccgcttctctgaccacaatagaaccaagagctcataagaaagagaaatttggaaaccaatggggaatcctcaagatccaacctgtagagttgtaagttggggagtggcctcggttgaaaagcgtcgtggtgtgcactacagctttatcactaagaatttttgcaatgaataaataaaaaatggttcttcagcttctctagggaaagacaaataagtctgggtcctactgaacaatacatcaaagaactatccagatgtccagatcaaaagaaaaaataattagaaaattgtataaagatgtgtag

SEQ ID NO: 152611 - DNA, 468 bp, Homo sapiens
tatctgaaaaatgaatagaatggtgtgtgaatatatgcagctcacccttctagagctgaaatcctgcttgcttattcaagaatatgggttaggttgctgggcaaatcaaaacaactagtgctgggccagattctgaagaccaaagcacttaaaaaaaatcagagagcctataagctcttcattttttattctgtgatagagaatctagcgatcatattcctattcaagactgttagggcctctttcaggtagttgtcagtgccaaagggtggagaagcataaggtttcctaaattagagaagaaacttaaatgtactcaacacatttagatcctgcctggattttcactagcctctgatttaattccacaccaaatgctactgcataactggacagagcaaagcctctagtatttacactggaggctaaggtctgacattctgtctaaatgaaatttcccagttgtcc

SEQ ID NO: 152612 - DNA, 399 bp, Homo sapiens
  misc_feature (1)..(1): n is a, c, g, or t
nttccgcccgcagagctccaccgctgaggccaacgaggccaggtgtttatttccagatcattttatttccgtcattcctattatgtctttgactcaacaaaccctagaatttgtttcagaattaatctcagactgatattacatgtctgaaggctttgtaacaagaggttcgtgtgctttcctaagccacaacatactctgaaactttaggaattcaaggccggaaggtcatttttctctctcctttccctttcagtgcttctggttgcttcccgagaattctgatgcagagtggtattagcccacccccagttaagaggagtgctctgaggggttcagttcttccaaattatatctaggcctttcacttctcttttttatctccttttcatctgaaaa

SEQ ID NO: 152613 - DNA, 1089 bp, Homo sapiens
gagctaacctctgctcctagagccgctctcatacttctgtactcctcaggacctttgctgttctgaattcctccaccttgaacatcctcccttctaccctgatcctgtcaaaacccaacgtccctcaggacctaatatcattccccatcccccgggtgaaaccctttccaggctctcccatgtataccttccgacagcacttttttttttttttagagacagagtctcactctgtcgcccaggctggagtgcagtggcgcgatctcagctcactgcaacctttgcctcccaggttgaagcaattcttctgcctcagcctcccaagtaactgggactacaggcacacgcttccatgcccggctaattttttgtattttagtacagagagggtttcaccgtgttgcccaggctggtctcgaacccctgagctcaggtaatccacccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctaccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattgttgtggctaccaaggaaatcagatgatcaaatgcaaaacttcctccatcttatttctatatgatcttttttttttttttttgagttggagtcttgctctgttgccc

SEQ ID NO: 152614 - DNA, 724 bp, Homo sapiens
gcagattcgtatcgtttgccctaaaatgtgtttcccgtataaaaaaaataaaaaaaaaaaaaagacttgctatccacccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctaccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattgttgtggctaccaaggaaatcagatgatcaaatgcaaaacttcctccatcttatttctatatgatcttttttttttttttttgagttggagtcttgctctgttgccc

SEQ ID NO: 152615 - DNA, 669 bp, Homo sapiens
ggagagacggagtttcaccatgttggccaggctggtcttgaacccttgacctcgtaatgcccacctaggcccacccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctaccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattgttgtggctaccaaggaaatcagatgatcaaatgcaaaacttcctccatcttatt

SEQ ID NO: 152616 - DNA, 439 bp, Homo sapiens
tgcggtactctacaggatcctcacgtaatatgtaaccactattacatataaagtaacaagggaatgtaattttaagcagtagacaagctgaattaaagcgtgaatacatgactcctatactttaaagttacatcattgctttgctctacaattctcaattacattcaaatctatgttcactgtttttgaaagctaaagttagaaaaatatcttaacatagtatgagagagaaagaatgtcttccaataatctttattctaagacataaaacacgaaaaccctaaaataatgtcaaactgttaccctttacaatgaatggcttgtgaccatttcaatttagaggggattgtggaaaaccttttttttttttttttttagagaaatggattttgcgctcttgtggtggagatacattgtcaggatgtcgcaggtttggtac

SEQ ID NO: 152617 - DNA, 142 bp, Homo sapiens
taggatttgagaccagcctgggcaatattgtgagaccctgtctccacaaaaatacaaaatacaaaataaatcatcattccctagggcctctggcacctctataggcatagtctccggcaggatttcagaggtgctctccagt

SEQ ID NO: 152618 - DNA, 830 bp, Homo sapiens
atactgcatgatcgtcatttatttgagggatctaaaaaagtcaaactcatagaagcatagtgtggttgccaggagccaaggtgggggtggggcaatgaggagatgttggtgaaagggtacaaagtttcagttagacagggtaaataagagtgtactcttatacagcatggtgactacatttaataacaatatattgtatactttaaagttgctaagagattagatcttacatgttcttacaacaaccaaagtatgtgaggtcttggatatatcaattagcttgatttaactatttcacaatgtatattatatcaaaacatcacgttatataccatatatgtacaatttttatttgtcatttatatgttaataaaaaataataataagtaatctgagtctttaagaaaaaaagaaaattatctttacaggataagttttcagtttatcaacaaaaagaaagatttaagcagaacttttacttatctctggaatatctttttatcaagataaggagatgaaaaataaattcttcatggaaaccaatttcaaaaggctataccactcttttacaggaaatactgtttcacaccattacatgtaataagaattgattgtgaccagctcagtttggtaatacaggtgcaatatagttgcaataattacttctgacactgtcacaagcatcaaaatgtttaacaaatatttcacaaatgtgaaaataattctaataagtgatttttcacgatatttctttgttatttggtaactgtagcaaaatgccagatgattctcattaccatagaagtcaattggcaggtgacaaataattt

SEQ ID NO: 152619 - DNA, 206 bp, Homo sapiens
caaaaccagatttctttaagtagacagaaaaatcaataatgatacagaagacttaaaccacactatattaaccaatttgacataactgacatatacagaaatctccatctaacagcaacagaatacataccattttcaagtgcagactgagtatgtatcaagagaaaacataagggtcgtaaaagaagtttcaacacatttaacag

SEQ ID NO: 152620 - DNA, 458 bp, Homo sapiens
aagaattccaggaagaaagaatgctgaaaaacaacatttggagaaataatggctaagaatttttctgaattgatgactttttttttcagatacaaggaagtttataaaactttcccatgtattaggcaataaagtaaaaactaataccaaatgtctgatactatacagaccacaatatctggctgtcgtatagtcaaagtagaaaagaatgatagcaacaaaaaaatcttatatatttggagatttaaaaccatacaaataatacattctttaaaagaaagagcacactattaaactgtaaacagtttaatactggcacaattgagaattttttttaagatactagtatgaagtgctttatgtcattaaagttgaaggcatcagtggccaattttatagaaatgcataatctattaaaacggactcaaaaagtaattgaaaacctgaagagatctgta

SEQ ID NO: 152621 - DNA, 416 bp, Homo sapiens
tgaaacttctgcaaatttaacactttaatatcaactttagctgaactttctaaatatcaagacccagacaaaaaagatcaaatgctgtgaatgttcaatttgcttacattgtttagctggtccaaataattcatagatatcaaagtacaaatatgggttgaatgaaaagagcagatcattaattatgctggaatattagaaatggtataaaaaactagaatgtttgtttttggaggaaacaaaccatataatgaaattaaaaagaatgaaatctatgctactgctgtcagaatgaataaagtagtttatatgtatgatataaatggacaaaaattaaggaaaggtggcaaactacagaaggtgagttgaaatatattttcagatagtaataaatacattatttcacgtgtgttccg

SEQ ID NO: 152622 - DNA, 391 bp, Homo sapiens
ctatagatgaagtgaaaagaaagtagtgggagggcacatgagctggcaggaggtctcttgtgagccgtttcctttcttctctaataataggaatgctggcttacaggcagttttaccccctgggatggcaaagccctctctgtagttattcttagagatgctggttatattggccgagggaagcttgctgatcggaaaacacagggctgagaaacctctggaaactcgttgcagctcggatctgaaggttgagtgctaagagtccacagagatcaagctacatgcaatgattgtgcttgcaggaaaggcagggtactgtggaattggtgtcagaggattcgaaatcagcttctaactagctctctgggtttgaacaagccactccccacct

SEQ ID NO: 152623 - DNA, 283 bp, Homo sapiens
  misc_feature (1)..(1): n is a, c, g, or t
nctagagctactccttgctgctcctagtgaagaaacaggggcgcgtttgcttccccttccaccatgattataagtttcctgaggcctccccagcaatgctgaactggtcagcccttttaaaccttcaactgaatacaaaacatctgagaagtttttccacgtatgactggagaggcattctttgctagcggtcaaagacaaggacaaagaactacccccaaaacagtttgaatgaactatgaccagaagctggttttgaataaagctgattttctatacctct

SEQ ID NO: 152624 - DNA, 189 bp, Homo sapiens
tacaacactcctaattcatctcaaagatctcacactctgagctttccttcttgaacccaatccatttctgctccatcctgtactgaagggcacgccatctccaccatgatgactcctgacttcctggcctggctacagcagcctggcttctgccccaccaatgccccagcctctctccaagggcaccag

SEQ ID NO: 152625 - DNA, 516 bp, Homo sapiens
tctgttgctccaccagccacccagccccacggtgggccttgcctcgtctgttaggtggtattttcatctttggtcagatgacagcccccatgctccaaaaattctcctgcagccagggcttggagaatcccgacccctctctggcatgaacctctcctcatccagggtggcttgtgtggtagagccaggggaatggagaagatgacctctgaagcctgaaggctctttgggaagcaggacacaaacatcctgaagagccagccttgagctggctgcacaagagactcatagactttgcgtcaacatccacctctccaggctgcagtgggtgtacctgttcaccaccacctccagcagcactgtcgcagcggagcagttcttacagccaatgagcttccacaccacctccctgcagttctctgcaaccgaggctccatcctgcactgatgggctgcctgacacgtcggcctcaacaagcatttccagcacattctcagctttcctgctctgctgggc

SEQ ID NO: 152626 - DNA, 576 bp, Homo sapiens
gcccctgctactgccaaaaaaagacaaaaaccatatgatcatcttattagatggagaaaatgcatgtgacaaaattcagcatcctttcatgataaaaatgctcacacaattaggtatagaaggaatgtacctcaacacaataaaggccatatttaagaaggccacagctaacattgtactcaatggtgaaaaattgaaagcttttcctctaaaatccagaacaagactctccccacttctattcaacatagtattgtagtattggcagtccttactagagcaattaaaaggcagccaaacagaaaagaaagaagtacaaatgtcagttagctgataacataacttttttttggcaagatggagtcttgctctgtcatccaggatggagtgcagtggcacaatcatggcttgcggtagcctcaactccggggctcaagtgatcctccttcctcagcctcccaagtagctgaaactacaggtatgtgccaccacatctggctaattttttcatttcttttggtagaaatggggtctcgctatgttatccaggctggtctcaactcctgagctccagtg

SEQ ID NO: 152627 - DNA, 256 bp, Homo sapiens
tgacacagtacagatggtgagggggcactgcagatgggtgtgttgggaagggagtttgcagtgacacagtacagatggtgagggggcactgcagacgggtgtgttgggaagggagttctttggagaagaggcccgctcagctgagaagccagccatgcagaggtgccaacactctgtggtgtcggactgtctcccctacaccagatggtcagcatctctggaccccaggacatgagatgcagtgtccccctcctca

SEQ ID NO: 152628 - DNA, 439 bp, Homo sapiens
agaagcctgtgggcacgttcgttcactgtgcaaaagccagagggcttgcctgggttttcatctgtgggctagctcttgttccccctacatgaagtccccggcaactcacttgtaatgggactggagacttcgcaaaaagaatggcctccccaggaggaggatctgacgatctgacactgcagagaccttggcttcctttaggccagagatatatatgattccagcttgcttatgacatttttttaaatcctgctttgactttttgttggtgtgtctttgggattgacctaagaagggagacagagggaacagctctatggattttgtcttctaagatgagcttcctagtagtatgtgctttcaccatcagtttttaggggaagttttcaatcatcagtttgtagttctctatctggctgtgttgctaaccacctggatg

SEQ ID NO: 152629 - DNA, 584 bp, Homo sapiens
tggcctagtatgaggagcgtgatggagtggaagtgaaatcacatggctaggccggaggtcattaggagggctgagagggcccctgttaggggtcatgggctgggttttactatatgataggcatgtgattggtgggtcattatgtgttgtcgtgcaggtagaggcttcatagagaaggagaaagcacagggacaggctgccagatttctgcagttgtgtcttcaatgggcttcgttattttgtttcaattatcatgacttcccaaaataccagagaaactcatatttagaagtttaaaaacctatcctatacatactaaaatatttccagattaaatcatacaacatcaaggatttactgcaaaataatgcgaaggggagtaggtatgggtatagatgaatcaagattggtcatggtttgagaactgtttaagttggtgatgtgcacacagggaggtacagtttactctttcatttacttttgtgtatacttaaatttttccataatgaagtttttttaaaaaaaatctcaaagctaaaataaatgacttaaatatcattctattaagtcttgtacacatttcc

SEQ ID NO: 152630 - DNA, 240 bp, Homo sapiens
gaggtaggggggtggtggtgcggagtggtgtggatggtgatgacgtgtgtctgctagcctgtctttgtacgcgaagactggtcaggcagcattcagagaaggctcgggcggggacctgcaggtaacccactgacacctggcacagcaacctgagcaggtatgttgcgtctgggctcgggcggaagggaggtatggccagcagagacgctgatgtcttgtgagttctcagaactctgttag

SEQ ID NO: 152631 - DNA, 450 bp, Homo sapiens
aacacaggcgtcacacaggcagacttcttggtgtgtttccatctcttcctgccctgggagctggaaggtggagctcacatttcagctcaagggatatggcgtccacagggcccatgtgggaggccctgaggtttcttaatcaccaaatctagaaggcgtaaaaccaatcttcacaaactacagcactggaaagaaggttcccttccctgattttctcagaaatcatcctgacaagaggatccctttagtcctcacgcacaagaaaattccctctcctgccccaccttatcatccatgaataattctcactgtcctgaaatacacagaatagaccatccacatagggccaccaacaacctgcacaacttcgaatgttgagaatgacagtggatgggtgagattctaccacctacttggcagcagttttggtctcagtccctgaaggcaggt

SEQ ID NO: 152632 - DNA, 431 bp, Homo sapiens
acacatttcaaggtggctgttcagaatggttggaaatagaataaccaaaaagctgtctttttgtggagagatttgcatctgtagaggaaatctgcattgatgtagccaggctttctccgaggctctcccttgtctaactctaggaaagattaactgagaggctgacacctttacagatctgaaagaaacatttaccctcagttctttctgagggctgctacctgtgaggtgtcatctacctaacaagactccctttgccaaccaggcctcctcttccctcccttccataacctgtcttgccactatctgagcccccatatttgtataaactcaagatggtggataagcttctgtatcccactgaggggttggggtaatcactttgtggttctctctcatgtatgttaataaatatttcctgttaaagccga

SEQ ID NO: 152633 - DNA, 303 bp, Homo sapiens
atgttagcggcccctcctctgccttcacagagtttaaagtgtgctctctccaccagtcaggactgttgccctcctttcacagccatgtgattgatgttaccagtccttacagcagtcacttcacccttttccagtcctttccttgtcttacctacaccttgctcctaaattgtgtattagtccatttttgcattgctataaaggaatacctgagggtgggtaatttataaagaggtttaaatggctcacagttctgcaggctgtacagaaaacatggcatcagcatctgcatctgatgaaggc

SEQ ID NO: 152634 - DNA, 546 bp, Homo sapiens
gactcgcagctctactcccactaactatgactgggcaagtcccttcacctctttagccttagtcatatcatctgcaagatgggctagtgatacctatgtcacaggatggttatgaggacccaataagagaccccaggtgaagcctcctggaacaggtccctctcactgtggatgtggagtcaaggcttactgggcatgaacaccaaggacgagacctcctccttggcttagacaatcgaatccatccagctggaggttcttcttcactccttccctccctgcctcagagaatgagacctgccaccttcttcaaggcccatccccacctgcacccatgagcccttgcatgcctgcttgttagaaaccattcacctgcatgcactcctcccctttccagcctctccacacctgctaggttctatgtggcccacctccctgctcatggaagccttcccaaggggtgcgtgtgaggggtttctcgacaagcagccaacacattctctccactgttccccctgccaccaacagcagtatgccccctgcacc

SEQ ID NO: 152635 - DNA, 401 bp, Homo sapiens
ctgaggtcaaccaagtgcacagaaagaggctgcagctgcacctgccctcctgcagacgactgtcacgcctgcacacactcactctctttggactcactctgccagacaagggtgacagctggcctagactacagtcagaatctacatctttcttacaagcacagaaatcacaggaactggaacacctgcctggggacagggatctggaaggatcacccaggcctcacttcctcaggcctcccttgtaccaggaaaggcctgataacagcatcatcctgtccttcttggaggcaaatgtccttctcctgcattttccagaggggcctgccctaacctctgagccccttctgggagctcagcctccacttttcccaccccaggaggaagctgggggctggtag

SEQ ID NO: 152636 - DNA, 144 bp, Homo sapiens
catagtttgattgtgtgaagtggatgatcttcttgggggtctattaaactattgggtccagggttgatgctgctaatctcacagttaaatggatgttctcctcctccttcacaagatgaccttcccaaagttgctcatctatag

SEQ ID NO: 152637 - DNA, 261 bp, Homo sapiens
aaaataaaaaaatctggtaagagctgtagtggaaagccacattagcccaccttttaatggtatatatatatacacacacacacacacatatatatataaaatcattatgccatcagtttgagggagagcatgtatgccaacattgtagagactaagtgcccatttatccataattaagataagcagacttttccccattgtactataaagttagagtttggggctgggtatggtagcttccgcctgtaatcccagcagttt

SEQ ID NO: 152638 - DNA, 146 bp, Homo sapiens
gatggtctagtttagaaaacaaaagtaattcatcaagttaagcatatacaagagccaaataattgtaatctggattttaattgctgtattaatatatcaagttcagttggtgagaatgggattgcttttggggggaggagggacat

SEQ ID NO: 152639 - DNA, 352 bp, Homo sapiens
  misc_feature (48)..(48): n is a, c, g, or t
ggtgatctagaggatccctaaaggtggagggtggagtgttgctgcagnacagctgagtggagggatatgaagcaccgcaggtctttgagttttaagctgtggctcgtaatgttctggcgagcagtttgttgatttaactgttgaggtttagggctaagcctcccagagtgctgggattacaggcatgagtcaccatgccaggctgaggtctcttcttttatgtgtagcaaggagctcagttctttggagagagtgggcatgaaggtcagcctccctcatcctacagggagaggacccctttacgatgataatagggggttggaagaggcagctgtgcctggtcctgcatctt

SEQ ID NO: 152640 - DNA, 262 bp, Homo sapiens
cgaacaggacacgcgcgtagaaatgaaactcaatccatacaaaaccattttgtattatgaactacacttattattctaattatttatattcatagttttgtttgggagagttgtgtgcctaacatctaatccatacagaaagcaccctggagcctttgtactatagaaatggcagtcagaaaactaagtttaacctctgggcatatcaagttccttgataacacacatctctttgaaaaaaataagacttatattgttcaaa

SEQ ID NO: 152641 - DNA, 499 bp, Homo sapiens
atcctggcacttggaataagcaaaaccaaacaggacaaagtactaaactacaattagtaaggttctaatacagctctaaaaaggaatgcttcctatattgatgataattagttgatgatagattactgagctgaaaacttgacatttgattgctacttttaagtgttaggcaaattaagaggtatggaaaattggacatatcatagtgtaaatgaatttattttctccatggcaggatttggttgcttgtgaacatatagcagattctctaatactcataaggctccctctttcctttaatacgaaggatgtaggagaagttcagcaagcacttatttgttaggttgaattctaaatatggacacagtgcagtcttaaattatgttagaaaaaggacatttggcttagtgagacacattaatcatagtgcagtcttaaatagatctgaggacttacaacagtgcatagatatgtctttaaatcagcagaaattcagaag

SEQ ID NO: 152642 - DNA, 583 bp, Homo sapiens
cagtgtttgattttctgttcctgtgttagtttgctgagaatgaaggtttccagcttcgtccatgtccctgcaaaagacatgaacttagatgaggtttctttggtgggaaaagctgaatggaagagctggaactcgcggaagaggaagaaccataagccggcttagagaaaatggacttctgatgtcataggtacctattccaattgctttctatcatgatccattagtgagttagcgccataatattgctgtgccacaaaccatcccaacccaaaactcagtggcttaaaacaacaatcatttactctcactcatgtgtgtggggaagcagatctaggctgggcttggcaggcttgactccaggctacacactgggtccatgccttcacattcctctattttccctggctaccgggactaccaggggacgttcttctcacagccatgacaaacgcgtagaagggcaagttcaatcgggcacattttatgcctccacctttcttctgctaacatgtcattggccaaaacaaatcacataacccagccaaagtcaagggacaaggaagtccatttcacctctagt

SEQ ID NO: 152643 - DNA, 382 bp, Homo sapiens
aacgggtgatgcggttgcagaagaaaaaaaagaaaatccatccctgccactcacaagctgctacctacagcagattactatcctaagcctcaattttgccatctgaaaaaaacagaaaaaacagttaataatacctcaccaggttcttgctaattctttagtaacacagaggaatcttttagcccttctttttttgtcttatagcttaaaccatgctgcaggaaatgtatcaatccaagataaaagagctgaaatccaagaacctccccctcacattttgtttgtttgtttgttttgtttttttttgtttagacacaggatcttgctctgtcacccaggctggagtgcagtggtgccatcacagctcactgcagcctcaaac

SEQ ID NO: 152644 - DNA, 268 bp, Homo sapiens
agcaaattttaaaataagtatattcagaatctaaccctctctaatactcctcaggttcctgtctagatttttacggtttctttcctttttttttaaatagagaaagagtgtttttgtttgtttgtttgtttgtttgtttggacatagggtcttgctctgttgcccacgctggagtgcagcagtgtgatcctagttcactgcagccttgaattcctgggctcaaacagtcttcctgccttagccttgcgagtaacggggactacaggtg

SEQ ID NO: 152645 - DNA, 257 bp, Homo sapiens
catcaggaacagataccacatgttctgagaaggggacagaataatctcttcagggaagctgggaccgagacctgtgaggcaggaagtgggggttcaagcctagccaaggttcctaaggccagcgacccacaccgggctctcctgggtcactttcagcagggggggagagccttcgatgacctctaagggcccttccatgtgctcacctaaaaacggatctggttaacctcccccgtcaccacccctcactattgctc

SEQ ID NO: 152646 - DNA, 404 bp, Homo sapiens
aaggagacagagccaagattaaagcccccagttcgtcccaccttcctggccagggctttttcagaaaggagatgtccaatggggagtgggggttggttctttggtatctaaggtttccagctcagcaggagttagggaggttggggcctgcaggttggcagagggtgcaagggcagatggaggccacaggaaagggtcaggtctagggtaggtaggaaagagctggatctgatttcagatgtatacctctgtggggccttaggcagcactcatttcttcttttccttttcttctctcttcctcctctttcttcttcccttcctccctccctcccttcctcctttcttcttccttctactcttcatttcttcctcctcctcctcttttttttttgagatagggtc

SEQ ID NO: 152647 - DNA, 379 bp, Homo sapiens
tggacttctggcatacctggacttctggcatcctggaccttctggcatacctggacttcggtggcggggacaggggatgagggcagaggacaccctagaaatggatcagagaacagcacacaggaaggggtagcagggagctgggagggcaaaaggactcagcgggccctgagatgggcagggaggaggtgagagggaatctggtgtccttagatcactggtcattagtaggggtgggatgagagagaggagaggaccaatgaagtagaagaaaaaccaggaaagggtagcttccaggaagatagaaaggaaatgatcagctatgtagagttaattggtggtactaacaagatcagtgtcagtgaggttttatgggcaa

SEQ ID NO: 152648 - DNA, 451 bp, Homo sapiens
tttccgctctccaatgaggccttgactttgcattccctcagcttcccatgatctgtttatatgatgtgaaagggcactttctggaaggctctgtaagtgttctcaggttattaccagtgtcccccagtacttctggacagactgtagagctcctttggctaaagtgctagaggcagcattctgcatgggggaccaacatgtatcatcacctcaccatgctgaaaatctacagcctggcccctgatccaaatcagcaatatactaatattaaggaaaaagtaacagaaaccaaaatcacccacctaatgaagatatatgatctagcaaaagaaaacgaggctgagaacatccacaggtaagccaggctatgaggaacatagctctgaactcagcaggaacaaaatgaggaaccggggagagtacagagaagtgttaactcacactggtagga

SEQ ID NO: 152649 - DNA, 220 bp, Homo sapiens
aagagttaggatgcatcctgatggtttgttagggaagtctagtcactgtattatctctcttcaaaactgacaaagcatttcacacacattatttcatttggtcctcagtgagacagtcattctcattctaaagataaaattaaattgactttcattccttttagatttattattgtttattctgtcttattccttcctccgtgtaagttttttttttttt

SEQ ID NO: 152650 - DNA, 414 bp, Homo sapiens
gtcatgccattgcactccagcctgggcaacaagagcaaaaccctgtctcaaaaaaaaaagaaagaaaccaccaaactgttttctaggaagtctgtacagtcttacattcacatcaacaatgtatccaaaaatgtttttagatatttagataattaatttaaaccaaattttgtattctaccttcccataccccatttttactgtatctggatttaggatcatcatccaggagtgtgcagtgggcttactacttcccctttctaaatcatgaatcacttcatcttccttttgtgaatcatgaagttaaggattattgtaccgcctaatgcagatttgttgtgagaccctaaggaagaaatggaccagaaaaaaatgacttaagaattataaggtcaggcatggtgactcacacct

SEQ ID NO: 152651 - DNA, 181 bp, Homo sapiens
ggaacaaagagactactatttgtatcctttcatggatatctcacttgacacttcacaaaacaatcctgtgaaatataagattatctccttttttttttttacccggttctccattaaccgggccggcatataaacctgggttttttggcccttggatggtctcgggcccgttgggaaccgg

SEQ ID NO: 152652 - DNA, 200 bp, Homo sapiens
tgcgtgcgtgtgtgtgtgtttgagtgcgtgtgtgtgtgtttgagtgcgtgtgtgagtgtatgtgtgagtgagtgtgcgcctgtgtgtagcagtgtagtagcggaggaacaaagaggtacaaagaggaatggaatcagtgaagctcagatccttaaagtcactttaagttgggttttcaggggggattttacaggcttctg

SEQ ID NO: 152653 - DNA, 376 bp, Homo sapiens
aagaagcagatagaaggtcaaatcatacatggatctggaatacatttttctgttaaatttgaaacaaaatatttgctattatttgagttcagcacaaaaatctagtagtatcactgaaaatccccaaaatattctggttttggcagaatttcaatttctcacttagactttcaactcatgtttgagcagaaagaattacatttgataaaatctgtaaatgaggaaggcatactttctcatccaaataattttacaagtcataccttccttatttggaatttgagataaatgcataaactattgctagtaacttagaaaaatatattgtaaacctacttcctatttaaaaaaaaatataagacacacacaaaaaacc

SEQ ID NO: 152654 - DNA, 862 bp, Homo sapiens
cttccacacagggatgctgtgatattgtgatataatacagactattcagtttggtggccaaaagtgttgtgagaccatagaagaggaaaaacagtgttttttttccatattcaggtgtgcacccagggccaggcggctgaccatggttgggaatgcatgccccactgcactctggtcccacccagtctcacactgtcacccccagggctcaatgcggaaccgtgtgcaaggctagcccttatccaaagcacaactcccagcctgggtagcacagggagaccccgtctctacaaataattttaaaacactggctcagtgtggtggcatacacttgtggtcctagctactcaggaggctgaggcgggaggactgcctgaccctcagagtttgaggctgcagtgagctgagaccgcaccactgcatcccggcctgggcaacagagcaagacctaacctcaaaacaaacaaacaaacaaaaaaaacagaaaaccccacacagcacaactgtaccaccaccgctcctcctgaggcgagagcacccccaccccgctctccagcacccactctgcgggtaggcttcgagcaggctgacagcctctgcagccattcagctgagtcactgggcctcggacatgccgagcactagagctcccctgccatttccctaaagcagagggacaacacctgtgccgcccgcatgtgcaagctcggatcctggccctctgcctctttctcattcccagtgcaaaaaccaccccagaaaagcaagagctgccaaggccaacagccttgcgcactggagagccgtcctgaccaatccctggagggagctccatgcaagctaccagggtaaacgcataacg

SEQ ID NO: 152655 - DNA, 493 bp, Homo sapiens
agcagacccagatgggacccagctggggcctgaaacagcggccctctgaaacccccgcctcctcctgacaaggccaggtaaagggtgatgcagcccaaactcaggggtgcagctcagagcacccccaaccccgccagggcagaggctcagcccaggacagcgagtgcccccaccttgggccctggcctccgccctcatcatccaggtgagagctcccacaggccctcccaggagtgggcttctccccagagtcctgggtgggggatggggatcagagagcagaccccgtctcatgaccgctccccaccaccgtctcagccaccaaagagaaatcgcttcaaaaggtcagctaggaggtcacctcatccaggacccccaccccagggctgccctggacagcagccctccacagcccagcacaagaaaatggagcagacgggccggctgcccatcaatcagctattaatagtagcgtgtgccctggcagggccct

SEQ ID NO: 152656 - DNA, 185 bp, Homo sapiens
cctggcagcccccgggctgatagcatttgccctgtggggtgcagtgttacccccatctgatcaagaccaagggcccacccaccgtgttcccagctctgccacgctgggctctgtgaatgcagacatgcagcatggccagcctccgggcagaccacccacccccagaacaggcagagacagggcac

SEQ ID NO: 152657 - DNA, 334 bp, Homo sapiens
cagagggagctcccccacttctcagtctccaaatgtcggtggcccaaggactcaggcctcaatcttcactttttctctatctactgaagtgatctcaccctgttgcatggttcaaatgccacatgcatgccaacaatgtccaaatttctatctcagaactccgatctcaaatatccaactaccttgggaggccaaggtgagtggatcacttgaggtcaggagttcaagatcagcctgaccaacacagtgaaaccccatctctactaaaaatacaaaattagctgggcgtggtggtgcatgcctgtaatcccagttacttgggaggctgaggcag

SEQ ID NO: 152658 - DNA, 283 bp, Homo sapiens
gatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaaggtcttatacagtctttattaacttcatagatcctttatcctt

SEQ ID NO: 152659 - DNA, 372 bp, Homo sapiens
ggatgaaggcagcaagagggcagcttgaggggagtgagtatgggggattgagaggaggggcagatgcagttgggggaggagtgaaggtgctaaagatgggtgccttgatttctctgaggaccaacatgactcccttccatctagaagggccaggcagctgtccctcggtgcttattaggtatgcatctctccacagcctcttctctggctctggagcttcagatgtgtgtgaaataaaagcagtgagctgagaacatcttgtcatgttgatctgcagctgtctcaggtaccctttacagggacattctgcagaaagcaagccaagactgcattcaggggtattttagttcacagtggccttaaagacatgca

SEQ ID NO: 152660 - DNA, 284 bp, Homo sapiens
tctaggtcagcgttgcttccactgcacctctgaaagtactcagctctgccccaaacctggagagtgccgcatttctccagactgcaagaaacagtgtggatgactcagtggagatcataatggcatctgagtgatcaacgacagcctccagttgccacttggtgagagaacaaaggaaccggggcatgctcagctatggctgcaagcccttcaagtgaagctgggcacttacccccttcattccattctcctcaggataacagattaaaattccagaagtgtgc

SEQ ID NO: 152661 - DNA, 343 bp, Homo sapiens
ttggaatttaagatgttgtcttaaagtagtgctgatttgaagtgcttttactttcagaaaaatttcaataaattactttgtatagcttgcaccagccacactttaagacgttggtaatgaacagttaaaatttgtccatctgtcaaactgtgtttgatgacagtatatgttgtaagagttgtgtaatgtatcagcatttgaacaagaataatgaacaaaaaaaggtagttttctttgaatcattacttaaatatctatcttgcctacagctcagaaacttgacagaaatatgtcttttttcatgaaacttaaaatcacctttcctgtctttaatatctaatca

SEQ ID NO: 152662 - DNA, 296 bp, Homo sapiens
tgtggtttcttacagagtagggaggagttataaactagggatggagaactctatcatatcacacatttttttcatatttaccatttctataactgaggtacatcttaatatcgttagcttgtcaaagtttagcagcagtattttgtcttggtggcacgtaaaataatggttgctattacaaatgatagcatcttatagttgatgaaatatttgagcagctctgtgagctattccctccgtatcacaagaaagtaaaattaacagacagggaggagggaaagaattttgcagggaga

SEQ ID NO: 152663 - DNA, 409 bp, Homo sapiens
aatacctcacaaccatgaagcaagagttaacttttctcatgtaacacagtgtggagtatggaggctggtttcttcactggatgtctgcaaagacccaggccactttggtctctcctttggcatccctcatgcattggcttgccaccatagcgtcacaaggcctgcaggcctcatagctgtggtctaagcagaaagaaaggtgaaggggctggagccttttctcaagaaatagaagcttctcctaaagcttcccttcctctgattctttccccccattatttgacctaggtcacatgaccattcttggctgcagaggaggccaggaaagttgggttgggccaattgagattggcttatcaatcaggattcaatagctgtgtcctcaagagtacatgattctagtaacaag

SEQ ID NO: 152664 - DNA, 483 bp, Homo sapiens
tcctcatccggtttaaatcctaaagtggaagaaaataattcaagacaaatagccctagtcttctgggagatcctcctgggtctccctataagcagctttagaaaattaaatgctcttttaaaaaagcaagagaaaaacgttctaaataaataaatgtgagccattttaagtataaggtattcctcctacagatattttcctctatacaagtgcttaggtagaaattcgaaattatcttatatcattcattatcagtattcattctgctgatctcttatatcaagattaatcttgtatgttgatattctgtccttacattgattttgattaagatttggtgtcatgaagtaaaaaagatataaacaattaagtgacaccttctcaaggatgggcaactagagaaatgcactgcctcttgagaaaattgctcatcagatcttcaagaattaaatagaagatgtttaaaattattgttaaggggaa

SEQ ID NO: 152665 - DNA, 504 bp, Homo sapiens
ggagtgtttgctgtgtagcaggtgttgctctaagcagttttcttatatcaaacacacttaattctccccagcaacctatgagagaggtaatattcccattttacagatgaacaacagagaggttaagtaacttgccaaggccaaacagctcgtgaatagcaaacctgggctagaacccaggtaatgtggctccagaacccctgcttttggtcgttctgctattctatgaggtagtcattatgatccccctcatcagaaagcagaaagcatgagattcagaggggtgcaattacttgtccaaggtcacacagctcatcagggaaggagctggtacccaggcccagatgtgtgggtcacacacccagactccaggccacctcccagatctgaggccgctcctctggagtcaagtctgtgcctgggagaagcaggaaggaccactggacctgctgtcagtggggcaggcacaggctttttccagtcccaggctgccccctactggca

SEQ ID NO: 152666 - DNA, 361 bp, Homo sapiens
gattttttaaaaaattgaggtaaaattgacatacagtgaaatgcataggtcttaagttctgtatacagtttgagtattaacaaaagcgtacactggtgtaattcacatacctattgagaatatactacatgttttaacatagaagtagcatttgaaattattttccatcaagaaaatggatgtcttaggaatattttctctttttcattttgtggcttctacttgatataccactctgtattcttcagggatgatggcagtggacaatggcatgattattccattttgagaagtgtggccttcatcaccaagatagctgtgcaaaatgattagacatcataatggactttcgttagctaaa

SEQ ID NO: 152667 - DNA, 138 bp, Homo sapiens
tacactgcacaaattatcctatttagattactttggttcttgctcaccaacaatcttttctttcttacacttcgctggttttctccaaattccatctcacaaaggggtcactttttctagcaactgatgtaattccat

SEQ ID NO: 152668 - DNA, 379 bp, Homo sapiens
ctggatgaattcagacacccttgtgtgactgagcaatgcgtgaggaactgttttcttgcagaactatggctccttggaggaaacacggagatggcacgccccgttccctcgatgtgtagaatattgcagtgaaacctctgtcattaagaactgatgaccacctagtccaaagcagggaaaaggggcactcacagaggttaaatgtaggcatcgaggcagaagaaaacctatcttaggttcagcccccactcatgcatatctgcggttttagaaaacactcttaacgaacaaaaaaacctatggtcagttgctttagccacataatgtaaaccacaaaggctcacactggcctacttcggggagtgagaacaaaggaggg

SEQ ID NO: 152669 - DNA, 342 bp, Homo sapiens
catgttgggcaggatggtctcaatctcttgacctcgtgacccgcctgcctcggccccccaaagtgctgggattacaggcgtgagccaccgcacccggtcagagccccactgttcttaatctttgtgttcttccttttacttcatgctctcttttgtgaaggtgaaaagcagttttacaaactagaaggtgctacataagatgtggtatatttatctgacttggtccctgtactccagagattacagtccatgaggaatgtgtcttctccaggctaaacctactcatttattgccactgttactcgctggatattgctgtcactattttggccacttttcttt

SEQ ID NO: 152670 - DNA, 301 bp, Homo sapiens
acaacaggcctggcttggactgtgtgcccatcattgccaaggagagggggtaaggtattataattggcccaatctgagtcatatgtgaatccctgaggctctgggtgggactggggtctgttttgagtggaaggaggaaaatggtaaaaggaagacagaacgtatactctgattagcttcttctgagtgaggtggcaattcatggctctttgtaggctcacgtgatacacgtctctggaatctaggtctcaaattaatttgcttgcaaatagggaagatagaacacatgctcctgtgaata

SEQ ID NO: 152671 - DNA, 251 bp, Homo sapiens
tcggccgacgggattcctgctcaagaactttcagtggctccccagtgccaaagaatcaaagaccagactccttcacgccatttacccccaacctgaggggtttgggaaaacaagtagggaggcttcccagggtgccttcctaagcctctcaagaggctcccgcctctctctactggctgagtgggaggagggggcagggtcgctcccttgggctcaggacacaggtagctggaggacaggaaagacgggga

SEQ ID NO: 152672 - DNA, 341 bp, Homo sapiens
ctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgt

SEQ ID NO: 152673 - DNA, 346 bp, Homo sapiens
tttaaacattgcttaggcttaagcatatatctgcaactgtcaggattgttctggacatttatatatgttctcccaaattccaggcatatagtggtccaataatatagtatttttatatttaaggtattagaaaagtcttgttatttggtaggaacacaatgctaggacacctgacttgcaatctgcatttgtatggcagcagatgtatttatttgaagtactggtggagagcaaccattattctttggctaggaaagtttgtttttcgtttaatcagtacctcataaatgctgagctttgaggacaaaggaatgataattagacacatcctgagctttgtaactgg

SEQ ID NO: 152674 - DNA, 222 bp, Homo sapiens
ggcaggggagggctcgggggtacagccgtgtacatgattagttagcgagacagtgaggagtgtatgcggagtggacacagctgtgggtgccgcccgcgcaaggctgggggtcgctgtgccagccctgctcccatgtgggctcccagctccccaggtagggacgctgaccccgggaggtgcctttgcctgcatccactggagcctcaggagcatgcgttccgt

SEQ ID NO: 152675 - DNA, 469 bp, Homo sapiens
tattttcttcaaccaaaaaaaatggttaagcacacaggaaaccatctgaggtgtagtgctgatccagttttcagaaaaccacaaaggaattcacttcagatctttatttttggcagctaaacagatatcacaaatgctaaagtccttgaaataataaaagtaagagatatcatttattcagtgtctgatgaccttgtgctaaatccttttttttttttttttttttttttttgagatagagtctcgctctgtcacccaagctggagtgcaatggcatgatcttggctcacagcaagttccgcctcctgggttcacgccattctcctgcctcagctactcaggagcctgaggtgggaggataatttgaatctgggatgtcaaggctatcatagtgagctatgatggcaccactgcactccagcctggatgacagagcgagaccctttctcaaaaccaaaacaaccaccac

SEQ ID NO: 152676 - DNA, 593 bp, Homo sapiens
agagacgctcctcacttcctagatgtgatggcggccgggaagaggtgttcctcacttcctaggtgggatggcagccgggtggagacgctcctcactttccagactgggcagccaggcagaggggctcctcacatcccagatgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccccgtctccaccaaaaccagtcaggcgtggcggcgcgagctttcaatcgcaggcactgggcaggctgagtcaggagaatcaggcagggaggctgcagcgagccgagatggcagcagcacagtccagcctcggctcagcatgagagggagaccgtggaaagagagggagagggagagggagag

SEQ ID NO: 152677 - DNA, 420 bp, Homo sapiens
ggttaaggtcagctagattcaggtataaacttaggggaggtataaacttatggccaggacaatgttcagggttggcttcagattcagattcagggccatgaaaagcaccagtgtactggattcaaaatcaatcaaagtcagtttcaaggacaagtttaaaatgagggcaaaacatggtcagggtgatggttagggtgaggacaagggtcagaattagggctagattcaaattcaaggtcaagttcatgcttatttcagcttaaggtcaggatgactgcatatgagattcaagatcaggatcaatacgcctgtaatcccagcactttggaaggccaaagtgagcgaatcatttgaggtcgcgagtttgagaccagcccagctcacatggtgaaaccgcctactaaaaaatacaaaatttag

SEQ ID NO: 152678 - DNA, 442 bp, Homo sapiens
aagagaggttggttaattagtacaaacgtatagttagatggaaggtataaacttaggggaggtataaacttatggccaggacaatgttcagggttggcttcagattcagattcagggccatgaaaagcaccagtgtactggattcaaaatcaatcaaagtcagtttcaaggacaagtttaaaatgagggcaaaacatggtcagggtgatggttagggtgaggacaagggtcagaattagggctagattcaaattcaaggtcaagttcatgcttatttcagcttaaggtcaggatgactgcatatgagattcaagatcaggatcaatacgcctgtaatcccagcactttggaaggccaaagtgagcgaatcatttgaggtcgcgagtttgagaccagcccagctcacatggtgaaaccgcctactaaaaaatacaaaatttag

SEQ ID NO: 152679 - DNA, 615 bp, Homo sapiens
caacctcaatcctgtcccaacaggacaccctgcctccggctccagcccccaactgcatcctaggcactgagccaaaggaactcttctaccacacaactgagagcccaccactcccccggggcgtccttcaacaggggtgaaagggttcggggagcacacaaggggcaaagggcaagttgaatcccggattccaaaaggaggcacagcgcaccaggcctcagaaggcaggaagacaccgccaggccaagtgggaaggctatttagacaaaagaagccgcctgcacagggtcttgtggaaaaggtcaaaacagcttcgtttggctggcgttaggggtacactgtggtctattctaaacaagctgaactgagtggtcacgggcagcatctgttcttctgattcagtgacacccttccacaaagcttgctaaataggccgggcgcggtggctcacgcctgtaatcccagcgttttgggaggctgaggcgggcggatcacgaggtcaggagatcgagaccatcctggttaacacgatgaaaccccgtctttactaaaaatacaaaaaaattagccaggcatggtggcgggtgcctgaagtcccagctactcgggaggctg

SEQ ID NO: 152680 - DNA, 655 bp, Homo sapiens
atggcacaatctcagctcaccgcaacctccacctctcgggttcaagcgattctgctgcctcagcctccctagtagctgggattacaggcatgtgccaccacgcatgtctaattttgtgtttttagtagagacggggtttctccatgttggtcaggctggtctggaactcccgacctcaggtgatccgcccgccttggcctcccaaagtgctgggattacaggcgtgagccaccgcgcccggcccaagagggctctttcttccttcatgggccagggacctgcccagaccattcctgtcccctcctacaactcaggatccacagggtagccaaacctcttggagataaactccccctatatgccccagtccagggggctttgggtttcttgagctgggatcgaagaccccatgtccccaggccagactccccaagggctgtcacaatttgccaagcagcaggagcaacccttcaaggcagggagtgccatggctggaccagcatcaccttcactgctgagccccagtgctggggtacagccaaatcaggtggcacacaggctggactgggtttacaggcttcatagttttgtttcttttgttttgtgtggggattttttgcttcttaatttttgggggagacagggtcttgctatg

SEQ ID NO: 152681 - DNA, 776 bp, Homo sapiens
ttgaatccagtagaaatgacccaaaggatgatctcaacaacttatgtacacctaattcagggccagtctttcttcctctgcctcttaccccggtcagaagtcacatgagaaagaagagctccagggggcagttcataggaagagaactttcttttctacctctccattctacacaagataatacgggcatcccaaagaagactcatcattgagagatactcctggcctaacatattttcctttagcaaagagaaatgtctttatacccaagcactgggtattcccccatccccccactctgtagaagaatccagccctccaatgagcctattttggaagattctgaaccacagcaacattttattgtttcttttctaaagaaattttgtgtttttcttttagtttcattactattaagtgattagaccattattcagatatagcttgatagaattccaattcaaatattttacaaatgcaggatatttaaatgtgagccttaagagtaaattgcttccattttaaatttattttgtctgtcttttgaaataatcttggaaattttcccttttaattttactgctgttaggtgaatactcaatttcttatgctgaagcctgatagaattataattttttttttttgagacagagtctcagtctgtcactcaggctggagtgcagtggcaaaatgtcagctcactgcaacctccacctcctgagttcaagtgacttagctccccgagtagctgggattacaggcacataccgccacac

SEQ ID NO: 152682 - DNA, 396 bp, Homo sapiens
tcatgtctgttcaatattaccatatcagagaggccttcctcgctgtctcatctaaaatattaccctagccccctactctgccctaaatatctgctgtcattattataaatatatactaacccatttaaaatgacccctatcactttgtctttctgcctatttgtattttcttcatagtacacattactgcttctactaggcatcatatttgattattcggtatttcctcccactagattgtaaactccggaaggacaggaacataggttgtttactggtatatccctgtattctagaagaatgcttagccatgtaggcactcaatacttattgaatgaattaatgaaaggtatagcctcatcccttgatcttttgttactaggatttctagcttta

SEQ ID NO: 152683 - DNA, 260 bp, Homo sapiens
ggatggcagcagtttcaaatctccctgagatcaccctagagctgcagtcttacaagaaatctcaaaggggtactatatatggaaagtctctcgagtgctgggacaacaggcgcgcaccaccacaccaagctaattttttgtatttttagtacagacaaggtttcaccatattggccaggctggtctcgaactccccacctcaggtgatccacctgcctcggcctcccaaagcaatgggattataggcatgagccaccagt

SEQ ID NO: 152684 - DNA, 751 bp, Homo sapiens
tggtttctggaggtatgttttaataacaaaatcaagtctggtcaatgaaagctttcagaaaatggttttataaaaaaaccttgcattctttttagatcaagagcagttttcccccaaaccttaatgtcagtcgtacgattttcttcttcttattttctgttctccatttttgcttatttgttgaaaacattttttagctatgtggagacttgcctgaatgctgtctcctatttaggtagaggccaataagatgatagctggaaaagcttcgattgtctatcatgaagaccaggatggaataaaagaaaaataagtaatgcagttgtgatattctgcagtatacttcggctctcttaataagatcatgctgtaagcagtgtcttttaactgaagcttgcaacctgttggtgggtcatgaagtagattttaaacattgcaattagcattttatttaatgaatagacatagaatagcatggaaatttaagagtgactatagacttaagagaattgtaaataggacaagtaaaatagaaaaattaatgtatcacacataaaaaggggattttcatgaaactttagtattagttccacagacacacagatacatcaaatagcgtgtgagtcaggatttagtccaggaaacaaaaattacatttatttaaaacaggaagatatttaatacaagagaatttgatgcttataaaatagttggaagatctaagatatgagttctaggctgttcttgctgg

SEQ ID NO: 152685 - DNA, 242 bp, Homo sapiens
ccatcttggcctcccaaagtgctgggattacaggcctgagccactgcgtctggtcttgtgctgatgttttagcaaggtttgagggtgacacatctcatgcctgagcatgaaaactcaatcatcacacttataaactataaaagaataacccccatttgatatgtaaggaaactaaagcccagagaggttaagtaacttacccaaggtcacacagctcatatatggctgagctgggatttgaa

SEQ ID NO: 152686 - DNA, 301 bp, Homo sapiens
ggcagccttgaaaagcctacggacccttctcagaaggaaagacacgtgcaggacaaaggaatccaactctgattgtaatacagtgatcaaaatattttttcacactgtgacatagcaattcatgtgcttcttcatgaatgcattaagtaaaaaatcacctgtggcagctttaataaccactgtgacttagaagcagagatgagcataaatgacatttcaaggtgcctgctggaagataacgtgataggaaatgcctgtgatttcttttggtaacagtcacaagttctgctaacactgctgt

SEQ ID NO: 152687 - DNA, 123 bp, Homo sapiens
tctcctgcttcagtctttcatgttgctgagaccacaggcatgtgccaccacacccagctaatttaaaaaatttttgtgtagagatgggatctcactttgttgtccaggcttatcttatactcc

SEQ ID NO: 152688 - DNA, 482 bp, Homo sapiens
gattgtaggtgtgagccaccgcacatggccagtatttctgtttttaagtgacctcttggggatttgccacagtggctgtttaaacatccctcattgtcctacatttcctttccttttgcttcccttcacttaatcttgcctcttaatttatagaaaccctcagattggagctcctttaccttcgtgccaccaaatttgagtgccacttttcgtcctttctgtagtgagttctacttggatttttcccaagattttaaatctgcccttctatatctttttttcatcaactttaaacaaaataaataaataaaatctagcacatttagttatctttaccctccatctgcttttcactctcctcccttctacaagccaccttcttaaaatagttgtctgtgccctttgagcccattgcagttctggttttctctttaaccacaacattgaaactcttttctccaaaatcaccattaacccccttg

SEQ ID NO: 152689 - DNA, 124 bp, Homo sapiens
tgggactgggaatctgtggcttacagagattatgcaaaaataggaggggaaatttggcacccctgccagaaagaaagcgtgtggccttgtactgtctgattcacaaaggctcggcaggtcacaa

SEQ ID NO: 152690 - DNA, 288 bp, Homo sapiens
cccacattcagcctattttggagatcccagctaagagcgtctttgtggtttccgctcgccacctccatgtcacccccaggaccttcctcttgctcctgggaaagtgtgttagtctctcctctcctcaaaccttccctgccgtggtatagatgctcagtcacctccttctggtgagtgctggagcttcctggagggtcttttttcagggttacctcctgcttgtctacccttcgtcccatccccgggatcccccaaactactgagggtgtatcatcccctccttggcag

SEQ ID NO: 152691 - DNA, 324 bp, Homo sapiens
gggatgttccatgtgatgggtgaagggatgttccatgtgacgggtgagatgtgatgggtgatgggatgttccgtgtgatgggtgaagggatgttctgtgtgacgggtgagatgtgatggctgacgggatgttccgtgtcatgggtgagatgtgacaagtgatgggatgttctgtgtgatgggatgttccgtgtgacgggtgatcggatgttccgtgtcagcaggtgacaggatgttccgtgtgaggggtgaagggatgttctgtgtgacaggtgagatgttccgtgtgacgggatgttctgtgtgacgggtgatggtcagctgt

SEQ ID NO: 152692 - DNA, 833 bp, Homo sapiens
cttgaagatgaaacacagataattttaatacaatgtgaaaaagtgtatgggtgtgtagaagaggggttcttagagtttctggagagaatgattctgagctcggttttgacaaaagaggagctactgaggctaaaagtggatgaaaagggccttctaattaaaagaaacaagacaggactcagaggtgtgaaacaaatattatgcatggtgaattacaatgagttgggggtattctgtagccctaaagtacaaggtataaagagacagaaaatgatcctggaatatagacagaggatacttcatctctcatgagcaatgaaatgaaaatattaaaaagctcttatcaaacacaaaaaaaaaaaaaaaaaaaaaaaaaaaaaaaaaaaaaaaaaaaaaaaaaaaaaaaaaaaaaaaaaaaaacaaaaaaaacaaacaaaaaaaaaaaaaaggcagggcgaccaactataattactcacccagaggaagcgacacccatatagcgaaccccgccccctatctgaatacaacgagcccacacacaggaggagccgacatcaaccacggagcgcactcggcgcttattctaaccacccctctctgtcgcacggctgcaaaagcccgctcttaccgagcacatcttcgtgcaacaacgacccaccctcctctctgaggggcggcaaaccgactatgcgaccacacaccctcccacgacgagttatctacccccacctgaggacgaccatcacaccctagccgctctctacggctggaccccccctctgttcctgtgtcagccaccaacctcctgccgcccatatgatgccaacatctag

SEQ ID NO: 152693 - DNA, 498 bp, Homo sapiens
cagcctcctgagcagctgggactacagccgtacgccaccatgcctggctgattttttaaatttgttttgtagaaacagggtctcatgatgttgctcaggctagtcttgaactcctgggctcaagcagtcctcctgcctcggcctcccaaagtgctggaattacagtcatgagccacctctcccagccaacacagtctttctcttactgtgtgccacagtagtaatatctcttaatatgaaatgggctttctttaaaggcattttttcagagtggcaattgtatggaaaagttgactaattaaataatcaacagactgttaactcatctggagtaggggcattcttatattcacctgtgggtgcagattcctcagcatgtgctggctttcctgtacataccaattcacattattggttttttgtttttaaaataagactatggtcttgctgtgttgcctaagctggtctggaactcttgggctcacgcagtcttcccac

SEQ ID NO: 152694 - DNA, 273 bp, Homo sapiens
gcatttaggctgattccatgtctttgctattgtgaatagtgctacaatgaacatacacatacatgtgtctttatggtagaacaacttatattcctttgggtatatacccagttatagtactcctgggttgaatggtagttctctttttggtgagagaatattatacttaaatgagaatatgtcacaaaaaatttcccacagtagacctctgcctatgaaaaaatcatgtagtagaattagactctagaatcacctcctaggatcaaatttcag

SEQ ID NO: 152695 - DNA, 270 bp, Homo sapiens
acaattagcatctctggactcagtttaccatctgtaaccatctggtaggggaaagagctattaaaaaaaaaaaaatcaagggttccccaaactgactgcccatccaaaagtcaccttgagagagctcagtaaaagcctagatgaaagctctcctctgggtgactcctatgcacagcaaggctagaacatttctgtaccaggtggtctcaaaggcctcagccaactgaaggatatgggctcctactgtggttaaaaaatgttaccaaattt

SEQ ID NO: 152696 - DNA, 175 bp, Homo sapiens
atcacagagccccaaatattagaaaaaaaaggtagttgctatataatagaaagaccacaggctttgagatcaggcagaactgcattcaactttctcactgattatgatagtgtaactttagacaagtgcctaaacttcttttgtttttttttctttgagacagagtctcactctg

SEQ ID NO: 152697 - DNA, 455 bp, Homo sapiens
agtgtgaagctagatccagaggttggggccatctcctgatggggcattatctaggcaatctcgaatacggatctttatgatagtttctgctctgccacctttcaagttgtaggtggccccaataaggagaggaatcgtcccagaataatccataaaaggtctggttactctgacagacgtgccgtaaccgaacctcaaaccccgtctccaattcggatgttcaggaggactcacaaaaggaaatggctcggctgggcgcggtggctcaacccggtaatcccagcatttagggaggccgaggcgggcggatctcctgaggtcaggagttcgataccagcctagccaacatggtgaaaccccgtctctactaaaaatacaaaaatgagccgggcgtggtggcgggcgcctgtaatctcagctacttgggaggctgcggagcgagagtcgcttgaacc

SEQ ID NO: 152698 - DNA, 248 bp, Homo sapiens
tgccgccgcaagacccgctggacaccagagtgttatacgctatcctctgccatgcacagagctctccagcctcttctcttctcattgactgggtcctcttctcccatctccatctgcttcatccgccgtctaatatttcatactacatccaaacatcactttggctacgaaactcgccgcctgatactggcatcttgacgatgtgggacgactattactgtatgacaccatctatagacgcgggcctt

SEQ ID NO: 152699 - DNA, 320 bp, Homo sapiens
ctctgttgcccagtctggagtgcagtggcataatcatggctcactacagcctcaacctcccaggttcaaacaatcctcccgcctcaacctctcaagtatctggaacttacaggtacacaccacaatgcccagctattttttgatttttaaaaaattttgtagagacagagtctcgctatattgctcaggctagtctcgaactcctgggctcaagtgatcttctcaccttggcctcccaaagtgctgggattacaggatgagccaccacacctggcctaacggtgataagactccaccttcagattcctttgaatttctca

SEQ ID NO: 152700 - DNA, 93 bp, Homo sapiens
gaggattgtttgagcctggttgtagtgaagtatgattgggccaccgtagtccaacctgggcaacagagcatgaacctgatgaacctgtttcca

SEQ ID NO: 152701 - DNA, 418 bp, Homo sapiens
tatatgtcacagctgttagcgtataaattcaattaataacatttcatagagtggaatttcattctaccattcttactttaaacacattatctctataagcagcaaaaagcacacaaaagtgatgattcattcattcaaacattttatctcatctgcctcataaagttcttgtgacaattaagttaaaagatgaatttggaatatctggcatcagcaagtggtagtgttatcaaatatttaatgcctaccatgtggcaaatgggcaagtgagacagagcaatgaacaagaccgacaaagcccctgtcctcatggagcttttattttaacgaatgagacagacaataaaccatactatataatgtcagtgctctgacaaaaagtgggtgaagaaaaaaaaagagtgtaacaggccaggcg

SEQ ID NO: 152702 - DNA, 358 bp, Homo sapiens
gtgaccctggcattttgtccaaagcatttatttagacatgaaaatctggcagagtttagactgtcagaaaattctatcttactggactactaaagtagccacttactgtattaatctctctgtccttccatctcttcttgcttcagttagcgtcttaaggcacagatatgacagtataactctgctcatgggttcttaatgcttatccacagaaggatgaagtcaattcatattatttagattaaactgcatctatcttatgctctcataaagcagaactaatttttaaaaattgtctttttcttaattacaagataggatatagaaaaataattgtttttaagggatactgtattag

SEQ ID NO: 152703 - DNA, 718 bp, Homo sapiens
cgtcgaaatattcttttattcttgtcacaatttcattaactgcctatgccttattatcgacgtttccctgcgatgttttacaatttgcatactcctttagaattgcatctacattttgcttagcagggagttaaaacagctgcttctgcttggtaactaagttccagtccccagcaagccatggtttcgattcttcaggcatcttcactttaacttccattctgttcttaaatgcgtcctcgctttcaacagtgaggtctgcccaggctctttccttccctggggtctgaggtgctttgctggtactgcccccatatctgtttccaggagtcctctgtttgttctttctggtcttcctcacggatcctgaagctaagaagttctctgcagagcgaccccacatcttcctgagagaggtggttcaagatttttctgctgtggaccagctgccttctttcctgaggaggcccctctcatctctgcatgttgcttctagttggttttttgaagttgtcttcttctgcagattgttgtccatgagattgagaacccggctttctggaactcattcaaccctttttattccaaccaacaatctttcttctttccaagaactcctagggatttcccaaaaggactcttatagatcttgcaggatggtctaggaggatacagtgggagatacaatccaagattctgtaatcagaggtttctacaa

SEQ ID NO: 152704 - DNA, 557 bp, Homo sapiens
ggggaagcaaggtccgtcttacatggtggcaggagagagagcaaaggggaagaaacacacacttatcaaacaaccagatctcatgagaattctgtaatgagaacagcaagcggggggttggggcagggagtctgcccccatgattcagtcaccttccaccaggccactctcccaacacatggagattacaattcaagtttagatttgggtgaggacacagagtcaaaccgtattaatatctttaagatgaggagacttaacaagatggtctctaaggatttttcttcagctgtaagatctatacttttctcttttagtgcctacaaaggggccagggcagctgtgtatactttcctagggtgtgtactgcacaattccaggggtgcatgtcacatgattacacagatgtgaatggttccacctggctggtaggcaacacagcattcctgagaaggagcagttcttaaatttttttgagagctagggttctctcatctctcccctgccttattaggatctgtacttacctctctagttctgattcttgcttacaacat

SEQ ID NO: 152705 - DNA, 537 bp, Homo sapiens
taggtgccagtgccattgtgtttctgttttgccatctgagacagcaggctttcctagaggtttgtgtacccatcttcccatccaggctgagaggaacacagttgagcatttctcagtgactccgggtcaccccgggaatagtcacctttgtactttggacaatttggctgcacagtctttttggttttgctttttctcttttccttcctcttgggctgtggaccatcacttatctgttgttcttgggcttcctctcagcgtcttagaggcagtgccacgtggggagtggagaatatgctgtctggttcaaatcctgactttggtgtgtagcatttacaggtccttttgccagggactcagcccctctgagactccgtgtattcatcggcaaagtggggataatcaaacctgccttataagaggaacatgaggattgactgatgtcacttcagccagttcctctggagagaagtagccccccagccctgaagtgacaccctcactttcttcttgcccactctgccatgcctcagacac

SEQ ID NO: 152706 - DNA, 349 bp, Homo sapiens
aataaaacctattgatttggaactttaaaaaaaaaaacaacaaaaaaatactttcagggttttgtaatttcaagtggttttttaaggggagcaatagtttgccatttaccaaaggcttctccagataatttcttaaatgtttctacttaaaaataaaagctattaataataagctgtcatgggatccatttgaagacagggaaaatagaaaatttttattgtaaagggaagaacttatccttttaattttatggactaacagagtctgcaggtcttaactcatttcagcctgtcaaatgtgcaattaaaaatgaattttctaattgtattcaaatgaggctctatagtg

SEQ ID NO: 152707 - DNA, 407 bp, Homo sapiens
taatttcttagttgtttggaatccttaacgtgcaaaagctttgaacagaagagttcacaaaggaaccagggttgtcttatggcatcagttacgccagagcctctgggtcatccacatcaggagcagaagcacttgttggtcctgctgccacggtttgggcgcccaacacgcccacgtccacctcgtcctcccctgccaccatgttctgggcggccaaggtctccaaaattgatctccagctgagatgttatatcatctgctggcttctggaaatgatggtccataaccgattcttcagcatgagccgcttcactttttgatttatgaagaacaaatcccttcttccactgcccatcagcaccttcatttggttttcagatattaaattttacttttgcccagtcctt

SEQ ID NO: 152708 - DNA, 281 bp, Homo sapiens
acatcttttcccctgctgagacctcatcagcctccgatcttggctgagatatcatgtcctcccacaaaccctcctgagccaggaaccctcttcccagtgggactcactacagagaggacccagcctgtggtgatgatgatgaagaagtggatggctacggcctttctaattttcccaccaaactgtgagcttccagacagctggcatagaagtacccaaaacatgtttgtagaatgaatgaatggccttcacaagctaaggaacccatggcttcttcactg

SEQ ID NO: 152709 - DNA, 449 bp, Homo sapiens
ttgatctcttcaactctcttcattgcgtcaatagttttattccatagctcttgctagtatttgataggttcatttctatgtttttaaaattcaaatgaattatccactgtaagctctttaccagctgctttccggaatgctttggtccacctaactttgcgaggattgcgcttctttttaaagtttctatgacacttagatttacaaaatctgaacaccttgcagtcgttgcggacaaacatcatgtcatggctggggtagatgggcctcgaagagaaataacacttcttgatacgcatgttgaacctgtgttggtcccctttgctttcttaaccatgccaaacatactcctccctttgcattggtccttctgcctggaatgtcttctctcagatatctgtaaggctaacccactcactttctttatgtctttgctcaaatgtaccttc

SEQ ID NO: 152710 - DNA, 347 bp, Homo sapiens
ttttagtagaggcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacaaaaggatatactgtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattga

SEQ ID NO: 152711 - DNA, 105 bp, Homo sapiens
ttccttgtagatggcaccttctagctgtgttctcacatggtgggtggaaggagtgagtgagttccctcaggcctcttttagaagggaactaatcccattcatgag

SEQ ID NO: 152712 - DNA, 629 bp, Homo sapiens
atcatttgagaacccatgaaaatctttagtaaatttaataatcctagaatcttcctttttttctagtctctatgaaattgctctcaaaagttaacaaatttcagtaatatagcaatcagatgacatttctatatttatatggcggttgggctcagagatagcctttacaagtgatgacaagattcaggctttagtaactatagtctcacagcaaagttttcaacgcagtcatacagtgacatttcagtcaatgaccaactgcaaatatgatggtagtcccataagattttaatggaacaaaaattttctatcacctactgatttgtgttatgttattccctaccatattcagtacagtagcttgctgtacaggttggtagcctaggagcaataggctatactatatagcctagattgttaagcgacacatgattgtacattgtaatttgttaggtcttttgttatttaaaatatcctcacaaaattccagtgggcaatacttggaagtaaagctctcctcagcaaatgtaaaagaacagacattataacaaactatctctcagaccacagtgcaatcaaactagaactcaggattaagaatctcactcaaaaccgctcaactacatgga

SEQ ID NO: 152713 - DNA, 158 bp, Homo sapiens
caagggaatgttgacttttgtcactgctttcctctgatttgtatgctcatttctggtccttgtgcaaagtcacggaggcacagtcacatacactgacccagattttgtgctcaagttgactgtctctctctttgagatgtacaactggttccatgtag

SEQ ID NO: 152714 - DNA, 469 bp, Homo sapiens
cgtctctactaaaaatacaaaaaattagccaggcgtgatggtgggtgcctatagtcccagctactcgggaggctgaggcaggagaatggtgtgaacccgggaggtggagcttgcagtgagctgagatggcgccactgcactccagcctgggtgacagagcgagactccatctcaaaaaaaaagaaaaagaaaaaagaaatgctttgccaatgtatctagtgttttaaatcatagcctactaaatattacttttttcatttctttataaatgtgtaagtgacagaattattagcattttgacagaaatttgtaaatgctgtggacaatcgtaatttttcctgttgatgattaaggttgtttggcacagtttcggctttcatagtcgtttctatggtcctgcactatttttcaaagtgagaactgtatttcaagtgacccttttttttttccaagtgacatttttttttct

SEQ ID NO: 152715 - DNA, 379 bp, Homo sapiens
agcgggaaacaatcacttgatcctgggacggaggtgcagtgagccaagatcgtacctacagtgacaggtcgagactccatctcaaaaaaaaagaaaaagaaaaaagaaatgctttgccaatgtatctagtgttttaaatcatagcctactaaatattacttttttcatttctttataaatgtgtaagtgacagaattattagcattttgacagaaatttgtaaatgctgtggacaatcgtaatttttcctgttgatgattaaggttgtttggcacagtttcggctttcatagtcgtttctatggtcctgcactatttttcaaagtgagaactgtatttcaagtgacccttttttttttccaagtgacatttttttttct

SEQ ID NO: 152716 - DNA, 219 bp, Homo sapiens
cctgcagtccgatggatgggacgaagctaccgtccctcctggagccagcagcagaggggtgagaataggaagattaggtggaagcttgagggagaagatatccctgcttgccacctggctgtgcgagttgggcaggttgcttgacctctctgagcctgcatggtgatgctcccgtcttcctccatagcctaacaagtgccccctcctgtcccactccat

SEQ ID NO: 152717 - DNA, 405 bp, Homo sapiens
cttttacaggggggtcgcagggaggaaggaagcctcacatttcccacccctgctgaccctgcttcttcaccaaggggctggaaagacattcccaaactgacctttctccactgtccccaaaggcgagggtgttctgtgcaggaagctctgcaggaagcaggatgatggagtgtccccaaatggtcacttcccctgcctgggccccaggttccctggctctaaaaccctcacagctcctgctatgtgtggggttacctccaccagccatttcatcctccctgtaacccctacagatgaggaatccaagtcacagagaggttaagagatttgcctgaggtcacacaggcaggaaacagcagagctgggatctgaacccaggcctgactgactgctgcaacgccgcat

SEQ ID NO: 152718 - DNA, 510 bp, Homo sapiens
ttcttgtgacagtctgttactacttcaagtgtttatttatcattgtctgtcttccctgctaaactggcctaacaggattctcgccaaaggcaggtcagaccctcaaccaccagtggtgggggtgaggagcatgatcagataacaaacggtgctcagacagcaagcggggaggaccctccctaaactgatttggggagattcttgctgagccaaggtggtgcaagtccagaaagcagtgggtgagtgtggaaggccaaggtcggcgcctagtggagaagaagctctgaagagcccagctggagttggtcaaggagaaagtccttctttctcaacccatgccttagtgtccagagtatctgctggggctggatcacaagctgccctcatggctagagtctccagcccttccctgagatctcacacctttagtccccaagtcctctggaagtcaggaaagacaccaaatagccccaaaccctatcatccatcacatcgctatactgtcccgtg

SEQ ID NO: 152719 - DNA, 248 bp, Homo sapiens
tccatgaaggcttttgttgtatctgtgctgtcgatgaattctaggtcttttcagtctagtggtagaaggcccaatttcagtctgacctgtttcaaggtaaggaataaatgttattcacgaatgaaatatacaggcacacaaaatgagatgtgaaaagtatatgtttcaccaactaattcagggaaaaagaaatgtttgcgttatcaaagctgtttctcatctactaaaagttaaaattaaggagagtg

SEQ ID NO: 152720 - DNA, 495 bp, Homo sapiens
tgtccagtctctgtactttctggggcctctcctgttgaatggctaggcacctgcaggtgtaggggctcagggtcacctccggcctgcaggtcaatgtcttgctgctcctgtcctggggagggcagctctctcctagcccaacccaaaagcccccagaagcctccacacagccagctccggagtctgtccttggcttaggtggcttcaggactgggccaggcacctccctcacaggacaatcagacatgaagggtacctttcaatcacacaatcctacacagtcctagacattaggtgggtcctctgccctctgcaggtgacctcatcagagagcccagcagcatctgcccatttcctgtctacattctcctccctagtgcactgggagtgggaggagagcccaaagctcccccagatctttaggaagccccactgtcaggctgagtggagggccttagtgacaagtgataacttcagggaagtccagagtgggag

SEQ ID NO: 152721 - DNA, 179 bp, Homo sapiens
ggcccaggctaacttttaaatgaccaaactgcattgtaaattctagataagccagttttccaggtgtttaatcaaacgcacacgaaaggagatgctctgatgagatgagatgctgcgtgctcaaggcctctcccaaggggtctgtgcggactttcagcttgagcacctgctgtgtgcta

SEQ ID NO: 152722 - DNA, 381 bp, Homo sapiens
gggagactatagaatatcctctaagagtgtgggaggctcagatgactcactgtttttgtcctagcaactagaaggatggaattgtcattagctgacatgagaaataatgtgggtagagcaggattgggaggaaagaggaagagttctgttttgggccacgctgagtttgagttaggcattggagtgtagcttctgagtagactgctggttattgctggcaagggagaggtcaaagctggaaatataaatatggtatttatcaaaatagagatgatatttgaaggtgtgaaactaaggcaagatcaccaaaggagtgagtcctgataaagtagagaggctgaagggccaagtcctgggaagtgccaatattaagaatttaga

SEQ ID NO: 152723 - DNA, 508 bp, Homo sapiens
ttacttttatcatgtgacaaaatataataccacatgtctctttcagctggctacatagcttagatgacaaaacagtatcttgcaggcaacctgagctctttgagaaaacgtggaaagtaaacataaaaaattatcaaagttatttatttttaagaataagctcttttgaagaaaagtgaagggcttaaaaggttgtattatgatgagatggcaatgaatatgtgcataagataaacacgtttattaaatcacgcttgccaatgaaggttgtgaatagcttctatcgaaatagcataaggttgctcttatgaaaggtaatgaggtgtagtcttttgaaaatatatcctacttctaaatgcctgtaaaatggaaaccacactaactctgctgagttatgttaataactggtgaaaagcgtcttattctgaagtacttcaaaaaccaattattccaagtggctaccaggtgttgtggaaggaagttagtttggttttgggtttttttccaa

SEQ ID NO: 152724 - DNA, 222 bp, Homo sapiens
gggccaccgccagcttcccagggccaggactgtgcactgcacgatatggctcactcccagaggacagtgtcctaaccagagtcagatgtttcagctacaggagagaggccagtctctatatgtttgggaaaacttgaaagaattctggaagagccataaatcttgaactggagccttttatcaacctctaatttatcatggtctctgaattactttgactgg

SEQ ID NO: 152725 - DNA, 633 bp, Homo sapiens
atgccatttccaccctcaccatgcacccccacccaccccacaagttagtttgtgacctggtggaggctataaaagtgtcttaccttgtgggtttttttcttttcaaaaaatgtctttattttgccagcaccttgatcgtatattttctggtttttcagaatgtttttcgttctctatttctgtgtattcattagaaatacattttttttgcaatctgagtcaagttctcaaaaatgattttcgcaagtgttctttctcccaaactgtttgctccttgaatagagaactgtcttactgtgtttgttttgtcttgctctctattgcccaggctggaatgcagtggtgtgaacacagctccctgtagccttgacttcctgggcttgggtgatcatccttccttagcctcccaaagtgctgggattaaaggcgtgagctactacccctggcccttactctgttttgattacactgtgactagacatgcatattgtgggcattaaaaacttacttctatggttatctcacctttctaattcagacaaagagtaatttgtcctgacgtattcttcctcatctcttctcttcccttctgtccaggtctgtcaggtacatatttaatttctagaggataca

SEQ ID NO: 152726 - DNA, 743 bp, Homo sapiens
aaactagttaattaaatgaacataatttttcaagttaataaattaagaaaatatctaaatgaaagagagaataaaatcagcatatgtgacagcccatatagtaaggacagtttcgcaatcaacgtaaccaaggaaaacagctttgttatcatttcaaacatgcaggcacacacaggcagaggcaaagctggaaccaaaccaaacaaaaagaagattttgaatattaaaaaactgggcctctagacactttgccttttagaaccagcttcctacatgttcaagtaaattccactgatagatcttgactatctacaatgtgctaggtattatgttaggtgatgaggacactaaagtgaataagacataacccttgttctcaaagagctcacaatgaaattaaggaaacagagcgagatgacttatcatcatctaatccagcaagtctttcctaatcctcccatccctagttcaagctagggaccttctctatgctaaacctgtgccttgtatataccttttattgtcacactaccccaatgtgtgatttatttgtttatgtttccatctccatttctagactgtgagctccttgagggcaggatttgtatctaattgatctctgtccccagtgtctagcatgatgcctggcacaaagagggagcccaataaatcactgttgaaaagaaccaagttacgatatgacaattgccaaatacaagctcacaataagagcggtatggatc

SEQ ID NO: 152727 - DNA, 174 bp, Homo sapiens
aggaactgctcggatcttaaggtttttcacactcttttcttctttgcatcatacctgcatgcatgattcctagtttattgagtctctgctcaaatgtcattttcttcatgtggccttccttgacactctatttaaaatcgtagtcctactgccccacattcatgatccaacccc

SEQ ID NO: 152728 - DNA, 225 bp, Homo sapiens
tggctatggagatggcagaggccggaacttcctccagtggcgtggctgctcggcggacagacagaagcacacacagtgggtgggggtgagtcgagggagctcactgggtcttagggaggccaaaggtgcctgtccagaagagagattagggtagaaatcacagaccaacacatctgctgagaaaaaggggccagagaaagaagcaagagtctctaagtaggggag

SEQ ID NO: 152729 - DNA, 799 bp, Homo sapiens
ctcagtacaaccgctgactgtgctggaaccctgatcttagacttcagcctccagagctctgggaaataaatttctgttatttataagtgactcagtctatgatatttcgttatagcaacatgaacggactaaaacatcccctaatttcttgtgagagtgtggcatacagagtaaattctttgagcagccattcctagtattgctttccctaagcgctctctgctttgcttggaataagaggtaggagggtttggagaacactcccctgggtgttattctagtgcttcactgctttccctcttaaagggcggcctagcctagctcctggcacatgtttgccagtgatgtagaaattctgtttctaaggattaaagaggtagggatgaaaataattaggcaacttgcagcctctgccacactcatatttcaagattcttctttgattttttcattttagtcacttaatgattcttccttcttgttttattcttccttgatctccagggactgtaaaacaatccagaaacttagtaatattatgaacaagcatttatcagctggccacaatgtgcttattaatgttcaaatactatgaggaatgtcagctttgctccccaaaccttgttagactcaaaccctcatgagacttgataccatgactactaatgtccttttattccccaaatcgatttccctttcctttcttactgggttttagatgcagatgacacagtccagggaagatcggagggcctgtctgagtatggagaagtacgagctggtattttatatagcctat

SEQ ID NO: 152730 - DNA, 385 bp, Homo sapiens
ccttgagagagcaagtgtgaactcatcatacccattctacagaaaagggatcaatgagaaactccaggagaggcaaagctctgataatgcctgcatcaagctacagctggagagtagaggatctggctctcctgtgaagctctatccacagccccaacacaaacactgggctgcctaagcaaagcccctgaatcaccaacccagaacagattctgattttatcagttgagttgttgcagccggggttaccatcgtgacaatgtcccataggtgccacagacaaaaaacaaaaataaacactgctgacaggcaaccgtgacaggtagacttagggaataactggccaggccagaaagaaagtacagctctgaagaaaaacacttag

SEQ ID NO: 152731 - DNA, 406 bp, Homo sapiens
tatttgctgaaactcactcgatctgctttatctagaatcttcagtgaacttaggaacaagatttttcttttgttgtctctttctctacaggactacctattattcacgtgtcttttggcaggttcttggttttatagctctcatgtgggacctctgtaaagtgcacatggccctcaccttgaacttgtttgttaagtttgccctggaacgagagccagctctgtcggccccagaaccaggggattccacattggaaacaaacaatcaccgaattgtcagtacttagacccagtgagacacaaagcgagtgctgttctgtacatgtggctggtgacccactgctgagcaatgcacctacaggcttggccactgctgcacaactgctcaactgaagtgaggggacagg

SEQ ID NO: 152732 - DNA, 589 bp, Homo sapiens
gctgaggcaagaggatcacttgagcccaggaagttgaggctgcaggaagctgtgattgcaccactgaactccatcctgggtaacagagcaagaccctgttacatatatatagttttacatctgcatatttatttaaagagctttctgtgggctgggcatggtggctcacgcctgtaatcctagcactttgggaggccgaggcaggcggatcacctgaggtcgggagttcaagaccagcctgaccaacatggagaaactccatctctactaaaaatacaaaattagccaggcgtggtgcctcatgcctgtaatcctagctattcgggaggctgaggcaggagaattgcttgaacctgggagatggaggttgcggtgagctgagattgtgccattgcactctagcctgggcaacaagagtgaaactccatctcaaagaaaaaaaaaaaagagctttctgtgaatatcatataaaaagcaaaacatttgacccgaggagagtagttattttaaagaagtgagcaaaaatgcttgctcagcactcatttagttaactccccagctgaagattagttgtttggattaagtagct

SEQ ID NO: 152733 - DNA, 285 bp, Homo sapiens
gtatcatcacaatgtcattaatacctcaggctaatattgtgaacgtaactgttttataaaaaagtaaaaaatcaaggctactatatatggcaaacagaaacaaacgtaaatgtttccttttgtttacagcactgattttagctagactttaaatgaaggtcatcaactctcctgaaataacctcaacctctggccataaatctacagtataaatatgatgaataaagttaaactatatactaatcaattataacaactaatacggctcttgaaaaccaatcttat

SEQ ID NO: 152734 - DNA, 148 bp, Homo sapiens
gacagttcactgtaaactgtaaagtgctaaacaaatatattgttgtcgctgctgctgttggtattattataaacgcatttgagccttttactgccatcaaggtgagaccatctctgatactggactttgcctctgcacatctcataca

SEQ ID NO: 152735 - DNA, 298 bp, Homo sapiens
tcaccttgtcgataaccctattttcaaacctatcatttgacaaattttagctatccacacagaacttccaatcagtattttagtgctccactcttttttttttttccttgagacagagactcactctgcaccccacaggctgtagtgcagtggcctgatctcggcttactacaacctccacctcccaggttcaagcgattcttatgcctcagcctcccaagtagctgggattacaggcgtacaccaccatgcctgcctaatttttgtatttttagtagagacggggtttcaccatgtt

SEQ ID NO: 152736 - DNA, 1743 bp, Homo sapiens
  misc_feature (417)..(417): n is a, c, g, or t
  misc_feature (1052)..(1052): n is a, c, g, or t
  misc_feature (1109)..(1109): n is a, c, g, or t
  misc_feature (1728)..(1728): n is a, c, g, or t
gtaccccctgacaaagtataataataaaagaaaaaaaagaaaaaaaaaaaaagcaattgcttgagactacttcactgtgagctccttttttttttaaataaatgcagattttatgatattcctgatcattctctttgcacttagatttaaaatgttatttgcagttgattagagcgtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgagnacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaacggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcantccaaagttaacctgaaaaactggttcagaccatgatgggaagtaggggtcagatangcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatatttgttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaancccatttctaccaaa

SEQ ID NO: 152737 - DNA, 1585 bp, Homo sapiens
  misc_feature (259)..(259): n is a, c, g, or t
  misc_feature (894)..(894): n is a, c, g, or t
  misc_feature (951)..(951): n is a, c, g, or t
  misc_feature (1570)..(1570): n is a, c, g, or t
aatgtggggcccatgccaataatctttttatactgtggggatgggaccaacgttaagttgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgagnacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaacggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcantccaaagttaacctgaaaaactggttcagaccatgatgggaagtaggggtcagatangcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatatttgttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaancccatttctaccaaa

SEQ ID NO: 152738 - DNA, 410 bp, Homo sapiens
tatttggaaatatcagttagcagttttagtcagtagagtaacatattttctatatttatgatatatcaaagagactttctgaagcagaaccctgattgactcaagagtcttttccaaattctgtattctctcagaaccaggatttaataggaggtgggtggggggtggtccttggtcaaactggggaaaagcctcataatgagattgccaaagcgcttacagcatttgaaggctcagagagatgccgtggtcaggaagcttgtttgagtctgtctggaagccagtaagtcccacagaatacctactgataatcctgtggaataagcagcatatggaatgttgctgagctagaattaaagtccacacacggccaggcgcggtggctcacgcttgtaatcccagcattttgg

SEQ ID NO: 152739 - DNA, 659 bp, Homo sapiens
tatttggaaatatcagttagcagttttagtcagtagagtaacatattttctatatttatgatatatcaaagagactttctgaagcagaaccctgattgactcaagagtcttttccaaattctgtattctctcagaaccaggatttaataggaggtgggtggggggtggtccttggtcaaactggggaaaagcctcataatgagattgccaaagcgcttacagcatttgaaggctcagagagatgccgtggtcaggaagcttgtttgagtctgtctggaagccagtaagtcccacagaatacctactgataatcctgtggaataagcagcatatggaatgttgctgagctagaattaaagtccacaccgcctggccgcttttgccttttcttgacattgccaatgcatcctgtccccgagcgtctctgagttttaagtctcagatttgttttctttggagacaaactgcaggtaggtgttacttctcaccgaagttcccagatagcacaggctttgctaaacaacacagcaccaggaactccatcatagagagcgcaggatgctgtgtgcgcgacatgcgtgtgcacctagtgagatgtaaacatttacctggagtaaaagaaattctttccccagagcccaaatttggctagtctcctt

SEQ ID NO: 152740 - DNA, 648 bp, Homo sapiens
ccacctccctctgttctcccccactgatcctggctggaaaggctgggcttccggaaaagagaggtggatttgcacacctggatcccaagctgatagaaagtggggtgaagacaaaggggactcagactggggtgtctgtcctcttctatgcccacagtaggaggagccaggattggttactccctgctgggtctgctgtgctcagagtgaggtagagaagtgggtagagtaaagaatttgggagaggaaaaaaggcattttcccaacccctcccaccaaagcctagagagaaggtgttgtctggtttaatgtttaattagagctcagagttcagggccagatttggagttgggatggaaagttgtttttaagaccctgtagcaatttttgacccagcctgggtacctcaaccacactcaggagtttgggggaccttctgttgggctggattataggctccaagaagaaacccctttcgccaatactctctctctcttctttttttgagacagggtcttgttctgttgcccaggctggggtgcagtggcatgatcacagctcactgcaacgtcagcctcccgagtagctgggactacaggcacatgccatcacgcccagttaatttttgtatttttagtagagttgggg

SEQ ID NO: 152741 - DNA, 621 bp, Homo sapiens
ccacctccctctgttctcccccactgatcctggctggaaaggctgggcttccggaaaagagaggtggatttgcacacctggatcccaagctgatagaaagtggggtgaagacaaaggggactcagactggggtgtctgtcctcttctatgcccacagtaggaggagccaggattggttactccctgctgggtctgctgtgctcagagtgaggtagagaagtgggtagagtaaagaatttgggagaggaaaaaaggcattttcccaacccctcccaccaaagcctagagagaaggtgttgtctggtttaatgtttaattagagctcagagttcagggccagatttggagttgggatggaaagttgtttttaagaccctgtagcaatttttgacccagcctgggtacctcaaccacactcaggagtttgggggaccttctgttgggctggattataggctccaagaagaaacccctttcgccaatactctctctctcttctttttttgagacagggtcttgttctgttgcccaggctggggtgcagtggcatgatcacagctcactgcaacgtcagcctcacaggctctggtgattctcccacctcagcctcctgagtagctg

SEQ ID NO: 152742 - DNA, 283 bp, Homo sapiens
ggctctggagcatggattgtacctgctgcagctggagttccttcctcttgaggcaagaggaggctgaccagtaccagtcattggtatgggctgcctaggtttaggggtaggcagggcaggattttttttttttttttttttttgagatggagtctcaccctgttgcccaggctggaatgcactggcgcaatctcggctcactgcaagctccgcctcctgggttcatgccattctcctgccttagcctcccgagtacctgggactacaggcgcccgccaccatg

SEQ ID NO: 152743 - DNA, 356 bp, Homo sapiens
agctgaacttctctctatgtctcctccaccaacagtgacaagagattcttacccctaaagattgagttcatgtttacaaaagctcactattaagtcatgcaaagaatgcaggtagccggagaagccagctcagcatcgaatagcttcaaggcactctagaaaataaagccctactctaaataggttattattaggatcataagcagaaactcgctaaacaacaaaacaagtaacatgaaccaaagtaaatatcaaactgagagggtttttacaacagagactcttcttttcatatgctcccccgagacaaacagcccattcttcagccaccctcactcactttccccttgagaatt

SEQ ID NO: 152744 - DNA, 451 bp, Homo sapiens
ttgtttccaagtttgggcaaatataaataaagctgctataaacgtccatgtgcaggtttttgtgtggacagagttttcaactcattttactaaataccaaggagcacaattgctggatcattcagtaagagtatgtttagttttataagaaactgctagattgtcttccaaagtggctgtaccactttgcgtttctactagcaatgaataagagtccctgttgctctacaattctgtttacctttcacatggattgatggtcaattgtgtcatagcacttactacaacatgtggctgatttgacacatagctcccttgtaatggtctcttctactcatttagaaaacatggaatactggtatgagctacaaggcacaatgaatttcccttgataggtcaaaaagagacccagcttagcaggcacaggggctcatgcctgtaattccagcta

SEQ ID NO: 152745 - DNA, 411 bp, Homo sapiens
gcactccattaataaatgccacatattattatctcatccaagtatttcaaatcacttccaaatgacagctcccacttcagaggcaggtagcaggatggaaaagggtggagagtacatcctaaccgaatggtactcagagtgggagaggctgagctgattatcttccaaccttataacccttctcccaaaagggccttgctggacgttctgtaattccagttttgaaagaattcaataaaatgctcattgcagtgctgcgtttccaagggctttgctccttgttagtgggggtctaggcttccaagctctcgggcatgaaatgaggtggtggttaaggtcagggttgcagttccttgacaagcagaaactgcccccggatgaggcctcccgtgggcacactgtactctggaa

SEQ ID NO: 152746 - DNA, 559 bp, Homo sapiens
aggatgaaattgttgacatgaggaaaaggatggggtaaatgtggaacttaacagagatggaacctgtgctcgcaagagggtgcctacctaatataaccataaagattacagtttaaaatcacaggtatatttcaataaaattgttattctcccaattagagaaagcatgccagtatcagcactaaaaatcttaaaataaatcagaaatttttccctaaatcccagtcagccagcagacatcaaataaaaggtaaaaaagtccaatctaataataaggaatactaagacatactcatgcctgaatgcaattacaactgtacttcacacagaactggcagaagaggatggaggagcaagagtgggaatttagtctttctaaaaggtcaccaagtatgaatattttaaatccagagactacacaattctaaaagtgaatgcctacaagtccactaaaaatgttaccatggagcaaacacgccagtgggaaccaaaaaggctggtaataacatttacgggttgaaactggggttggtggtgagggttcctattgcagaaactg

SEQ ID NO: 152747 - DNA, 375 bp, Homo sapiens
agatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatat

SEQ ID NO: 152748 - DNA, 182 bp, Homo sapiens
tccacttctgctgaatataccaatcatcccagtcatacattcatgttagatccttagcagtaagagtccattatgtatctcctatttgtgactgcggcattatgaaacagcatctctgttctccaattatcaatttagaatatctgatacagttttgtcaatttcatgatgcagtgaagtgt

SEQ ID NO: 152749 - DNA, 222 bp, Homo sapiens
gcctttgccccacttcttgaaagatattttcactgaatgtaaaatctgagatatcagttattatctttcagaatcataattgtccctttctctgctgccttttgggctcttgttttacctgggagcttgttctgttgaacaggtcatttttccttcctctggacacttttaagacttttttcccctttatctttggtgtttggatctctcattaccacacag

SEQ ID NO: 152750 - DNA, 217 bp, Homo sapiens
taaaataacaaattacccagaatccaaacaacaacctggatttggttttgtttctcatatttcaggacttctaaactaatctgttcttatattaaacactactcaatgacatctcatggttctctccaatccctaaagttacatggtattaaaatcctgaaaaactaagtgattaggcaattgaactatattttatttcaccttgtaaccaaattct

SEQ ID NO: 152751 - DNA, 467 bp, Homo sapiens
actgtccggcgctctagcgagagaagaaacagactgaaccgtgactacggcttcagtgtgccacagtgtaccactgtctccaaatcacagacctaccaacctctgctcctcctgctgtcaagggacgaggctcccgactcatctggtggaggccatggagctgcccactgcccagcccagccccaccagcctcggccctggcaagcccaccccttccttctccttggcagacactcttctgcggggaccttctgagccctaggccacaatcaccacgcccctgagtttctcagcctgattatctttctgctcagctcattccacagaccacactctcctacccactgcacacaatccgcctcacacgttgatgttgaaggagcgctacatcaaagacagaaaaaacaagtagaatatccacacccgaccccacagacgcaggagaggatccacacccgaccccacag

SEQ ID NO: 152752 - DNA, 393 bp, Homo sapiens
acacacacacacacactaggagtgtcctcaaggcccagtaacttgggaggattggaaaaaataaatacaagagataaggagaaaaataaggagagatgagtcacaattagactaacagtcccatcccctcccctacaccctgcaactttgctttgtgacttgagcagcgtcccaccccaccctggggtgatccctgggcctcctcgaatccctctgaccttacccaggagacccctgccacagcagacagtgctgctaactgctccctcaaacacccacctctgcccctacctgagaactccccaacttctgggcaatgtgcccagtgccagctgccagccaggtgggccaccccatctcaggtccctgtcactgtccctgttgctgctgtgt

SEQ ID NO: 152753 - DNA, 421 bp, Homo sapiens
gaaacccaggggccagggatcagggctccagattgctatgaggaccagagacctgaaatagctctgacccagctgaactgagggactagggcaatgccctgccccactctgactcagtttccccacatgacatgcatcaatgactgtcaagtctgcggttctgtctgactgcatttgcttcctgggaatgttctaggtgtttccatcaccttttctccccagaagaaacccaggaaatattctgtgtgacctgcagtgtggcagggccctcactcacctgccaatccaaacaatttctgtaccaccttagtatcaagcaagggggcacaggtacagtcgagattcaactcgtttgcaaacctcacctgctccccagagtgtcctgggggaacctaaagtgcaaatatctttttcttttttt

SEQ ID NO: 152754 - DNA, 475 bp, Homo sapiens
aactggggacaccaagttttgtctgactagcaaaggagtggagggtaaaggtaaaactgagggttcagtctgagtaagctcacaggtgaaagggaaggcaaactgaggacattagagttatagctggcactgtcaaaggctctaccgcaagacagctgctgtcagctgcagcatagactcaggaagtgattgtggtaagattctatatgacagcaaccacctccatggaactccacactcttctgaccacagaaataaagggttatacatttctgtgaagttacctacaaagaaaagcattccagcatagaaaggacatttaactgttattcaaagagcatagtgttctctggacatttcttgcatggcctagaaaaaggtatcctatgcccctctaagaagcagttgaaataaagggaatcagagattccagggatgccagaggtaaatacctgaagcaaagaggaccaaaagg

SEQ ID NO: 152755 - DNA, 160 bp, Homo sapiens
gaagcacatcatggtgctctatcagaccattctctttgcctgcatcttaccccaggcaagagaaagttgtcattctgaaagctcctttaacaagtatacttctattaattagatttatttctatctcctctacattttggcccagctgaaaaagcatgtg

SEQ ID NO: 152756 - DNA, 422 bp, Homo sapiens
actgtgatttcagcagagtgtgcaaatttctgagatgttcacattaaaaagtgctacaaattttcaaataatgtgactttgttaacaggatgtactatccatccagattttttaaactccactctaattttataatctactttcctgactcaactgtacatgagagaggtacagactcacccaaatgtatgctttctgaatattttctattatagggaaacagggttaaagacaccccagaccagatcccactgttcattctactttccctattctgaactacgaaaatatcacactgacgacaatggcaacttcacttgtttcctctttggtaaaatgggctgcctgggctaaatgatttctcaagctccttccatttctagaattctagccatataattaaggagctgattttcttagat

SEQ ID NO: 152757 - DNA, 275 bp, Homo sapiens
tctcgaagtgagtatgtggtgctgaagaaggatgtggctctagctacatagcaaggtggagttgtggcaaggtggttgcctgaatgatgagatcacttcctcaggacctacatgagacggattgacagagctgcagtcccagatctccgacacatctgtggtgctgtccatggacaacagtcgctccctggacctggactgcatcatcgctgagatcaaggcacagtatgaggagatggccaaatgcagccgggctgaggctgaagcctggtacc

SEQ ID NO: 152758 - DNA, 428 bp, Homo sapiens
cttcctgccctagggggattccacggatcctgagtcaccctgggagattatgaaactcaaaggtctttctcaaagatctttaaaaaccactgattctcaactgccaaattacagctactagtctttcctgatagtgttggctagacctcatggatgaccagaaggccttttcctcctctgcttctgtctaaaatgtcaggacttaggagcgcttgttatacatttcctggtaacagtaaattagaccgctatgactaagcgctagtgacagctgcgtagctaaagcaaaaccaaagccatcttctgtttgggttgcttagtttaatagaatagtgattgttttggctgggcacggtggctcacgcctgtaatcccagcactttgggaggccgaggtgggaggagtacttgagcccaggaggtcgaggc

SEQ ID NO: 152759 - DNA, 278 bp, Homo sapiens
gaagttagaagaatctcaaattaaaaatcaaacattgaaccttagagaaaactagtaaaaaaataacaaaataaccctaaaagtagcagaagaaaagaaataactaaaatcagaggataatagagtaaattgagacccagaaattcacaccaaagatcaataaacccaaattttcttccttaaaaggataaacaagatcaatacagctagattagattaacaccaaaaaagagagagatccaaataagcacagtcagacatgacaaaagtggcattac

SEQ ID NO: 152760 - DNA, 438 bp, Homo sapiens
cctcactccacctcactcacccctctgtcatttgcaggcaagacagtgaactcccttctgctcctcaaaccaaacttactccctcccaccttggctttgtctgagctgctccaggagtccccaccacctccaccctccctcccctgttgaccctcaggtcttggtatgtacacttcatggagcactcccccaacactgccagcctggggcaggccccttgccatgttctactcgacagcgctcacccatctgtgatcctacaaccctcatgtgcccatctgctctgtgtctgtgccctcagctagactctaagtttcacgtgtccagggcattacctagaccggcttactaaagtattcccaaacactaccagcaaagatctgttcaaagaaatgtgaacgaaacctgacccactgatgctggacagtagattcccgc

SEQ ID NO: 152761 - DNA, 409 bp, Homo sapiens
gaggtggaggtaggtggtaattagaaggggacatgagggggcttctgcagtgcccgtaatgatttgtttcttgatctgggtgctgctcacaggaatgtgtctagtttgtgaaaattacttgactggacatttgtgatgtacatatttttctgtatatatgttactattaaatgtttttaaaaacaaaaagtcaaaaactccttattatggtattagagtccccttatgatcaggaccatcacagtttataccacataaaatgttttgactccctccagtaccccaatgtaccctgcactctatccccaactttttcctgatccaattgtagaaggcatccaaagccaagtctgtttctgctaacgggtcttccagtgcaatacgtgctcccacctccccagaggtgcgc

SEQ ID NO: 152762 - DNA, 528 bp, Homo sapiens
gaatttaaaatgccagtattatgattaaatttccttttcagattttttttcttagaatgattggctttcttgtaatttcttcatatattatctttattttaaaagattgtttcattatatcagatacacaatcaagtcctctcttttccagccatccagtctgagcagtggcctggagatgagtgtcatttatacaactgcctttaatgctctcctatgtagaatcccctaaatttccagtgttccatgttttcttctttcctgatttgctcctttcttttcatggagtacatcctaaaataactttctaagaaagaatgaaggagacttaacatattgagcccttgtatgtgtacatctaactttattctgccacccctcctccatcacacgcgcacacacacacacacacacacacgatagttttcctgaatataggttaaaaataaatttatcctgttattgaaagcttttgctatgttttcttctaaatttcagaattgctcttgaaagctgatgtcaacctcc

SEQ ID NO: 152763 - DNA, 410 bp, Homo sapiens
tcagagaagtggtcttgagctgtgccttgaggacaggtggctggtggtatgaagacagcatttacagggcccctaactggtgcaggctctgtgaaggaggctttatagagatagatgtatttttcaccacggtccaatgcattaggtttcattgtcttttgcacatgacaaatctgacaggctaaggacacattcaggtaggtgttggagcttggctttgagcttccagcctgtgctgtggggagaattccatcttatgaggttacggggtgtgagggacaaaggttgttggcactggggaaagccaaatggtggtgacttgggaacagcttgtggtggccccatttttctggagcctggagtagttgtgggggagcagggagcaggaaggctgcagaagaatagggtca

SEQ ID NO: 152764 - DNA, 428 bp, Homo sapiens
tgaaagaggagagaggaataaagaagagaagggcagtaacagggagaaggggtcgtattccctggaaggttgaacgctgttccacatgtacctgtgaaaaccatcttagaagaaagcttccaaaggcacagcagaaaacagagtgacgatcagagcctgcatcgagaggtattacattggggagcccctaaacctccacgttgctggccctgtcagtcctcagtgttcaaacctcatacccatatatcacctgaatttgccatgacaaccataaaggctgagctggcagggtgtaaagactgaagaggagtgggatagatactgtgagaaagaacaaggcatcctgcaccaggatgtacttggtcattcccctgacactgcaggaacaaaagagaggccctaactttggctagtttatcactcctccc

SEQ ID NO: 152765 - DNA, 486 bp, Homo sapiens
caaagggctaagcctgtactgacatatttaattctcacagcaacctcatgaagcaggtagtattattagctccctgttgcaattgaggaaaagaagcacagagaggtacaggaacttgcccatggtcatatagctggggaatggcaagctgcaatttgttcctaggcagcttggctgcagagtctatgctctcgactactttcatttattgttctgctctacccatctcccgagggggctctgccattcaaaagcaatgattcacatctttggagaactgattctctattgttggtctcttgacttttcttctgtcttgttttttttctatctctattccagggctctgtatgacatatttggtgttcttttaacaacccagtaaattaaattcattttgcaagtaaccgggggagcttgtagtagtacaataaaaggactggaagcccctgatttaattctctcctcttccccaatcctaacatc

SEQ ID NO: 152766 - DNA, 702 bp, Homo sapiens
tgaattagagcctggcaatctgctaaaataaaaataaaatagaaaaagatgagattactctggctaaaccattttagatacttgaatctcttaaagcacacttctctctcagtaactatgttaatatgtactaaataagacagtagaactgattagctgttctactgtcttatttgcaattagaattcacttgttggagaagtctgagttacacttactttcacaaatatgaatttagctatgaaaactaagttaaatttgcaaagactcattgaaggcaagtcactaaaaaggtttcacttgaattaagagaggaaatgtaaaaaattagagataataatcttaagaggcagtgcacactacttagcttccatttccaggtggctttagagtcttgctcatcagaaacagttgtaaccatttaaattgtacacaaaaacttgacacagctgaattgcataatgtgaattagctttaagttaagaaaaaaaagaagccacaatgtatgtgtgtgtgcacgcacatgcaaaaaaagacaacctgaaatcccatgagaacctttagtaaaatattggcagtgtcatgttttacagcaagtagaacatgccttggatgatggaaaacacaccatggtatccatgaagtcagcataagaaaaaactatttactgatcaggctgctacttaaattatgctttaagtt

SEQ ID NO: 152767 - DNA, 300 bp, Homo sapiens
aagcgttagacagacagaaagccattctcaagtgaaaagtaatgggcaggaggtaattagggccaggacagtaacaaaaggatagagaggaggaacccattggagtatttgggaaataagactgggaaggatttggtgactcactgatgccacttaaccatcccaggtggtcaacccttgaaaccctgcttcagagcagcatggtaggaaccttgagcccatgtagatcagtgcttttgagttgcccgaggatcttgttaaaatgcagagtatgctttagtgggtctgagattctgtatt

SEQ ID NO: 152768 - DNA, 710 bp, Homo sapiens
tggaattgtcacggatcctatctacatttacccctcaaactcaggtcctaatctgggacagagcagaaaaagaagttgaaaataattggctgggtgcgatggctcacacctgtaatcccagcactttgggaggccaaggcaggcagatcacctgaggtcaggagttcgagaccagcctaggcaacatggagaaaccccgtctgtactaaaaatacaaaattagccaggcgtggggcgcgtgcctgtaatcccagctactcaggaggctgaggcagaagaatcgcttgaacccgggaggcagaggttgtgatgagctgagattgtgccattgcactccagcctgggcaacaagagtgaaactctgtctcaaaaaaaacaaaaaagagtctgggagagggaaaaaagaaaggcagacagcttggtgggtagatgggtgggacaaaagtattgaggagaggaagacaagaagctggtttgggagattcagggtcttattaacattttaggccaagtacctggaaagtttaaaacaccctgtatttctttggacatgtgctaattatcatgacttattctgacatttcttagcctttttggaaatttctcttcttggctgataactatcatttttctctctttacattagggagtaagagctttgaggtacaagaatgagacggttgtggcagacactcatgttgtcacggtag

SEQ ID NO: 152769 - DNA, 181 bp, Homo sapiens
tttgcagagatacctggcacggaaagtgtgtccacaggcagatgtgaccatgagactatctttacctgctgcaatttgcagatgttttaggagcaactggactttgaccaggactctaattgagttatagtccagtggttccttggggaagcaatgggaggagtatttaaacatccaatgt

SEQ ID NO: 152770 - DNA, 222 bp, Homo sapiens
tttgttgtaaccatagtcttaaggaaaggagactggacaacaccaattaactttttttgggtgctctcctggaccagatgccaacagagcttttgcacatatgatcagctcatcaggcactgttggcttccttttctctttcccgcagaggctgggatggttctgagcactgagttaattacatgatgctgcagtacggtgggctccatcctctctgccctg

SEQ ID NO: 152771 - DNA, 747 bp, Homo sapiens
ggagaatgccgattcctcactcttcatcatttctttggtatagaagaaaatatataacgtaacctacatgaattttttcactggccctctaacattataagacagagcaagtggagtaactcatccactggggagggctacactgaggaaaaaaccctaaaaatttgcagaggtgatccttcaagaattcagcagaatcgttttcaatgtatgcatgtaagaaaactatgcatggctgggagatgaggagagttcgagtactggattctcaaccaggggatattcaccaccactctctcccacccccaccagttcttacagtgaacacattttgcaccaactgtgctctctgcctgggattgcctttccctggatatgtgcattgctaccttgatcattgtcttcatgtttttatctttcctcccctgttgcttgattagtgtggatcccaacatttaagaacactggatggattcatcgcctaaatttagccacctctcaggtaaatgagaagcaagtttatgaccaatattagccaactggtaccaggctacatcattggttggactcttgaaaagaaagcttattggtagatgaagctgaaaagatgcgagggtgggaactgctgtgattacctagcaaacataacatgacattctgtggagaacaacggcatctttgagaaccacaggaagatgaaaagggggagcatgtgctgacacagatgtgtaccactctccagtgatc

SEQ ID NO: 152772 - DNA, 656 bp, Homo sapiens
  misc_feature (560)..(560): n is a, c, g, or t
tgtggacacaagcgtgctgtgcctatcacacatggtatatattgaatgtgtcgcttgaatccacaggcgatcgactagaaaagaactaacatgacattgatgtaagtggctggcacccctcttacaacgtattgactcaaacaacctacccgtcgtctctgggataacagagattgttgtgcggtgatataataattttttttcttttttgcctgttcggctacttctggggcccggactgaaaagctaaccatgaccaaccattaaactgtggaatagtctctccacgtgaagaaagcccatcgtttgagaccattaaaactggattcttcatagccctggagcatgactgtagggatgacctctgagctggccagaatggacacattaatgaccaaataggcctttttccatccctgacgtttccttttggattgtgtcgactgcgtatgctgcagggcgtaggccggtgcgcggtgtcgactgcggatgcgcgggcgtcgggtctgtgacagggtgggggggtgggggcaggggtgggttgggctggggggagtggnccccattcgggctctgtgtctctcattttccctgtctccctccagggcctcgtcccagctggcatccggctcatcccccacaccgtgcttggatcg

SEQ ID NO: 152773 - DNA, 569 bp, Homo sapiens
cacccacctcagcttcccaaagtgttgggattataggcgcgagccaccatggctcagcctcatgttcgtttttaaaacttaggatggtggctcttttacattgattggtaggaactcttcatattacgaggcagttagctagttgtctgtgaaataaaatactaatgattgaactttctaggaagtacctattctgctaatagtgtaaatatacacttatccagggtcagaaatactcaagtttacccacttaaaagatctagaaaatacatgaacttgggcttacttgccagttaaaattgtttatctcagaattgtaccatcaccttaattaaagtagatatgctaggattatcctgataactaattaacatagcctttccccttagtgttcttcacctgaatgtagtagtggactcttcaagtctagcagaggcctgtttttaaccttacgcccataatttttttttttttttgagacaggatctcgctctgttgcccaggctggagtacactggcatgatcacagttaactgtagccttgatctcctaggctcaagcatttctcc

SEQ ID NO: 152774 - DNA, 282 bp, Homo sapiens
tacgaatcgagctcggcccgggttactagaaaagagaaagagagcctttgagctccatagaagcggtgaccacatgaatctatctttatactcaaatatctacaagagggtttgggaacaaatgagtacaaacagccatctgctctgtggaaaattcaggccaccataacacgtgtagataaatatacatgcatttataccccatcacaaggtagctttgcttaatttatacaaaaaagtgagaaatctattctggaagatatctgtggccattactactac

SEQ ID NO: 152775 - DNA, 263 bp, Homo sapiens
ctggaatagacttggcttctgggggtgtgctgccccctaggccccttgggtctctttcgctggactttcacatcctggtgtagtgccacttcgtcttgaaaggtagggggcttccacttcctttctgtaagcaaggaagattgggtacaagggaggtaaaaggacaagagggggaatctgtgagcagggggaatctcggacaacttaaaagagaagggatacaaaagactaaaaattttaaaactgtgaataatatatataaa

SEQ ID NO: 152776 - DNA, 618 bp, Homo sapiens
tataatgtaatggtagagataggataaccacataagaaaaatacctaacgttcattataattaaacaatataagcaaaagtaaaccagtaactatagtgaagtaaatatgtcaccactaattggaagcaatttgaagcattatctggctaatatcaaacagccttctgagaagcttttcggtgcttgttcctgctagtttcttctaggaaaaagtacgggtggtgatttttcagcctcttcagggctactggcttctcccttgtaatctataaccatgtttgggtctttcctattttaagatataaaatcttgacagttgcctggattccctactctcttatcatcccatcttccttctccactcccagcaaaacttctcaaaatattggctaaacactctactgtctggctgttttctttctttttcttcatgactctgtttcctctgcctgtcccttaaatatcagtgactattgtcttattgtccttattcataaaattttatatatcgtaatggtgtccaaatcttcatctttagctcatttttctcattcaactccagattgtttccctggatgttccacaggcacttcaaattgaacacgtataaagtggaa

SEQ ID NO: 152777 - DNA, 174 bp, Homo sapiens
aggatttctggtctcggtgctgtaggtcacatagccactctttcctggactgagtcttcctaagaaaggggacgggaagtaaggctggcctactggtgtggacagattccagcaacatacatgacctgggggcacaaggactgcttcctaaacaatgatgagcacacagccacc

SEQ ID NO: 152778 - DNA, 280 bp, Homo sapiens
gcctttagatctcacagtctacaggtaaaatggatctataaagagggctgaaaagtacaaatcatggcaagaaggtggcagagcagggactaggggacagctaaaggagggtcatgatccctttgcctgagggatcaatattgcccagtagtaaccctagagcaggttctttaaggatgagtttcccaggcagtcaggaaatggggagggaaatccctatggttttgtgtattggccccagtgagaagcaagtgtgtccccttcgggaacttgatgagta

SEQ ID NO: 152779 - DNA, 334 bp, Homo sapiens
cttctgagtcttgaaagtttattagatcactctgtatgcctttgtgtactcatagcttagctcctccttacaagtgagaacatacaatatttggttttccactcctgagttacttcagattatgagaaattttaaaggaaaaatcttctataacacaatcattcattctttctcagccttcctcattacttattcttttccaatatcttgtccccattgacctaactccctccattcatactctgtagtgtttcacacacttaagctattactcatcaattctgtaattgcatttataagcaagatctcttaaagagagtgtgagaaaatgtgg

SEQ ID NO: 152780 - DNA, 412 bp, Homo sapiens
cagaattctatagcagaaagttagagatcatgtggttcaatttccttcctttgaagaaaacgaggtcaggagaagctgaccaccttactatggtcacactgctcttctatttagaataaaaacaaaaccagaccagcactttcctaaccttccaactctctctcaccataatgatctgccctttctctttccatatggaacaatggaataaaacatatgaatcataggaacccaacaatgaatgaaacacattatatctgttgacataataaacttgcgtatcagctaaacctagcatttcccatttctcaatcctaattattcttttaccgtgctatttcctgtccacctattcgctttggaaaaaaggatgcctaacaacaaggagggtcactgtggtaatgactgtctt

SEQ ID NO: 152781 - DNA, 169 bp, Homo sapiens
ctgctggaagccgagaggccctgggtgccggccaggagcacagtttcaagagtttggagaaaggacgcccagcctcggttctgccccctcaacttcgtcctatcactctggcaaatcacatgttcatatgcctgggactcagtttcttcctctgtagaacaaaggtaag

SEQ ID NO: 152782 - DNA, 1039 bp, Homo sapiens
gacagctgcttcaggacaagaaagttcttttggtctctcagttggggccactgtcagcatcatgattggagtactggctggagttactgtctttattataccaaactcttatcagagttttaacaacagtcattttacatgttggtgattcacagatagttgttttgattcttcctgaaagcatctgcaatcagctacagtccaaaattgcttctatttcaaaagatttatggaaaagatactgacaagtactcttgcatacaagtttctgagcagttcaagattataccactggactctctatggacttccaaaactttaacaaacaggctgatgccttcatgaaatatgccaacctaggccaagcttaacaaaaataatttcattgaaataaatgataatgtggataatgtttttataatttttatttgaaaatttgctgattctttaaatgattttttccagatttatggaatttttcttcttttaagctagctatatctaaagcaatttggtaaagtatacttttggaaacaataattgaagcccatttatttttgctctttacctaactgtcccaggattgggaaactattcatgagtattcatatgtttatgctaatacagttatttgcacaagtttagtaagaatcttctctctttacaaaaggacacatttcaaaacattggttatattaccaaggctttgactgagatgttatatttgagaatatacatagaatggacccataagtactgcaggcaaagtctgaagatggccttcatttggcttcctcatctcaagaggtttgtaaaagtttaatctgagactccttataaaaacgtctagcgatgcaaactttaggaagagtctctgtggtccaatgctactcttgatgcacttatgtaaagaatcccggcaaagtttgataagactaaacctactttggaaacaaatttatcctactgggattatctttggtaaaaatagatattcttatagagagaaaaataacgttgaaaataaaaagtgtagtat

SEQ ID NO: 152783 - DNA, 783 bp, Homo sapiens
atacgtgactcaagttaccaagttgccatgactgcctactggagatgaaggaaacaaaatcatcattactgaaaaattcttgaagaaaaaaatgttcatcaatttggagatacctgtcttccagaatacttgagattattctttaaaaacaatttttaccacatataaacagaagccaaggctaactcaagataaaaatttaggtcttaaggatctttcatgcctgtaatcccagcactttgggaggccaagatgggcatattacttgagctcaggagttcaagaccagcctgagcagcatggcaaaatcctgtctctacaacaaatataaatattagccaggcatggtggcgagtgcctgtaatcccagctactcaggaggctgaggcaggagaatcacttgaatctgggaggctgcggttgcagcgagccgagattgcacctctgcactacagcctgggtgacagagtgagactgcatctcaaaaaagaaaaaagatatactttgggtgtggatagatgtaatatttctgagagaaaagatcttttttgctcactttaaaaattgttcctccaccgcatctcaccactccacagcctaaaatcacctgatattgatccctgttctatccagagtattagtgatgtgtagtatctattcaaaaagtgctccaatactgtctttgaggtttcctcccaggctaccggcacccattctgtagcttttgctgctctcaaatcttgagtttaccagaaattgtcaataaaagtttattatacaaga

SEQ ID NO: 152784 - DNA, 113 bp, Homo sapiens
tgtagcttggtcctcccaggagtctcggatgtaaggttagcagtcctgctgttaattctgtcacaaattttggacatattttcctttctcatatctggagaaagaatacatag

SEQ ID NO: 152785 - DNA, 232 bp, Homo sapiens
caggctgctgcttctgctgccccatgggctgagccaagtgtgcccacggctgcatctgcaaagggacgtcggagaagtgcagctgctgtgcctgatgtgggaacagctcttctcccagatgttaatagaacaacctgcacaacctggattttttttttatacaatactgagccatttgctgcatttctttttatattaaatatgtgagtgacaataaaacaattttgacttg

SEQ ID NO: 152786 - DNA, 160 bp, Homo sapiens
atctattttgggtgatgagggaatgggttatattttagatagctgcagtagttgtacaggtcttctggtaaatgaaatacagctaaagaacaattttttcctgctaaccaacaattctttccagtctccctcactctgaacttggaataatctcttttct

SEQ ID NO: 152787 - DNA, 393 bp, Homo sapiens
gtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactca

SEQ ID NO: 152788 - DNA, 500 bp, Homo sapiens
atattgtgtccggaattggtgggctcctggtctcactgacttcaagaatgaagccgcggaccctcacaacttaccacggtggagccctgcaggggctacagtacaaatggctgaaacatcaagagaagcttcctgtcttcctagccagaggaaccaggataacttgccccactaagctgcagagtgtaaggagactcctagaccaaaaacagtcagagaaggggatcctgtaactctgtgatgagcctgcacaattttcaggctctcccctgaactactcttatctggaacaaacctaaatcagcacagcaaaagtactgagagctgaactgagatttgaagcactgcctacatttcaaactgtcctgtgagccatgggagcacagaaagtttccaacaaatgtggcaaataccttaaaaagtggtatgataattgaactgatgcccacaaaaagtgagacaaaacttacagtctgaaactaactggggtaactgcctga

SEQ ID NO: 152789 - DNA, 420 bp, Homo sapiens
cagtgaaggtctcaagctaggacttcaccctcctacgtgagactgcctacttggcctctccctacaggctcaacaaagcttctaaaacctatacccaaagtcaacccttgagttctcctcaagcctgcttttccatctcgctaaatggccaggaaatcattctgcaaagtgctcagcttgacagcctcaaaactatccctggctcccactctcatgtcccactttcaaatcatcagcaaatctcactggccctgccttcaaagcatattcaaaatctgaccatctctcatcacttccactagtctgggttgccatccctctcacctggattactacaaagcctcctacttggtctcgttcctcccctcttgccaagccacccatcccattctttttgccacacagcagccagaggaagcc

SEQ ID NO: 152790 - DNA, 505 bp, Homo sapiens
ctaaaacgattcttgagtagagatatctgatgagatatatgactctgcagctcagaaggactgacctaaacatagagatctagaagcaatgaaagtagatgaaaaaagcattcagattacgaggatcaaataaagatccctggtaatataaacagggtaggtaaagtccaaaatggaggcttgaaaagctacagaagctaagggaagaaaatgttatcagaaagcagcaaatactacagtcgagaaataataaagtaaaaagaaaactagttcaagatagtacactgagcatgtgtttatatctgaggttacaaagtgaaggcttgaactttaaatccagtctataaaagtgctcttttggggacaaaacagtttttgttgttgtctggctgctttctgtttcccaaccttaaaacagaacatttagttttgaatatttctctgtgtgtgtgtgtgtgtgtgtgtgtgtgtgtgtgtgtgtgtgtgtgttatatttttagaaatg

SEQ ID NO: 152791 - DNA, 480 bp, Homo sapiens
ctgggttgtcagccgggcagttgagtgggagtcaggggtgctgacctcacaggcacggccagtgaggagcattccggggccctgaggatgccagcatgggtggtcctgggctcgccctctccacagcatggctggcgttcctcgactgccgccggagccccgggaagacaggcttgaccccgtgcacacacgcagggagacgccaggagccctgccctcagaagcctgcacgctttgcctctcttctggcagctagctaaccctgcatccccacctgagcctgtccctggcactgaggacactggacctgtgtcactggggtggggtgtcctgggtcctgctgggtgctgagtgtctccatgccaggagctcccgcctctaccatcgagatgaccacagatgtccccagacgtggcctggtgctccgtggaaaactgctgtccacaaaccatggcgtccttcccctgacccccgcccctt

SEQ ID NO: 152792 - DNA, 286 bp, Homo sapiens
gtgaatcatcactttccctctgctattcactgtgctctactcgccacaggttgaaactcagaggtgggcattaaatgccacaaagagctccagcggactctctgattctagctcaaagagctgaaaaggggcctcctaatgctcaatgccctaccttttccaagtcctcaaatagctgccgaatgcattccattcaggctttatagctgcattcagtgggacagacaagatggagtgtggttactccatctcactgggaactggaaacccaccacacatctttgag

SEQ ID NO: 152793 - DNA, 1473 bp, Homo sapiens
  misc_feature (1028)..(1029): n is a, c, g, or t
gggatctgtcctgagattaaataaaaggatagattagaggcatggtaggtccaatggagactttagatcctacaatcttaatggcacgagatgcagtatttgtgtcatttgaaactgcactgctaaaccattttggatgaaaggtgacacagttggggatttgctgattaaaatgcaaaagagaccagaatactgaagaaaagacaagtatgacctattgcaactcagcttaaataagaaagactaggaataatctgcctggaaggaaatggagcagggacaagaaataaatactgtgtaacaaaatgtctatcatatggccgggcacagtggctcacgcctgtaatcctagcactttgggacgccgaagcgggcggatcacaaggtcaggagattgagaccacggtgaaaccccgtctctactaaaaatacaaaaaattagctgggcgcggtggtgggcacctgtagtcccagctactcgggaggctgaggcagaagaatggcgtgaacccaggaggctgagcttgcagtgagccaagatcatgccactgcactccagcctaggcaacagagcaagactccatctcaaaaaagaaaaaaaaagcaaaaaatgtctatcatatagcattaaatatttagatgaactagaaaggaacactggaaaagagtaaagataccaattgtgtaaaaatgttggaattaattttttttctttaaaacataatttcttgtccgggtgcgatggctcatgcctgcaatcccaacactttgggaggccgaggtgggtggattacctgaggtcaggagttcgagaccagcctggacaacatggtgaaaccccatctctactaaaaatataaaaaattagccgagcatggtggcagatgcctgtaattccagctacttgggaaatcaaggcagcagaatcgcttgaacccaggaggccgaggctgcagtgagccgagattgcgcaatacattccaggctgggtgacagagcaaggctccgtctaaaaaaaaaaaaccacnncccaaaacaacaacggccgaatatgggtcaattgggcaattggcctatagggggcggtttacaataagggcggtcgttaacaacgggggatggggaaaacctggggtacccaattaaacgcttgggggaaaaccccttttcccagtggggaatatcaaagagccccacctgtgcctttcaaaattggccacctaaagggaatggaattgaggggaatattgttgaaaaacgggaaattttgtaaaagcgcatttttaacaagggcgaaaggcaatcctcttaacaaaaaataccccgtaagttaggtgttccattggcaagaggccctttaaaacgggctccaccaaggggaaaacccttttgggggggccttctgacacaccttattttgggggggcgcgaactctaagccctgggcccttatttctgggacacccctcgggg

SEQ ID NO: 152794 - DNA, 457 bp, Homo sapiens
aaacacactgcaatggtgacatttgaaataggaggaagtaagaagggcccagactgttggtatactaatgtagtgagctcagaatggctattgaaagacagtcttaccttcaggctataatgaacttgactgactctaaagatcctcaggcaacttgttttctttcatgggctccctaaggttgagctgacatgagctagaaacaatctcccaaagagcggagttactgaagtccactttctcccaacctacaaacctaagagcctttctgaattttcacatcatgtggattggaattgaacatcgtagggctcctggaatattagtgccacttgaaatcaactttttaattacagtgattgaaatgaggccgggcacggtggctcacacctgtaatcccagcactttgggaggctgaggtgggcagattacgtgaggtcaggagatcgagaccagc

SEQ ID NO: 152795 - DNA, 169 bp, Homo sapiens
gtcacatctctttcatatattttaatgtaaggtagttggcaatgacttttttgaagactgtagaccattattttgtagtatttctctcaaagtgaattggtctgttctcatgaggagagtcacatcaatattttggccaggaatactacatcagtgatgttgtgttctt

SEQ ID NO: 152796 - DNA, 167 bp, Homo sapiens
cggggcggggacgcccagccgcaaggccttgtcaatcactgcagaggcggaacctgtgaggacccggcaggggcacggacatgactacggggagagacccagccccgttgtctctctccaattccctgccccactgcagaccctgcagggcccacaaagggacctgc

SEQ ID NO: 152797 - DNA, 362 bp, Homo sapiens
gggaatcatctgataagggctacaggcccctccagtgcctcatggggttagaggctgctggagtcttctccagcttgggggcccctggttaggaggaatctacattgggttgcaggggagtccaggtgcaggatgtggactgaaagccaggacccaagagtcccattctgtgctggcccctgccacctttggcacctgtctccctcccagttcaagctgtggtggggcctgcagtagaggttggtagggggagctgtagtttctatattaaagtgctttgcagtgtctcaatggaagggaacaagtgggtgtcaagccgcatgggcagtagtagggttggggtttgagcccccttcccaacc

SEQ ID NO: 152798 - DNA, 270 bp, Homo sapiens
cgtggtggagagacggcaggctggcaggagcacttggctgaaggtgggcgaggcccacgctgacagcaccaccttcacggatgcccatgtggagccaggcaggaagtataccttccgagtgcgggctgtgacctcagagggggctggcgaggcctggagtctgaggagatattggtggctcctgaggctctccccaagcccctttcgcgccagccatcctgtcggcctccagccagggcatcacactgacatggacagcacctcggggcc

SEQ ID NO: 152799 - DNA, 203 bp, Homo sapiens
caactagacgaagcttgcagaaagcaatgaatatgtctgtcagattcacactgtgcccccagcaactaatacagagtctagtatgcacgtactttcttttattgtgcttcatggatactgcattttttttacaaattgaaggtttgtggcaaccctatatcaaggaagtctgttggcgccatttttccaatagcatgtgccta

SEQ ID NO: 152800 - DNA, 347 bp, Homo sapiens
attccgggagaacttggaggaagtaagataacagagaaggaagggactatggcatctttgaggatcgaataaggtaggtgaagggtccgtcgggattgcagccctcaattgtggagaagcagagagactctctgggggaggggttcccagagctgggtactgcagaatgaataagagtttggggaatcgggccaggtgtgatggctcatgcctgtaatcccagcactttaggagcccaaggtgggtagatcccttgaggtcaggagtttgaggccagcctggccaacatgatgaaacccctgtctccactaaaaatacaaaaattagccaggtgtggtggtgtagta

SEQ ID NO: 152801 - DNA, 563 bp, Homo sapiens
tgttgtaaattatgcaacatgtcttagaaaaagtacatctagaagaaatcagttttaaaaagtatcttcacgcgtttctttaaaccgctcacttaaagctagttaaaacagtaagcgtgattttgtttagcctttcattttataagtttaagatgccatttccttccgccctctttcgaagaatcattaccttgaaaaatgagtttggcacttttaatcattccacaataacccttatattcaactttgaatggcattttctttatgcaaaactattctctaggaaatacatcctcaaaaagtttctttctaattctacttgttggaggaatgatttttgaccaatgcctttgtttctgatatggagacacatcagaatcactagtgggaaagcaggtaactggaggaactaggcacaccatcaggggattgcccatgccatggacacacacacaaatggaaaggactcaagtatgagaggctaccgcatggcactctagagtaaaaatccaaagcaacaggtcaagggaagggtcttggggttcctggaaaccattttccag

SEQ ID NO: 152802 - DNA, 255 bp, Homo sapiens
ggaaaaaaaggcagagaagagcaggaaaggggaaggaaggagggagcaagaagccatggtccccaccctgtgctcaccagtgccttcctgcttctctgcccaaagctgcttgggccctaaagcccctgtgctggtgacctcattggcttattctaaccccaggcttgttttctgctggggaggtctacagcccctggggcaccttctcagggattagtgagggcatgcagtgtgggggagctcagggcacaggtg

SEQ ID NO: 152803 - DNA, 494 bp, Homo sapiens
caaaattaaatttcctataagcatggaatatcatacttagactttttctgcatatcaatatcatatattttattagatccctcttcatgttaaatttaccaatatgtataagtaatttttaaagctttctttactccaaattgtctaaacatatggttaaccctattatttgcaagaattcttgcataattaaggctgttggtgtttaattaccaacatcaccacaatagtggccatttctgtgtgttcactgagtatccatgtccccctttctctctcctaacaacatccatttatgtgtaggtgtctaccctgtccccccacactatccaagtacttagaagatgtctcccagcccagcacggtggttcaggcctgtaatcccagcactttgggaggccgaggcgggtgggatcacctgaggtcaggagttcaagaccagcctggccaacatgatgaaaccccatctctactaaaaatacaaaaattagcag

SEQ ID NO: 152804 - DNA, 365 bp, Homo sapiens
cttgcttgacacaggattgccacagaccttcaatttgttaaaaaaaaatgtaggttgggcacagtggctcacgcctgtaatcccagcactttgggaggccgaggcgggcggatcatgaggtcaggagatagagaccatcctggctaacacggtgaaaccccgtctcaactaaaaatacaaaaaattagccgggcgttgtggcgggcgcctgtagtcccagctactcgggaggctgaggcaggagaatggcgtgaacccgggaggcagagcttgcagtgagcctagattgcgcccctgcactccaacctgggggacagagcgagactccgtctcaaaaaaaaaaaaagtaatatctgtgaagcaca

SEQ ID NO: 152805 - DNA, 753 bp, Homo sapiens
acaatcagcacaatcaggtactactgtcacctgctgtctatccccagacttagcatggacctgtgagatgccggcacagagcgccgagaggcctatgaggtgctctggggttactggctttgtgtcagggcagcaaccaagtcccattctaggtgagcccactgcctcgcagcccagacacagcagagatggagcatggacacagcagagatggagcatggagaggtcaaacagccgagtcccacctccattcctaccaccaatcccaggcctaactccagggcgtcctgacctttgtagtccttggtccttccatcacctgttttccgggcagtcagaccaagagcctacccatcctgaaggaaaaaatgatcagggagctcttcctggccccaagacatgccaggcctcctcctcacagcgtccctcgtctgcggccactgtctgcccttcatctatgttctcaagcactgaggagcccagcacgggccaggaagcttccacttcagcctgctttctgccagtctccttgcagttttcctcctgcaaacctctcaagggtttggagaccccctagttcccagagtgtgtatagccctcaagcagcctcagctccaatcttccctggagtggactggtatactctagctggtgtgcccacccttcccccacacactggtgctaactgtctgggtcccaagggactgccactggaaggccaggctggctaacggcaggatagagtttcccata

SEQ ID NO: 152806 - DNA, 250 bp, Homo sapiens
catatgctaagctcttgaataccactgatgtttactgtaacatcttcatagggcagtcagaagagagatgttaataatctatagatggctagttggagggacaacttacatgtttcctgctcagtgctgcactaagagctcatgggtgcccctggtaataatttatgctcttaatccccatggattacctaatttcctagataaactattcccgacagtcagcgctttgcagggcttctgagccattaaa

SEQ ID NO: 152807 - DNA, 362 bp, Homo sapiens
gtactaaacatagagaagtcccaacccccagaaacctgatgagccactttctggggtttcttcagaggtagaatggattgatgatgaatggatgaacagatgaaaagacacaagctgtacattcaaaaaatgtccaagtgaatgttattccaattaaaagtgcaagagctgaaaggaaaaaatatatcaccagacttaagtaggggagatggcaaacaaaaattcttctgtgaaggtagactttttagagtggaagaggctttgcagatggaagaagtgactccaggaaaggcacagcaataggaaaatggaggaatattcaacaggtgcatccagcttcaggggcaaggctgctgttggtc

SEQ ID NO: 152808 - DNA, 596 bp, Homo sapiens
tatggctattcttgcaggaataaggtggtatcgcattgtgggtttgatttgcatttctttgatcattagtgatggtaaccattttttatatgtttgttggccatttgtatatcttcttttgagaattttctattcatgtccttagcccactttttgatgcgattgtttttttccttactgatttgcttgagtttgttgtagattctggatattaatcttttgtcggaggtatagattgagtttgttgtagattctggatactaatccattgtcagatgtatagattgtgaagattttctcccactgtgtgagttgtctgtttactctgctgactgttccttttgccatgcaaaaactctttagtttaactaggtcccagctatttatctttgtttttattgcatttgcttttgggtttttggtcatgaaatttttgcctagccaatgcctagaagggtttttttccaattttatcttccagaatttttatagtttctgatcttaggtttaagtccttaatccatcttgagttggtttcttttataaggtgagagatgaggatccagtttcattctacatgtggctagccaattatc

SEQ ID NO: 152809 - DNA, 402 bp, Homo sapiens
atttcaggatcagaaaatggtctttaggagctcacaggcaaaaccaactctgaaaaacctttaatactcagcatgggtattcactaagttaagtctccaccctgagtaggaattgttttaaagctgctgtaagagtctaaatctttccttcacgttttatttcttgcaaatgtttgtgaacgtgttccttgctcttagattttgtgaaatgtaggctagagtagaacttatagcactgaaatccatttctgctttactcttagacaggtagccatgatggcatctctggagccaagtctctagaatgcaatagtctttgacataatagtgcttttgcaaagctggagaattagacaatgccaaaattagaaagtgtctgcaaggaacccacgcgaagttagt

SEQ ID NO: 152810 - DNA, 166 bp, Homo sapiens
caaaactaacagaactgtaagaggaaatagacaaatatgcaatatttctcttttagaattccatagaacaagtagacaaagtatcaagaaaaatccaggagacttaaacaagaatatcagctgtgtttggagctgccaagaagcaggtaccaagacaggatttaac

SEQ ID NO: 152811 - DNA, 595 bp, Homo sapiens
gcccacatcctccttcgtgagggtagggacactttccctgggggacagggaagaacattttttcctggcgcgtgtttcagggccagaggatctggttagtttaagcaactgcacccacggccccagaacttccagcagatttgtgctggagtccttggcccctggctaatccacatccagcaccctgttcctatgtcttagaagacgatctcttgaaaccttgttttttcctcaagcttcaattttccttggtattttccattgggaagcctctcctggatagtcagtcctgtaggtcttattttcagatccactctgggtgttgacttttcactgcccactcctttggcactagccagagatttttacatctgcaaatgctctccagagccaggacgagggtgatgatccttgtctttcagacgaggaaatttgagactcaggctacttggggacttgtctgagtctcacaaatagtaaagggcacagcggggatttcaagcccaagtttcttccccaaagcctgtgttcattccaccctgtctcactgttcctgcttttctgcttgggaggtcactataagcttaaccttttc

SEQ ID NO: 152812 - DNA, 811 bp, Homo sapiens
tgaaaaggtatgacagctgcattgtacaaatgacagaaagattgtcttgatcttctctaggaaacttttctggcacttggtcaatttatagagtgctctctatcttgtatttctgaatgttagaattggaaatgagcctgacaaataatgatcagtttgcatagttgatttcttttaaaatctgagaaaagttcagtcatttaaaatgaatattattaaagcgaacattcatgagcatagttgatagtaaacagaagaaaaaagggaaaaaagcagggagagaggagtcagccccagtgacatgctgacttgaatgttgtgtttgtcccctccgctagaatgtaagccccaggatggcaattatatctctctgtgctgaacacagtgcctggtatgtaacaggtgttcaatttatatgtgttgacgaatgaatgaatggactactaacgtttttgttgtttttttctacctcttttgttctcataggtaggtttttttttttgacctatgtgattgcagcatactgcctcgtttaattcttacgtaacacttacctcaattctcatttaattctgcctaacttcaaaagagtttttaggtgactgtatgtttttctcattcattctttcagtagaaatagcacttatttccttaaaaatggtctaaaagcatcatgcagtggcagatatatacaaattttatgtatttgaaatctgtgtgggcctacatcaaggaatgtaagtaacataccagagtttgttgtcagcatctgcagatactgaaatagtaaatggtataccagcttttttgg

SEQ ID NO: 152813 - DNA, 341 bp, Homo sapiens
acacaggaagggtcagaaatggagtcaggcacaccaacacttgatcactaactggacgtttggaaaggttctagatgcatcagtttctcctgctttataaaacaaagattgtttttcaaccaacttgtggattttgaagaatggccaccaagcatttctggacaggtggatgtgccaacatgaatcgctgtgctctgccatccagtgggtggcggccggggcctgagcagagctgcctgctcacagcagcacatgcaggtgggcatcccacttgtaagagcatctacaacgtgggtggtagagagaggaaatggaaacgaaggaagaatggatgagccttg

SEQ ID NO: 152814 - DNA, 563 bp, Homo sapiens
tctttctggtcatcctctacagaaaaaccaattctcctgtttcccttttttctttaaagactcgcctctgtccctttttttttaaatatacacctctcccaaaacgttttcatcgcaaaaaaaaagagttatgccattattaggaacagcgtgtcccaagacaagatctctatgatcctttgtatattcaagattgcaagaattgagctttaataactcatagaccataaacacaccctgttaaggttttccttcaaacagcaacattcccactcttgcgatccctaataggcgtacataagccacacaacacaatctttcaaaacgacacagatggtaggtgctctccaacctctctcgagagatcctcactgcacattctcctctaaagggcccacaaacactactgtcattcagagggatggtgactgttgagcgtgggtgggaaagaaagtgcacacgagatacctaactggatggggaaggttgttagaggcagccctccggtatcacgtaactagccaaacccgctacaaacttttgagagattaagttaacattcc

SEQ ID NO: 152815 - DNA, 507 bp, Homo sapiens
gtcaagtatttacttcaaaattaatttttaagtcgggattaaaaatgagtaagtaattgtagctaaagccttttatcaactcaaactttctaaaatattatatttgctttttaaaccacattttggtttggacagatagatatgcctggaaaaataaaatataacataagaatgtcaagtatataaatctcacacatatacatttagacaaacacacaatacacgtatgtatacatacgaagtttgtattttaggaagattcttgtggtagggtgaaaaaaaggtggggagtgtgttccttttgaatgttttagattttaaatcgttcctaagcgtatttcctgcttaaaagtcactgcttcaattggtaccacgcagacacttccctgtgcaaccagatctggtttgctgctgcaatgactattcacaggcatttcaaatcacctcccacgactgatgtgctcaccgctcacattccttcctcatgtatcataaaacatggtttgt

SEQ ID NO: 152816 - DNA, 406 bp, Homo sapiens
tacatcactcaaatttctctagtgaaaaacttcagaatccttgattgtactctgctaccctatatccactccaacaagctagttcccttggctctcctttcagaacatacttaaatcccactacttctcagcagctccactgctcccatcctaatacaggcgaccaacacatctcacctaggtgatgaccacagcctcctaactggtctttctgcagctattctcacattcttcttcccgatgcagtctacattctacacaacaggcagggtttttttaattatcaccatcctgctcaaaagctcaaagagcttctgacttggagtaaattgctacaccccaaccaggaccagcaaggtacgacctctctgaccttctcccccagaccctttgctcattccactcc

SEQ ID NO: 152817 - DNA, 348 bp, Homo sapiens
catacctatttctcttttctcagactattttccttgctaaattggaagagctttcaggcattgtttttccaaagagaaccatcttctacataaacagaatttgtttacaatataagaaaagtatttctaatgtttggagtgttcacagaattatactggcatttgagaatgacgaaagttggttaagagatttaataaaaatccgaatcaagtaaactctcaaagacttttaaaagatgaatcgaatccaatgacctaattagctctcctgtggagcccaggtagaggtgcctcatcctgaccagctggtgcctgagctgagctcatacacaacactgctcccgtgtg

SEQ ID NO: 152818 - DNA, 552 bp, Homo sapiens
aactctaatcacaacatccgaagacttgaaataacccaactgcctatcaggtgaatggatacacaaactgctatatccatatactggaatactactgagcaatagaaaagacaaactactgactggtgcagcaaatggatgaatctcaaacgcgttatactacaggaaagcagccaggctccaaatgaaacaagctctatgattccatttacataacacaattataggaacagacacattcagtggttgccaggggccggtagggagaggggctaaccacaaggggcaggagagtccctggatgattatataactgtaggcactaggcgaaactcacacacctgtacgctcaaagcactcaatttttaaagtgaaaaattctcatcttttggaagaattacttttttgtttttggttttgttttgtttcgttcttacttgacacggagtctcgctccatcgcccaggctggagagcagtggcacgatctcagctcactgcaacctccgcctcctgggttcaagcgattctcctgcctcagcttcccaaatag

SEQ ID NO: 152819 - DNA, 326 bp, Homo sapiens
tcacgcccatgtcacaaccctgtctggggacgagaccagcggcgcggggccactgccggagctgaggccaggcgtgagccaccgttcctggcgccctttgctgctttggatggtccctttacccaggtgactggtggtggccagcttgcctgtgggtggccctgcagtccagggcttgccctccctgtgacaaggccttctgctgggctgccccagagcagagggcaggcatgactgagggtcctgagcagctggggaagaccagtgggagatgagggtggatcacttgaggctaggagtttgagaccagcctggccaacatggtg

SEQ ID NO: 152820 - DNA, 195 bp, Homo sapiens
gttcctagctgtactcaaattcttccaggtacagggattttactgtcttcctccaaaagcccagctcatctttagggggccgtaacagtggattttagctcaacataggaaaaaacaccctggagccctcttttccactaactggccttacagtgcccgatggagtgggtcagaacaagccaatcgccccctcgc

SEQ ID NO: 152821 - DNA, 472 bp, Homo sapiens
  misc_feature (45)..(45): n is a, c, g, or t
  misc_feature (56)..(56): n is a, c, g, or t
  misc_feature (102)..(102): n is a, c, g, or t
tctagaatgaagtctgtaagaatgagtttcgtcgggtgcaaaggngcaggaatcangtttttggtcaagatatgttaagtgggtgaccactaagacccttcncgcctccttaatccaaacctaagcagctgccctgcgctgggaaagaggaggttgtggcatactgaaggggcttggccatgagaatctttgctgtgtcataggggcactgccttgcaccatggcttttgctcaaatcaagccaaacctggaacagttcactcccagctgatcacccctgtcattgtctcccaagccaatttaagatgctcagtggccacacacagagtttctggtagtttatttaagcagacacacagggaggaaaaataaaaactaaccttaagaaatccccataagcttccagcttctctgggtggtgcttctgactctaatcacatagctgctttgtgtggatctaccacagattatg

SEQ ID NO: 152822 - DNA, 159 bp, Homo sapiens
catggatggaaatgtgagggatggcaggagagatgctatgattgaatgaatctcaatattcttggtgatcaaagaataatgagactcatgcaataagactctgtgaatgattgaatgtagttcctaagctaggaggaagaatgaggaatgattttctgg

SEQ ID NO: 152823 - DNA, 516 bp, Homo sapiens
cccacgggctgtcgcatcaggaagcttgtgacctacaaggagaggtgacagggagaatcccaagaacaattaccaggctttgtctttctgccgccagtggctaagaaggagcagcactgtccagcccgccatctaagaaggggccatttctggaccctgctctgtatttccagaggctgttgacaatcgccttcattttctttttctttctttctttccttctttctttctttctctttctttttcttttcttttttttctttgacggctaaatagtactccattagtatagatgtaccacactttcttttttgacagagtctcactctgttgcccaggctggagtgcgatggcttgatctcaactcactgcaacctctgtctcccgggttcaagcgattctgctgccacagcctcaggagtagctggaattacaggcatgcgccaccccacgcccggctaattttgtatttttagtagagacggggtttctccatgttggtcaggctggtctcga

SEQ ID NO: 152824 - DNA, 438 bp, Homo sapiens
caatcctaaaattaatttgacctggacacactaattcattattgttggcacaaaggaaatccttgaatgtagacctgctctttcatgctccacggatgcatgagacattttctgggcctctgaatttacattggttgatttttttaaaaacatcatgctaccacaattcaggcatatgttagttttaattttctgataattataaagaccattaaggcattcctactttatttctgaaccaaatctagcaaaacctaaccagtcatctcacacaaattaacctcagaaaagacagcacatcaagttgccaatggggatgtctgcttatggccaccagcattactcaggtactctgtaatttagaaacctaaaccagaacacattttctcttaaagaaacaacattgtaagtatgaatagtccttatttacctccaatc

SEQ ID NO: 152825 - DNA, 239 bp, Homo sapiens
ggttttatcatgtcagagctcgtgtcacatccagtgcaggcgtcaatactaagggcatgagtttaacgggctttgctgtgttaaaaactcgtgggaagtgtaagcagtggagcgctgtagccacccgtcgccacgatgccccaaacagtagcagttcatggggaaaaaaagaaaaaaagaaccattatataaagaggaacttgagacatattgaaccaagtataaatgtatagactctc

SEQ ID NO: 152826 - DNA, 259 bp, Homo sapiens
cccgtgctatccctttggtgctgaacatgacactttggagagccttttttttttggagacagagtctcactctgtcgctcaggctggagtgcaggggcgtgatcctagctcacggcaacctcggcctccggggttcaagcgattctcctgccccagcctcccagagtgctgggattacaggtgtgagccactgcgcccaccccagttatgagaattaaataagcaaaatgcctggaatatagcgagaagtcaatgagtg

SEQ ID NO: 152827 - DNA, 208 bp, Homo sapiens
catggaagcaggagacatgaagggacagggaggggatggctgagagaataggcagcttcatggagttagagaaagcagagtcagagatggccatggtacccactcttacccattcccaccccaattctcccagtcaagtctgatgagatgttttttctgacctccgcaacccctggactggggttaagcccacaaggtgtttccagag

SEQ ID NO: 152828 - DNA, 453 bp, Homo sapiens
ggagcccggtggcctctgttgccggcatacactggaaacgcgcatctgcgtctgtctgcagagatgcagggtcttagacgcggtgctggggattccagtgaaacgctgggcaggatcccaagtccgccagcaatggaatggaagacccaccgtgatctaatcgcccaccagcagaggccacggaggcggaggcgagccagccacagccccgccaacgcgcacgaatcccacgtggcgtgagtcttttcacagaccgtgggaaacatgcacaactgcctggtatctaatttagggacacagcctcgtgacgtaaaccctgcagaagcacagaggcgtggcgcacgtgagaattcagggcagcgggctgcggcagagcgggggaggaggctggaagcgtccctggagctgcacggggccccctccctcatggcaatgtgctaacatagctgaata

SEQ ID NO: 152829 - DNA, 370 bp, Homo sapiens
gggaacagggagtccagtttaggaggcttattttacaattataattatagaaaagagatgacatagtggcttggattgggggcttgaggcagagatgatgagaagtagtgtattctggatatgttttaaaggttggaccaacaagatagagagaagaagagtcaagaatgacacttggctaggggcagtgactcacgcctgtaatcccagccctttgggaggcctaagcaggaggattgcttgaggccaggagtttgagatcagcatgggcaacaaaacaagactccatctctacaaaaattagctggatgtgatgggatgcaactgtagtcctagctacttggtagatggagggaggaggatcccttga

SEQ ID NO: 152830 - DNA, 570 bp, Homo sapiens
ccattctcctgcctcagcctcccgagtagctgggactgcaggtgcccgccaccacacctggctaattttttctatttttagtagagatggggtttcaccacgttagctaggatggtctcgatctcctgacctcatgacccacccgcctcggcctcccagagtgctgggattacaggcttgagccaccgcccttggcccatatgtcattacttacatctccttggctagagcttagtctcctggccacactcaaatgcaaacatggttgaatgcattttatttattttacttttttagagacaattccattttttgagctgcttaagccaaaattcctggtatccctgtggtagaaaagctagttgcctcccaaaacgcattcaggacggatgcagtggctcatgcttataatcccagggccttgggaagccaaggaaggaggattgtttgaagtcaggagttcaagaccagcctaggcaacacagggagaccctcgtctctaataaaaatttaaaaattagctgggcacagtggcacacacctcccagttactcaggagactaaggcaga

SEQ ID NO: 152831 - DNA, 423 bp, Homo sapiens
cgcctgtaatcccagctactcaggaggctgaggcataagaatccttgaacccaggaggcggaggttgcagtgagctgagattgcaccattgcactccagcctgggcaacaatagcgaaactccgtctcaaaacaaacaaacaaacaaaacaaaaaaacttaatgaatacagtccctcctaagattttcaaataaatgaaataccacattaatcatattgttttatttttatcattacattaaaaatcaaatagtatcactaggtttataatgaaaaacagcagaccctgtcccagccctccacactctcagtttctactccctagatataatctctattcacccagctacctcttctggtatttatctccgtatttctaaatagcatgcttatactactaattcttaatttttcagtttgggc

SEQ ID NO: 152832 - DNA, 175 bp, Homo sapiens
ctcttcccctgtgcaacatttccttacctgatcctatcagagcacaacccttgcttccgtggagcatgtgatccaggagaatgacatgtggggtcacttttatgtgtttaacttggctttttattcactccagataaacggtggtggttccctgtgtaagcagagagagagagaa

SEQ ID NO: 152833 - DNA, 399 bp, Homo sapiens
aaatcaggcaaataaatttagtgtgataaatgccacaacagagaagcctttccagagaagaagatttgtgagctaagttttaaaaatacacaaaaaagtgtgctaaaaaattggggcaagggtcctggtcacagaagaacattctgtgataagcctcttgacagccttaattccaaagaatgctagatactcttttttgctgtaactgaagctgggttctctcctgaagcacccccagaaaccctctcaactcaccctcctacatctctcacatctcagcaccctctggtgctggccccagatcattactcctgcattcccttgtctttgtggctcatgtcatttagcaatactatccttttccttccttttcactgccacctactgcctgcgtaaaat

SEQ ID NO: 152834 - DNA, 281 bp, Homo sapiens
aggcggaggttgcggtgagctgagatggcgccattgcactccagcctgggcaacaagagagaaactccgtctcaaacaaaaataaaaacaaaacaaaacaaacccacaaaaacaaaaacaaaaactgtaatccagcgggaactaatcatgttggtgataataataatgacagctctggtctcccatgtcccaagcgtccactctgtgcctcatgctgttcccttcaccagcagttagttctccatctaatctttcttctgagaaaggcagggcagtcacgg

SEQ ID NO: 152835 - DNA, 765 bp, Homo sapiens
atggagtttcacccttggtgcccaggctggagtgcaatggcatgagtcttggctcacagcaatctccacttcccgggttcaagcgattcttctgcctcagcctcccgagtagctgggattacagtagagacggggtttcaccctgttagccaggatggtgtcgatctcctgacctcatgatccgcctacctcggcctcccaaagggcggggattacagacgtgagccaccgcgcccggccctggagaattaatttgaaggggaggaaaattcagtttcagctcagctagggatttagtcttactaaagacgtgggaggaagttctccagctgaccagctttccccaacgtggaaaggaccacggcaaggtcacctgacctctccaacaaacattacacgccaagggattcacagtcccgccttggccatgagggagattgtgctcacgcagacggggcagtgcgggaaccggatcggcgccaagttctgggaggtgatctctgatgaacatgccatcgactccgctggcacctaccgcggggacagggacctgctgctgaagcgtatcaacgtatactacaatgaggccagcggactccccagtacaacatggcctggagatctttccatgttcctctgtacagatctgtcatcgatttccagcttcatggtaaccacaggatagatggacacaagttgtttaacccactgatagacttcattcctatactttccctaatgcaaaaataaaactcgagcatcctg

SEQ ID NO: 152836 - DNA, 200 bp, Homo sapiens
gcctcttgtgcatatcacatggatgctaaaatcactgggtgaatggtttttagagaacaatgtatttgcatttgcattgtgtcaaaacattattccctagtccccaccctctagattctttgctaatagcaaagggaaaaatacatatttatggccgggcatggtggctcacgcctgtaatcccaacactttgggaggcc

SEQ ID NO: 152837 - DNA, 209 bp, Homo sapiens
aggttagctggtgctgctgttataaattcaaccattatttttgacctcctggtatataacaagcattgaacaacacactggggacacggtagggaacaggggggaaacagcccttgacctcaaagagcttgcaggctagtggagctgtgagatgccaaagagatgatcttacaaataatggattatgctgttacgtgcactggaagtgc

SEQ ID NO: 152838 - DNA, 145 bp, Homo sapiens
gagtatttcttggaaattgagcctcaggaaggcaagtgagactagaatctaggctgcctatctctgagctggtcatctcattgaattaatggtggcagtcattggttacctgaacattttaggactcctgtccacacgtggtatt

SEQ ID NO: 152839 - DNA, 217 bp, Homo sapiens
agaccatttacaataacctatctactctacataaaatattcccagtagactcatcaaaacaagaccctctgataccacaccatactgggtttttccttattgggattcccccatgttttttctttaatgcttccccatgttttagaaacagatttgcttacccggaaccttccacactcaattccatatttatcatagtactatcatttgggagtaa

SEQ ID NO: 152840 - DNA, 165 bp, Homo sapiens
atttaaaggagcattacaatcccaatttaactaagatgagttggttaaactcaaactatgctcacataatagagtatattcagtcactataaatggggactatagtcagaattactggtaattcgcccgtgaaacctttaaaagatatacttacctgggaataac

SEQ ID NO: 152841 - DNA, 370 bp, Homo sapiens
acccaggctgaggggcacaacacagcaactggcctgcccccttacaagactgcaggtcatcagagtaaaaaaaaaaagctgaggagtgctccagactcaaggagatccaggagacaggacaactaaacacaatagtgcatcctgaaccggatcctttcactacaaaggacattatcaggataaatgggaacccatagctcattgctaaccccggctctgatggctgcattctagtcatgtagaagagggccccttgtttgcaagacatacaccctaacagtgatcaaagggtaatgggtatcaagctggtaacggttcagggaagaaagttcttcatactgtattcgcaacttctctaactttaagacgt

SEQ ID NO: 152842 - DNA, 234 bp, Homo sapiens
aatttcctgtagtcccaattttacctcaggcttaaattaagcacaaaatatgctaattattactatatattcttagttcagagagttgccagtaagctgccaacagattgaaccaggaagaatctacacatggcaatgaaacaaaatttaaatgcctcacaataaggcatgatgaacactccatgttagagaggaagccacaacctaaaagacgacttcacccagcctaattat

SEQ ID NO: 152843 - DNA, 148 bp, Homo sapiens
gtgctgctgggattacaggcctgagctaccatgagcccaggaatttcatgagaatctctctccttctagatgggttctggagtaagaccacctgggttcgactcctggctccattgctaaccagctgtgtgaccttaaggacgttact

SEQ ID NO: 152844 - DNA, 689 bp, Homo sapiens
ctaaaggcgtgcgccaccacgcccagctaatttttttgtatttttagtagagacagggtttcaccatgttgaccaggatggtcccgatctcttgacctcgtgatccgcccacctcagcctcccaaagtgctgcgattataggtgtgagccaacacgccaggctgctatacaactattttaaaagaaaacttttatatctttggaactttgaaaggcgttttcccctcaataccagaacttaaaattccttaggctgggcaccgtggcttgcacacttcgggaggctgaggtggaaggattgaggtcaggagttcaagaccagcctagccaacatagacctgtcctatctaatctatctatctatttacttatatatttatatattttgagagagggtctctctgtcacccagcctggagtgcggtggtgtgatcttggctcactgcagccaccacttcctgggttcaagtgatcctcccacctcagcctctagagtagatgagatcataggtgcatgccactatgcccagctaattttattttttgtagatatggggatctcactatgttgcccaggctggtcttaaacttctgggcacagtgatcctcctgccttggcctcccaaagtgttaggattataggtgtgagccaccacacctggcctagtctctttaaaattaaaaaaaaa

SEQ ID NO: 152845 - DNA, 492 bp, Homo sapiens
atacgctccactcttccctatctccaagcatttagtgataccattttcacactgaaattctatctataattcaaggttaagttaaatgttacccacctccttcccacctagcctccacagtgggtctgctcacaagctgttttctcacaaaaccagaaccatgaatgccttacacaaagcaagactaaacaaaacaataatgaagttttgctgagtattcttcaaagaccattctgaaatccacagctttcacaagtagactaaaatacaatacaactcatctttccaaagatcctgtctttattgcagttcataattttcacacattacaagagaagacagctgaatgaaactacaaatttcaaaacagattaagagaaatgagttccaagccatgcttttgatggaaagggaagaaggaaaacagtgatatgttaaaaatggagccaggagcagtggcatatgccggtaatcctagttattcagcaggct

SEQ ID NO: 152846 - DNA, 213 bp, Homo sapiens
aggtttgttcccatctgtcttagggagcctcagtagctgtgttgagcttgtggggtctgtttccatggcccaaagcataatgggcagctgggtatagagggtcacaggctcagggtctgggagagcctctatttctgggacagcccagtaagtgggggccagtcatctattgtattaatgctgtatagcatgaggccaacaggggcaatatct

SEQ ID NO: 152847 - DNA, 434 bp, Homo sapiens
ctcaggctgtcggagaaggcatcatccctggggagaagacagacatgaattggaggcaccttcccccaaagaacccagcatatacagagctccctgatatgtgtctgaggggctgaattaacacaacttatggttactttgtgcccacagcgcttgctaggccactgcccactgggtgccttcccaccacgcatgcccattgcaacactcctggtcagtttccgcagctgggaccctcttctgtcccacacctacctcctccttttttctcttctagcttgttcattcccaggcagctccaggctaggacaagctaaatgctgcagggtgtgttggagaaatggggggatggagtccgcaggctgagcaccgagggctgagtgctgagtctctgtgtgacttcatgagaaatggcttctggctaagcaagggag

SEQ ID NO: 152848 - DNA, 528 bp, Homo sapiens
aaaattcactcagcttatatatttagggtttatgtacctttttgtacaaatgttatgcttcaaaaaaagttaccttaaggaaaaaaagaggcttatcttttaaatactactgtaatgcttctaaaccacaagaaaacagacgctaagaatagggtactttacacttccttatgtttaaagcatgacagccaaggatacgttacatgtattttggagctcaaagctatcacaggcacagtacccatggattttgttctctaacaaaataatggcagttctgtaacacattatggtattaggctaaccaagcaggtcccaagtctgacttctttacaagtgaacaggtttaatttttcaaaaactgaatgtacggctcacgagcaagcgatctgagattttgaaatgattcttaccgaagtacccttttcattaagtctttccttctatagcttgagttcagaggggatttattcatctaatactaaacatttcacttctgttgaagcatgtggtttagttgcataacat

SEQ ID NO: 152849 - DNA, 247 bp, Homo sapiens
ggattacaggtgtgagccaccgtgcgcagtaataaatgttaaatacagcagaaataaatattaaagaacaaatgggaaattaatgattgttcagttaatgacagttctccctctccatgaatattagccagaggataaccaccaccacagccacaaagggtcaaacccaacagagctgtcttggaacgaagctgggtttgatttccttgcatctctcccgaattctcacatggtctcctacacaaga

SEQ ID NO: 152850 - DNA, 299 bp, Homo sapiens
acccaacgaatccagtactgaatgttctgccagtatatgtggcctctagtcagtaaaatagagcccaatcctaattcaacctattgaacagtaagatgttaatggggaacctagccttccactttgtctccttcactaggttgacacttttattaaataatcagaaacagaaacaaataaaagggaaacagggtaaagtaggctagcagagatataaaagatataaaattaacaagacctttgtcctacatggatatcttatcctttgcatttgtaaagaatccgaaaaacacatattc

SEQ ID NO: 152851 - DNA, 366 bp, Homo sapiens
agctgaaggcatcgctgatcctgctggacttcattaagaaagacaggtccaattttccaacgtgagcacagctaacagccaggaaactctggggctaggaaaacacctcctccagaccattaacaacttgtggtcaataaaaacctctcgttcctggcagccactctggctcaaatcgaattccacgacaggaaaaaatggctcaccaggaacacagaattcggaacctatctgtgacttaccgttcgaccagaagcctgccaggcgccagctgcagagtgagacctgcacggttccctggaagaacaagccagggtaggaaaacagcctcctccattcaagagccatttccttttgaaaaccaca

SEQ ID NO: 152852 - DNA, 1012 bp, Homo sapiens
gcataaagcccgtatcacctcacttagacaaaaggacagtgacatgtctgcaactgttttttcaaacttattagcaacacttagccaactatatgccacctatctgcctatgtatacttttcaatgcccaactattcttaatatatattccagttaaccacctataaataaacttgattggctattttcaccatttgtcctagttcttcacttttttttttaccaacttactgctgttgttgttccatccagttattctatccatgaattctcatcaccatctgttactttatctcccccaactgatatgttcatagaatgacagtttgtagatagaagatccttaaagtccatcatatacacaaagaaatggaggctcaaaaatgttatatgacttaggccattgcaggactgagatcagaactgaggtctcaatttgtctgagttttttaaaatggtgtaatctgctatatctccataaaaaaaaacaacaacaacaacaaaaaaaaaacaggcttaatccccattgatttaggccactggttccccaactttacctcagaatcaactttgtagttttttaaaaacactgatccctgggacccacagaaggttactgaaccatagcctttggaagtaggacaaaggaaactatattattaaaaggcactccaacttaaaaaatgttttaaagaataatttttttaaaaagatgcctcagggccaggtgcggtggctcacacctgtaatcccagtactttgggaggccgaggcgggtggatcacctgaggttggtagttcgagaccagcctgaccaacatggagaaaccccgtctctactaaaaatacaaaattagccaagcatggtggcgcatgcctgtaatcccagctgctcgggaggttgaggcaggagaatcactggaacctgggaggtggaggttgtggtgagccgagattgtgcttccgcactccagcctggacaacaagagcaaaactccatcttaaaaaaaaa

SEQ ID NO: 152853 - DNA, 162 bp, Homo sapiens
ttggagggactgactgtcttgggttaataccctgcttgtggcatgtttcccagagtgcctgcaaagacctccatgctgcagtccccagccacagttcagagtctgggatgcgctggcaatgtttgttctagaagaaatgtgagaaataaacattaaggtatc

SEQ ID NO: 152854 - DNA, 110 bp, Homo sapiens
actatctcatgtgtgaggaagcccagagagaactgaccaagcactaggagagcctggagtgtctgccatcctactctgtctactgcctcctcccacttgccacgacccta

SEQ ID NO: 152855 - DNA, 497 bp, Homo sapiens
ctgcagaaggatgatgcgcgggctccctcaggaccagagtgagaaccatgagtttgtggctctgtgaaggagaagcattggaagtgttgagctttgaaaagaaaaagagtaaaacagcaaagccttgggagtcagttgaactggtcagttgctgagaggctggcagcggagcgttgccgttggtggatgtgccacaggcagagtttgctccttggctggcaggtcagggactcatcactcagcccagccatagatactctgagtccaaagccggcccaaatcaccttgggccactctaaagagagaaataaatgccggttgtcactttctgataggctgataatgactttatgctacaaaaacataggtgaagcggattgaaaatataaccattatttggggattgattaatgccttttccttactcatgcaggggttatgagactgtcagtaaatctaagacatgttaaataatgtagaaaactatttgtagtata

SEQ ID NO: 152856 - DNA, 472 bp, Homo sapiens
accctccacgttcacaaacttatataggcacaaaaggagtcatatgcatggccacagagtgatgcacagatacagcatccttacatctgatcataacattgacttataagaacccaaagaattgacaaatacattagtaattagtaattatgtatctacctatcctccccaaccaattccaacaattcctgaattgtcaaaccttactaagagatttcaacccaaacccacaaccatacctcttgtcccctatactatcctagatttagaagctaattaactttttcctatactccaaggtgggagagggagcagagagcaaaaagagatttttagatagcttcaaatacgtgaaacctctaatagggaagcaattcattttgggaattcattttattttaatgagttctgggtaacctgagagaactaggagggaaaaaaatcaggaaagaaattttcacatggtactcta

SEQ ID NO: 152857 - DNA, 466 bp, Homo sapiens
ttctaaagcaatatggggcaggcgataaaaagcttcttgggcatcagaaacatcgtgaactgggatactgaagcaggaaagaattcactgaaaatgagtagtatatctcagccataataacgaaaaattggtatatcagaagccattaggctgaggacacaccgatactatataatttgtcatttatttggaaaacaaaatcgaccctcaggattttacgccctcagacaattaatctgcatgtatttaagatacaaaaatacatatataccatccacataccctcatctcaaaattagaacagcttgtgttaaaacataaagactatgacagttcttactcatttatcttttcacagttaactatttcatttagattttatggcaatctgtattcacatgctagcatagaagtcatattaaaaaaccttgattgagatgtaattcacatatcatactatttaccc

SEQ ID NO: 152858 - DNA, 393 bp, Homo sapiens
ggcagtgcaccgtgatgcgtgatggcgactctagaggacccgatgtgattgttgaaaacatatttattttcagccagataaaactcagagcccccaaatggtgacaagatcagaacccgtttgttttctcatcagctttggctcatccacctgtgaaacattcataacattgcagttaatttctacaaatacttggatgactggctgggacaaatgtacagtagcagttgtggtgctaaaaataaaaatatagctagaacaatcacatcatggacaatcacatcatgaacaatcacatcatgaacaatcacatcatgagcaatcacatcatgaacaatcacatcatgaacaatcacatcatgaacaatcacatcatgaacaatcacatcatga

SEQ ID NO: 152859 - DNA, 507 bp, Homo sapiens
taatgagcagcgcacacacacaaaggcgagctaaaaatgtctccacccttctaaatatgggatgccttggccaggtattgagtcagctctgtgacgccagtgcaattatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctgtggctctttttcacaaatgcttatggagctctaactgggggcaag

SEQ ID NO: 152860 - DNA, 298 bp, Homo sapiens
caggagatgggccttgcccttcttcagcaaaggtagggctagatgcctcttgttacagttccttctagagcattttgtaactgggaatgtgtggaattgggggtgggtgggtgagaaggatgaatcctgactactgagctagggataaagggcaaaggacactgagcaggctcttgtaataatccaggcaagcactgatgtgctttggaccatgatggtggcagtggaagtagcaagaagtgattggattctcaatatatttgggcagcagaacttacagggttcccaaacaggatga

SEQ ID NO: 152861 - DNA, 167 bp, Homo sapiens
gaacaagcgaaggagaagaaaaagataatttttttaaaaaagaatccttttatgagcttatgctagcttattttaatgttcttgcattataggcatgattaaagattttaagtgtatgactttgcattttgatcagagttatcatctccctcaaggctgctcaataa

SEQ ID NO: 152862 - DNA, 450 bp, Homo sapiens
tttcaaattagggataaaaggttttaagacgttatcacttatttctttgcttttcaatttcatttatttttatatttactcctttattatcaatgtgtcaatgcagtaagtagtaacataactaaaatatgaaatgaaaaatgattattaatacactgatattacaatatacatatacgtgaaaccatattaaacaaatattccaaatatttgtaaggcaagttgttgaaaacacattgcctgtagtctccatgagatacagaattgggcatctgtgactgctacggactgggtatttgtgtccccccaaaaattcacatgttgaagcctaaactcccaatgtgacggcatttggaggtggggcttttgaggtgtagctaggtcaccagtgtggagccctcatgaatgggattagtgcctgtctgagaagagcctatcagcactttgatc

SEQ ID NO: 152863 - DNA, 478 bp, Homo sapiens
gtggttctgctggatcctgctgtcccacctttcacaatctcattgtctcctttgattctcacacaaccttgggataaaggcagaacagagaatgtccttatttcacaggtgatatagggtgacctgtgcttcaacagaggactgtgtggcacttaggaatacagactgctgttcactcccaatgtgacataaggacctgtgaactaaggacattccctgatctgcagtcaaatggcccagaccactcacctgcaacagggttggtcaggattcaaggagatggcagagtatttctttttctcctgtgaggttaatgtctttggccttagtgctcagctctagccaaatgagttggcagcccagattttaggacttagatgagggttggggggaagaaagttccataaccatcttagtgcccatgaagaatcattgcgcaaagggtaaggattttcctttgttctctctacccagaaca

SEQ ID NO: 152864 - DNA, 280 bp, Homo sapiens
ttccatgccttcccctggagtcctagacccgctagacaacatcatttttccttaattttttttaaagctaacagtttagggaacattttatcctttctccagcaaattcactagcttctgatgtaaattgccatccaggttccccagggcagcccaggaatgggggccagtgtctcaccctctaggctcaggtgtgtggcaccctgctgcccggctcctgcccgcctccccagagacagcacgtccctgcagctcctgggggagggatgcttattctgta

SEQ ID NO: 152865 - DNA, 364 bp, Homo sapiens
gggtgtctagaggaccgtgtcatccctcgtcagatgcattggtgaggggaggtgacgagatggattgagttgagagtagatgtgggaaacggtatacaaaaagcgattaagggaaggtgggggcagatagcggatttggtttgggggatgttaggatggaaaggcctcatggagatttggcatccaacaaatgtgtgcccgtcacgatgtgcatagcatggtgtggtatttgtgttaggctttgaaatttatgtgatgattcggttaaggtcagttggttgtttaaagggaatagacgggaactagtgaatgttgatgcttagaaaaaagtgggaatgcgagaggagttggaggaaaaggaaaa

SEQ ID NO: 152866 - DNA, 452 bp, Homo sapiens
acatggcaacaatacattgtgctggccagaaaggatgtcagcaaacaaactagggcccttggcttccagttttccacttctcgtacatttgagctggagctgagatgtctccttccctttaagccctggggtccttttcatccaactccatgagtgcagctgggaattcccaggttggaacttgcagacatggggagtggggactgctgatattacatggcataatttcaggtggtcttggctatggggtctcatggctgccttgggccccattttccctttcagagtcatggccagctcacacactgcaccacacacagccctggtgaggaagccactggggtggagaagggaagcctctgcccagtgccacacaatgcgtcagtagaggaacttaactgagcatggaggccaggtggcctgctcctgggccagtgtccattccacgagcc

SEQ ID NO: 152867 - DNA, 583 bp, Homo sapiens
tgatttctaggaacccccaaaaggagaatagtaaaaaaagatcatacttaaaatttgtattacaatttttattttaggaacttattcagacacgtaaatgttgtttaattctgtaggtaaccatttgagctgcaattcaggatcttttttataacaccagtgtagccaaaagagaaacagataagtgaattggtaagaaataagattcagagcacttgggattgtaagttataggttctgagctgaactgtttatcagccgctctttttattaaaagacagtgtcaacacttcaaaaaacgtgcttaaaggagacaacggtgagattaattgcttagaaaaagctcaaggctgactgataagttttaaaaatttggtggtcttgtagtattttgaaatacagtagtcttttaacagaatttccccttagggaggtaagtggacagaaatctttgctaaaatgtttatatcatatttattttaaaatgagagagatatatttttaaattatttattatttaccttgtggtatggtacctgtgtttagtgtttacgttctgtagctttatttaataagttaaatt

SEQ ID NO: 152868 - DNA, 300 bp, Homo sapiens
caaccagggcttcttggtgttatttagatctgctttgtctaagaacacagcagcaacctggatgggccacgtctaccaaatgcactagggaattggaatttgtaattccatttgtcgacagggagaaaaatcatggactatcatacaatagacggggaaattgagtcccatagaggctgagtcccatagaggctcaagattacgtagtaaattagagtcggagttagggctagaaacaagatcagcattcaatgcacatcttcaacattttcttccctgtacctcattggaggctgtgga

SEQ ID NO: 152869 - DNA, 735 bp, Homo sapiens
tttgatgaagacacgtggtggggtgtgttgctgactgttcagccagaagcccagagtcttgaccgaagaaatttgtcagcctcctttgagctctttgaagggatttttgtcctctgggatgccctttaccagtggatccttgccagatcattcttcaacgtaatctcttcttcacaacatttggataccttaaggggaaggaaaaacggatgactcatttggtttaaaacagaatactccagatgccaagaatttatttactgcaataagttttcaggtcgtataatttcagtttgattctctctgctttccaccaatgcatacgtactttgtaggaaagaagaaagttgcacccttcccactccttctggatatatctccagacaaaggaaaaacagctggccatgctccagctaaagattccccgtagacactgcctccaacatcaaaggagacaagacccaggaatcagaacacaactggcaacggaagtcaagaatgtcatcagatttcatactgattaaatctttttcctcattccaaaaatgtgactcgtaaaggtggaagagaataattattaaattccagcctggccaacatggcaaaacctcttctttactaaaaatacaaaaagagttagccgggcgtggtgggactgaattacttgaaccagggaggcagaggttgcaagtgagtcaagatcgtaccgctgcactccagcctgcgtgagagagt

SEQ ID NO: 152870 - DNA, 997 bp, Homo sapiens
aggtcaaacattagctggtgtcatttcataaatgaagtgggcctctttcctaaagctttttccaagtatcatctgcaaatgttccagttgggtgctacaacatgcagaggccaccctgtctcatcgtcttgtcttcaccacccacccttctctttcaaaggcagtatgatcagacacagtagacggggggcctatcctaccaaatcccacctggccctggatgctgcagcttagggcatccaagagcccaccagggcaagcctgcactgtaccttctttctctgggttgtcagtggcaggccactctgctcaggcctgccaagtgagggtggtacactgggcaaatcaactttctggtagaagcacaggaacatctggccccaacactcttctctccctctgcctaccccacagtaatcctcagaacctagagacctaatgacaactctccaaacttcattctaaagtcaggaacaagaattggaaacctcatcacaagtcagaagattgagacatgcttaaggttactacctatgtgttcagattagcaaggacaggagcacactgtaggtaccaaccgcttatccatggaaggctgctcctgagctgcactgggctgcatgttatatttgtgtgcctgttgtctacaaacactcctatcccatcagaagtacacaagggtttgtcagatgacttactggccacgagtgaatcaatgaattcttctcaggaagagaaccagtttgccttttaaaaatgctgacagtgaaacccaagtgaggaaactcacctgctgcacccagcgtgcagcccacactccttcagtggtcctttaggagttggaaccaatctagtttcccagcctcttctcccatgacttcactctacgaatgcgtctgctccagccacgaaccttctctgggctcctcgaatgtacctaaccctttcaggctgtccttcccccatttcccacctaacaaaacccttttgaccttca

SEQ ID NO: 152871 - DNA, 325 bp, Homo sapiens
ccaggactcaggttggtgttatctggtgagactatgggatgtgtagagagatgaatttctatggattctctgcatgagcttgtgtctgtggttggggaccttggggcttagggactgaagaagagtacatgaatggcattcacagggacggtgatcctctgagttgtatgcaaatgttggagtgtttgcgcatggaaccgaactagtccatagctttcgctatattctcagaaacctctgtaactccttgaaaattcagaacactgatatatagggaaatacccagagaggattagaagggtagaaaaccctgtaaacccagcta

SEQ ID NO: 152872 - DNA, 505 bp, Homo sapiens
gtcaggtcccagctcaaacatcacctcctcgaaggcctcccttgttggccacctaaagtggcccagtgcctctggcctactgtctttccttttgacatgaaaatattggccctgaaagagcaggatctgcgctggccagcaggcatccaggatacctctggatgcttatcaggtgcataatacattcactgaatgagcagtgcataaaataattgaagaaggaggtttccatttctcttctcactgctgtagtcatgataagcaataaacaaacaatgacgaggccggtcgcagtgagtctcgactggtccaacacttcgggaggcggaggcagatgcatcacttgaggtcaggagtttgagaccagcctggccaacatggtgaaaccccgtctcttttttttttttttttttttcagaagggagtctcgctctgtcacccaggctggagtgcagtggcacaatctcggctcactgcaggctccgcctcccgggttcacgccatt

SEQ ID NO: 152873 - DNA, 247 bp, Homo sapiens
tacctgacatatagtcaagtctcaataaatagaagctttaattactcctctcatcagtgctatcatcatcatcatgaaaacatatccttaaaatatatacacagaatacattcaaactaaatccataatgaggtaaaaagccaaatctcaattattcataggctatctagttggagctccaagcccttcatttcctcttcaagggtaagtagcttttggccatcttactgttggctatcacctccac

SEQ ID NO: 152874 - DNA, 189 bp, Homo sapiens
atcattacctaggccatgggtcaagtttgaatgtggcctcatcactgcaagcttatttgcaatgtttggggtccctcaaacattcacataaactggagtcattcatgtttattaactgtctctatggattcttcacctatcgccttcctctgcaaggtgtatggggtcattagtgaaatctacattctt

SEQ ID NO: 152875 - DNA, 300 bp, Homo sapiens
cctaaatccccttgaaaatcactgaatttttctgttctaggtgtggctgccaacttctctaggagtttgctcttgacaacatggaggtagtgtcattggtggagataagaaaaatcatgaaagatagttgcttcagaaaagaactggagatgactagctactagaaattgtccagtagacaattgaaaatctatttgtttgttcatccaacaatatttttgagcccctacttggcacctactatgtgtcaggcacctgaacaaaaaagacaaagacccctgctttcatgaagcttactga

SEQ ID NO: 152876 - DNA, 353 bp, Homo sapiens
acctcatgatgtgcttgccttggcctcccaaagtgctgggattacaggcgtgagccactgcacccagccggggatttgaattcttatctcaccatttacatactaagtgacctttggcaagtgatctaacctgagcgtcaattccctcatctgaaagatggaggacataacccctatctcattaggattattataaagatctgatgaggcaaagccatctgtgcaacagaaatagaaattcaggcatctaatataaattaaccgcatatgtcatcctaaaattttttagtagatacatttttaaaagtagaaacaggctgattcattcttcaataatgtatttgatctaaacc

SEQ ID NO: 152877 - DNA, 714 bp, Homo sapiens
caggttatcccatgtgagcgcctagtacgtgtggaaatttaatagacaggcagaacagaacgtttgtagaccacctgaacaaataaattagcacccgtattagagtcgcagattgcttatatgggcggtgatttattatttgttagtagtgttttgaagaagaaatacggggatacatatgcagtcggttttaagttatatgagtggcaaggttgatatatattggctatattcccgactggtcttttcaccagccaaaagtcctctatgatgtcactctacgtacgggattcttcacttaactctagccttcgccctttccctaccttctatcccctctttccgtgagtcagcccccacttatttcccttaaaggtaagtttaaacatttaaaaaactatcttagaggatacgcttggttatttctaatcttaacctgactatcccatgtaggaaggctattcttaccaccagttataaatatttcaaaatattgatggagatacatactaatttttagcagaatctttaaactgcccttgaaggtataagatcggtcctatacctaaacttacctttgtgttaggaaattcttgatttgattttagactgaatttgagtgtcagaaagcaatgacgagatattgtaggttaaagctgataaaccaggtagtacataaaaaagaaaataatcttgaactgcgaaggtgagcta

SEQ ID NO: 152878 - DNA, 448 bp, Homo sapiens
gtgatggcctcccaggtgctctatctgaccccaggtgtgctgggggagcctgcacatatcccttctatctcaccgctggccttcatgctctttgtcaccaaccctggcacctctctacctgagggtcttctctggtgggcagaatccactctgtctaagcatgggtgggtaggaagtgcctgagaattaaaaaccctctctttcactggatgatgatgtgagttggtgcataaataccccagctccctcacccgtcagggccgtaatgctgagcacatgctctccattggcttccagagttccctttggcattaaggtccaggtattcaccatggtcatggtagcctgcttgataatgctccatgttttggttaaattacctccctgtctgttttttctacttcccttttcctgtttccttcacctcccaaataaactacttgcatta

SEQ ID NO: 152879 - DNA, 599 bp, Homo sapiens
agccttaatcctgcaaccaaagagagacaacaaacagaatgaagttactcctagaaattagtgggaactagcttattgataacctcataaagcataaagctccttttcttctccaagttccttcaaatctactatcagtaattcaatggtggtccttaagaagttaaatgcaatgccaaccctccacctaggattgtacaatctcattatgtatctgcccctttcacagacaagagttaacacagcaggcctgaggctactatctacagaaggacctgtctgcaagattagatcctggctggtatctgggaacttggctttcaaagttaactgacaagaccaacaagggctattcactcttcctagaccgtctatacaaacatggtgatttatgctgaacacctgccccactctagaagtctagaattttttttttcttttcctttttttgttgagacagggtctcactctgtcacccaacaggctggagtggagaggcacaatctcagctcactgcagcttcaacctccccaggggcttaggtcatcttcctacctcagcctcccaagtagctggaactacaggaatgcaccaccatg

SEQ ID NO: 152880 - DNA, 102 bp, Homo sapiens
cctcccaaagtactgggattacaggcgtgagctaccgtgcctggcctgttcatcctttttagtgtagtttttagcacatgaagaggacacaggaggtgttta

SEQ ID NO: 152881 - DNA, 376 bp, Homo sapiens
  misc_feature (203)..(203): n is a, c, g, or t
  misc_feature (220)..(220): n is a, c, g, or t
aaggatgaggaattgggaggggctagacatcataacaataactgaggtgggggtaggtggtctcagtgtgggtggtccacaatggggcatggactgcggtctgaagagggcctgtcctcactcaggtctgggctctagcagtgtggcacttccgacagagcacgtgaccgtccaggggaagcagccattgtcatctgcctcantcgacaggggcttccanggatgaggaattggtagggctggaagggaactacagtatgacctattgtagtccttcattttcagagaggcctggaggagataagtgtctttaccaaggtcatggggctgatcgatatggagaggcagagctacaaatagatctgtgcacctctga

SEQ ID NO: 152882 - DNA, 296 bp, Homo sapiens
acaatgttgtcctgtgttgagcatttttaaaaggtagaagctccatgtgtgggggtgagggaggtgggctataataagtgatgagttgcctcttgagaaagctctgcagattacttttaagagaaatatccaaaataaataggtccatgtaaacaataaaagtaaagtatgttatttctcaatggatacatttatatttgcttccaatcccagacatatgtaaaaggaacttttgacaatatatattaagaacagtctagactcacacttttccttttttttttttggagacaagg

SEQ ID NO: 152883 - DNA, 386 bp, Homo sapiens
ggtgaggctcctcaacaggataagtgtgtgtgtgcaggagggtgagcgtggccagtggaggtgggctaggctaggaagaaactgtcaccaggggcaggaactggggccccactcttgagctcagcccctaccctcccatctctagctccatgacctggaactcagcctttactgtctggtgctgggctacagttctgctctttattgccccctacctcccagcattgccatggcaaacactagctcctaatggtacaaataactaatactcaggggacaccaatgccaggctgagcgccctgggtgtcccattcgtttaagcctcacaacagtcctgaaaggctagtctccgtgtcccaatgttatttacaaggaaacttgggcta

SEQ ID NO: 152884 - DNA, 187 bp, Homo sapiens
tagtgcatcctttaattatttctgtgacacgatttttttaatgtaactatttaatacatatggtatatattttggtataccgatgaattcaggatcttagatatcatcccccagtattctaagtacttttaaaacactttattgaatattatttcttccatattaatatgttaatttcattagatac

SEQ ID NO: 152885 - DNA, 321 bp, Homo sapiens
acagcagttttggggaaaatgtgtgtgtggccccagctgcctgatttttctctgagagtcagaagtggtgtctgagtacatacaggttaggaatccccaaggtctgtcttcctttagctactaccagcccccatcttcctccaggactaatattttttaaaccttagtgcaaggacctatcccccccagactaaatactgattatcacaagagatcttgcctgctagctctgaatggacttgtggaccaggtcccttgataaactgtagtgggggttccagtaatacaggcctctttcttacaacagcaaagaatccccaa

SEQ ID NO: 152886 - DNA, 131 bp, Homo sapiens
agatccattcagccaactcttcctaagtgaggaaagaaagatcaagattaagcaaaacaaagggagaaatatatgaaggaaaagaaatacatacaaaggattgtttcccttaagtattaagcaattgcctt

SEQ ID NO: 152887 - DNA, 563 bp, Homo sapiens
cagaggttgtaatgagctgagatcatgccattgcatgccagcctgggtgacagagcaagaccctgcctcaaaaaacaaaaaacagtttgtcaattatggaacatttggaaagctgacagaagcctccacccagaacagtgtttttgtaggttacatctatttcagttctccaaggagtcccaaaggtattaataaggagctattttccatttcctcagagcagtatgtatatggggataggaggatggggaggtggagtaagttagggagaataaaaaaatatgccagggggttgttgtcaatgtagtgcccaagcaagcagaaaagcagcagtgtttgacagcttgctatgcacatctcagcaccagctatcttggagaggtatcagtaaggcctaatctgctattcaaaaatatctgatctggttctcttaacctctcaccaacttgttgaaggtccttatttagaattcagtgcccatttctcattcatgagagatttacttgtggaaagaatcaaatggcatccttgtctgtgaactcttccatccaagaccttgggga

SEQ ID NO: 152888 - DNA, 442 bp, Homo sapiens
tgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagataaaatagacaaattggcactttttcccctttattctcttcctcaagcttttttttctcctctatatctttctctatttttcctacggctttgcctctctaactgcaattctttgcctttttttgtgtcttctctccttttttaagtgtcccatttgcatttgctgttgacagaggccatggcaagctagagccaaaagtagagaagctggctttggccccc

SEQ ID NO: 152889 - DNA, 338 bp, Homo sapiens
caccctttcccgactcctgttttcatcttggagatgggcatggataaagccagcatggtgtccttggtggctcaaagggggcaggggtcatactgctgtgaaacagctgtggttggtaggtcgtggtacaagaaggccaaccctgaggcttgggattgttctgctgaaaacaaatgggctcgaacttggggaagagggggcagtggagaggcccccagacagacagcccagagaggctgctgggcagttgggcctcgtgcccctgctcccgtcacggtgctggggctctggcggtgtctacacccagcctcctggttgtgggcaggcagtgagtggag

SEQ ID NO: 152890 - DNA, 258 bp, Homo sapiens
agaagcatcaggtaccctttggaagctggtagtgctggtcagtttaatctcactctgtgatgtccgatcctcgggccctgggctcacaagccatcgcttcccatcgtggctccattctgtagctgcaaatcacaagactgtagacttgccattacccagaagcaggtcacctctgaaattcagaactcttcctgtcctcccactacacagcactccttgaagcagccctgcccacccctgccccaacctgggaaatct

SEQ ID NO: 152891 - DNA, 312 bp, Homo sapiens
acgcaatgagggcacaaaagcagcttctccctggctatcttcagaaggaatcttagattgcccttgaacaccatcaacaatctgctatttggagggctggaaactaagcctaagaaaccaccaggcttcggccgggcacgctggctcatgcctgtaatcccagcactttgggaggccagggcaggctgatcacctgagcccaggagttcaagaccagcctaggcaatctggtgaaacccagtctctataatatatacaaaaactagccaggcatggtggcgtgtgcctgtagtcccagctactggggaagga

SEQ ID NO: 152892 - DNA, 488 bp, Homo sapiens
ctgggcggacgtcatacaatcgggcaaggagatgtcacttggatgacggatggacgagccgcgatcgcgacatgatcggcagtcgaggcacccagacaatatattaaaatcagtgctatattactgactcgagcatcatcaaatatcgatgctcggaaagggcaaggcatgaaccacctgaagagaactgaatattcatcaacgagcatactatgtgttacgcagtgatgagtaaacgcttcggaaaggaactataatttgctctctagcagcaatgggtccagactgcttagatcagggtagaccatgaggaggaaagtgtatggagttcaaagacacatgaagtaaaagccacataactgggagtgagaaagggagagagagagcgcactggcaatgaccatcttctacttttatgcacatataaatcctgcccaaacatgagctcacatgctacatcctgcacaaaaccttcacttttgctcctt

SEQ ID NO: 152893 - DNA, 670 bp, Homo sapiens
agtatatcttttaaaatttggagcaagcattatacataatgatatcaccttaagagttatttactttaaaattgggaataagacagttacctgctttaccacttctagtcagcatttgatggagggtattaatcagcaaagatggaaaaaaaagtggtctaaagtttggggaaaaacaatcgtaaactatatgattgtttatatagaatatccaagcgactttacagacacattatttaaaatagatttgttatatgaagattaacaaaaatagatacaacaacattttaaaaattaattttgtttctataaaccagagatcagcaaacttcctctgtaaagggccagataaatattttagacttttgcctgacacatacaatctctgaaatacattctttttcttcttcctttgaagtaatataaaaatttcctttagctatggggcgagacagacagaggcctaaagctagatttggccagtggaccataatttgttgacatctgttatatacagaaatagataattgaaaactgtaaatactggccagggacagtgactcatggttataatcttagcactttggaaggccaaggtggatggatcccttgagcccaggagttcaagaccagcctgggcaacatggtgagacctggtctctacaaaaaa

SEQ ID NO: 152894 - DNA, 716 bp, Homo sapiens
taaaaatacgaaaattagctgggcgtggtggtgcacacctgtaatcccagctactcgggtggctgaggcacgagaatcgcttgaacccgggaggcagaggttgtagtgagctgacatcgcaccactgcattccagcctctgggtgacacagtgagacctagcctcaaaaaaagagtatagaaacaggtttgggatctagtagatatacatatttcaaaatatgtaaggatactaagccatgtaacactacagagaagttaggagtgtgtatgtgttggggggtatttcccaaaagatggagcgggagggttagcattactcttgtgagtttactgcaattcatggtgtggcctttagctttgtgagctataccagggtggagcaatctttcaagcctagatccacagtgatcaagctcatgcgactggtgcataaaaccaggaaagttagcttattcatttacagtgagccataactagcacaaagattgcagtactgtgttgacatgactagtatgttctctttcaggaggcagatagactcacgtaggaatcaagacataatcattaaattgtttagtaagtgtggtatgacagagaagagttggatgctgctcaaatgttgaatgaccatcgtctccacagtagggggtagatttgttagtgcactgattgtggttcacacttttttagactgtacattggatccttcagtgt

SEQ ID NO: 152895 - DNA, 136 bp, Homo sapiens
ctcagctgctttttaaaacgatttcctctacctcttggacttcactgaacctgctgttgaggatactgcctcctctgctgtcctgttaaaagaggactgctttgttgttgttttttttttttataacccctgcacc

SEQ ID NO: 152896 - DNA, 273 bp, Homo sapiens
acatattatattaataatattaatcaacttatcacaaccctgacaatacatagcattgtatcaacacgtatcaactgctgagagctgcacaaaataccctgggtggattctcatttaatcttgttaagaaccttttgaaccaggtgtcatgatgatgcccatgttactgaggtgaaataactgagtcacaggggttatatcatctgccccaaatcacaaagggaatcagtgtcagtatcagaaatttaacccaagcaactgaatggacctgaa

SEQ ID NO: 152897 - DNA, 511 bp, Homo sapiens
ccatcttggccaggctggtcttgaactcctgacctcaagtgatccacctgccttagcctcccaaaatgctaggattagaggcgtgagccaccgcgcccggcctaatttttgtatttttagtagaaatggggtttcaccatgttggccagtctgatctcgaactcctggcctcaagtgatccaccagccttggcctccccaaagtgttgggattacagacgtgagccacggcacccagccttttgtttgtttttgtttttatgtatttcattaaatgaattgtccttttagtggtatatcaggagatcttgccttctggtactcttgaaaaatatgaaaagaaacaactgaagtaggcatctcctataattagtatgtagcattttattctcagaaaatgtgtggtaacctggccctggattttacctttttgcaaagtgatatccgaataaaatgaacactagattcccacttggagtggaagaacattgcagttgaggccttgggtaagt

SEQ ID NO: 152898 - DNA, 297 bp, Homo sapiens
agatcctgtggttagcagcaagtcaccgagtccagcctacgcaagcgagcactaggaggctgtcaggctctgagccatctcagttgtctcggtcttcctgccacgctgactgcgacagccctggtcagcattcactgagtgcctgctgtgtgcctggcaccgttcaaacactcatagattaatctttaatcacttatggattaataatttaacctatacattgggctgggcatggtgggtcactcctgtaatcccagcactttgggaggccggggcgggcagatcacgtgaggttag

SEQ ID NO: 152899 - DNA, 343 bp, Homo sapiens
tgtgcctgtcccaagggaccgttggaaagatgagagaaggaaatccatataaaatgcttaacacagtatttggctttagtaattgctcagtaagtcatagctatatgttattaatatgatacacagtcattcttctgaaatgaatgggcatgaatgcttccctctctgcataaggaattatttgtgctggatccttcttaagaggcttctcttctcttctcttctcttctcttctcttctcttctcttctcttctcttctcttctcttctcttctcttctcttctcttctcttctttctcttctcttctcttcctttcctctctctgtagcccaggctggagt

SEQ ID NO: 152900 - DNA, 569 bp, Homo sapiens
ctagcaatctttggagttccctgccttgtagaagcatcacctgatctctgccttcatctttccatggcattctcccagtgtgcatgtctgtttctgagcctaaattttcccttttttataaggctaccagtcagattagggtccacattcatggcctcatcttaacttgactccatctgcaagagggtctgcaaagaccctattttcaaataagaccctattttcaaagaggtactgataggatttcatatctttttggggggacacaattcaacctgtagcaatgagcaataatgaagtgacgaggtaagttaccttttcaaaagggattcctcacaagacaagggtatgttgtgtagcaccagcagctggcttcaagacttactgcctgacattttttaagagtaaggattttttaattgccccaaagcctcaggatcatttaggtggactaagggatagtattgtagtctttagggctattctcaaatattgcatatctctctcctcctctgggcaatggtaaaaatgtacttcccaatctgaaatggcatggccacgtgacttgc

SEQ ID NO: 152901 - DNA, 239 bp, Homo sapiens
tgcccagcagagatgaagttagattctcatgagcttaaaccctgaattgtttctacaaaaatgggaaccattttattaaaacaagaaaatcatgtcatctttttcttgaattttggaggcagtagccaggactcatattgattagtctttttctgaagaatcgccactttgaggaggaggaggaagagagaggaagctaccacttactggccattacttgaagagcagatgagtgatta

SEQ ID NO: 152902 - DNA, 507 bp, Homo sapiens
ccacaaagcaggggctgggcctgcaggctccccgcggtccagctcccgaggcaggtctccaaagtgcccccgtcccccgcataactagaaaatgtctccggcaagtaacagagctagagctaaggccaacttaagcttggtggggtgaaggcaaggcgctgatgtttctaatacgttgaaaaggagaaagggaacatcacagagaggacagcacagaagttaaacatcttagattcagtgggggcgggattccgaggcccaagcccacgcctttatattacatttggaagctgaatttgtttaccttatgtaaataagagtaactgttgggattggaagctttttcctctctttgggactttgatgtccttccgaggtctccaaattagggtttgaaattattcaaaccagtaatttccctcccctcctcctttcattaactgaagtgagtgggggtttgggatttctggattttttcaagtgctacatggcaccctttctctcatc

SEQ ID NO: 152903 - DNA, 246 bp, Homo sapiens
acatctttatttcactttcttgaataatagatcatcagagtagaaactctaaatcgaggtatttcctattagcactttgaagatattcctctattgccttccaacataattatttcattatcttctagtgtctttcatcaccacgaagaaaatgtctggtgtcattccttagtttcggagtctgctgataaattcagcaaccagtaacatttattaaggttaccgtggtgagcactatacatgcca

SEQ ID NO: 152904 - DNA, 166 bp, Homo sapiens
gtagccttgttccaatccaagcaccactgatgctcatcccttcccatcattacagtttcttaaattataagctttacaagtcaaacacaagaaaaattgaaaaatccataaagtgaccatctaacaccaaaactatttatgtatttggtatttatattttttcatt

SEQ ID NO: 152905 - DNA, 400 bp, Homo sapiens
cctggacttcatctctcctcaccattttcattcctgggaatgagatgatatggtctttgactagagttagataggtagatagatagatcttacatttaaataatatctatctactaattcagtcagcttttattgaaggctttctattactaggcaccataatggaattaataaaggtagaacacctaccatattctatactgattgctttcataaattaactcctttgatccttacaactttatagttactactgttatattcattcaacggaggagcaaaccaaagcacagagagattaagaaaaattttcaagattagagagcctgtaaatggcacagagtttgaacccaggtagtcagctccagaacccatgagcttaactactatatgatatact

SEQ ID NO: 152906 - DNA, 569 bp, Homo sapiens
ctagagacagagtcttaccctatcatccagctggagtgcagtggcgtgatcaccgctcactgcagcctcaaattcctgagctcaagccatcctccctaaagtccttctttaaaataagcagcttctccgcttagctggagctgcaaggaaagaaacttaaaaacaaacaaaataagctgtttctttgttgagccttaaagactcatcacatagggtttacttggttgctttctacattctagagaaattactgaataaataatttcctaccgggggttgaaaattagaggtgcgaaaagaagataaatagtgtttgagtatgaaaacaaggagaaaaaagtgtagggtaaaatcgattccactgtatccttggattaaaaaaaatacaacacaaaaaccaaacttatatgtacttttctatttacttcttttcatcaatattcacagaataaatgtgtatcattcactttaagctgctgataaaaatggatgtatgctatgatcacatcctcattgtgtccatcaaacttctttccctaagtttttctaataaagaacattttgattcc

SEQ ID NO: 152907 - DNA, 602 bp, Homo sapiens
aatgctttggcgtgtgtgggatgacaaggtgggttattgatgaagctcatgtgcgtgtggtaagtcagacttgcagtctggtgtatgattcctagattggaggatgctcgcccctctgcagcccggtccttgagatcctcagcaatgcccagctgctgctcatggtattgtttagctctctccaaatcctgcatgcacctggcagcatggcctagtccagcataggcccgcatctcaatagccttctccatcaactcctgtgccagctccaggacatagttatggtaagacatggccttgtcaaagttcctccggtagtgataggcactgcccaggttgctataagcccgggcctcttctcgcttgttccccaggtccttggctatcttcagatgctgctcatggcactgcacagcattctcaaagtcacccatggcaatatacacagctcccatgttgccaagttctcgggcttcagaaagttcatctttggattgcttggcaagaagaacacactgtttgtgactggccagtgcattggggtagtctccaatggctgtgtacacgtggcccagactgctcaaggctgatgaagctgcctg

SEQ ID NO: 152908 - DNA, 320 bp, Homo sapiens
ggcacagtctgaggcagaattaacctggtggagtgaatgggatgtggggaagaggattagaggaattggtggtggttactggatttctaccccaggtgacagggtacatggatatccatgggccaggaaagggagacttgagggaacagtttggggagaaagcagcaggttccgttttagctgtgcacagtgcctttgggacagccaaatagagagatctgcagattcaagaggtctgagttggagcttgtgattggagcattatcaccgagtgatggtggaagtagagttgaagattgttcaggagagagtgcagaatg

SEQ ID NO: 152909 - DNA, 406 bp, Homo sapiens
gcatgtggtcagactggggtgcacaaatgagaggccaggatgttggaggagtcatccaaagaatttctatgtgccaaatcaaatgactcatgggcagggtgagcgtgggatataccaagtaagccatggtggccgggtgggcttatactccaccaggggagtataagtggagtgaaatgttccgaacaggccaagtggcctgggttatagcaagcgggccataaggcggcatgggtgggtgttgtaaagtctcccccagaggagttgcatatcgtcaggagctctgaccctggttcagatcatctgggtctgagtcctggtgcttccgtcttgagcacacctgtctcagatctgagtatcaatcacaagccctcctccccatgcgaccttggccaagtgacttcac

SEQ ID NO: 152910 - DNA, 389 bp, Homo sapiens
atagtgagatcccatctctacaaaaaattttaaaaattagctgagtgtggtggcacacacctgttgttccagctactcaggaggctgagatggaaggatcacctaaacacaagaaggttgaggctgcagtgagctatgatcacgccactgcactctagcctgggcgacacagtgagatgccatctcaacaaatatccccacaacggaacttttcagagatattctatcaaaactgcctcttaattctctatgatcagagctggccattctgaatgagtttcaagttttaccaaaggggttttgtatgtgtgtattaacaaataggccggacacagtggctcatgcctgtaatcccagcactttgggaggccgaggtgggaggactgctt

SEQ ID NO: 152911 - DNA, 300 bp, Homo sapiens
ccttttggtcaggaagggggcctctgaaagacgaggggaagtcggcattttctcaagagaacaacctcccctgtggaggtccaggcatctcaccagagaacacatctcatactcaggatgattagctcttggtttcgtctgaatggtggcataatatggatgtgttgcttagaaaagaatctgatttcagcacatgtttgatgggtgtagaaccaagggctgtggtcccctttgccgatcactttacattgtggggatatttggaaaaggcaactcatacttaggggcaagggcagtcac

SEQ ID NO: 152912 - DNA, 1000 bp, Homo sapiens
tattcccccaaccccttccacatctttccaaccaaaacaaaaaccggtctgttatcgccttttattaattttaccataaaccacaagatggaaaagacaactaatacagacacagttaagttccagaagacttctggacttcaaatgatggactaaaaccagcataaatttacataaaaagaaacgaaatacctacatattttcataactcaatgagcctaatgcatgatagaagggacttgtttttatggcaattaatatgaggaagagcagggagttttttgctgagaacaagatcagtgtgagtcagtgggatggccttgttacttaaagaaaacataggctgcattatttaaaacattctcaatttaagggaaaaatttttcacaactctccacactcagcaggcctcacctaaaaaacactgtccatctctataccagattttactagggacactgaagagttggacggggcatttggataaatgtaaccaaagtgaaaccatcatctccttcttcatgcaacatcctcttctccttggtttctgggacaccactgtcttcataaccctcatattcctgaatgactcctcttagtctcctttggctgctggttggcttacaaaatccatccttcacttcttcaatagaagtcaagatttagctgggcagtgatgatgagcattttttcatgtgtctgttggctgcataaatgtcttcttttgagaagtgtctgttcatgtccttcgcccacttgttgatggggttgttcgttttgtgcttgtaaatttgtttgagttctttgtagattctggatattagccttttgtcagatgagtagattgcaaaaattttctcctattctgtaggtttcctgttcactagttcagcatggctggcgaggtctcaggaaacttacaatcatggaggaaggggaagcgaacacgtccttcttcatatggcggcagcaagaagcagttctgtagcggtggtaatta

SEQ ID NO: 152913 - DNA, 301 bp, Homo sapiens
ctttggctgctggttggcttacaaaatccatccttcacttcttcaatagaagtcaagatttagctgggcagtgatgatgagcattttttcatgtgtctgttggctgcataaatgtcttcttttgagaagtgtctgttcatgtccttcgcccacttgttgatggggttgttcgttttgtgcttgtaaatttgtttgagttctttgtagattctggatattagccttttgtcagatgagtagattgcaaaaattttctcctattctgtaggtttcctgttcactctgatggtaaaatgaaaaa

SEQ ID NO: 152914 - DNA, 690 bp, Homo sapiens
aatcgcagatgccagttaagaggccgcaaacagacaagtccagagatccaaggaaaggccagaagattaagagtgtggaagtttttaggaaaagggaatggagggagtccattagagaaaaggataagataaaatacaggccaggcccaagtcctaaacaacacccagtattttgtcatggagtatagaaagggagcagccagtgaagcagaacgaaatcaggctctggaggccttgtgcaagccatgagcaaagaggcggtcagccctgcaggtgatgcgggcaggtaagaaaaggacagaagggaccggaccgctggatgcaacaacttggagctcactggtgagctcagtgatccacgtcagtggagacagagcctgacgggttaaaagtaaatggaaggtgaggatgagagacatcacatatgcagacaattctcttagtgactaattccatataatcagcaattactaagaaattctaggccttgtggctgcatggctgtgactccctgtggtttggtctgattacagctcctctgaaaggtttcctggccagctgtgaagccactcacagcctcattgagactgggctctcgcccgatgactcctgcagctcctcaattggactctaatcacagagtaccgctgctggcctttttattttagggagaatataacctccttactg

SEQ ID NO: 152915 - DNA, 305 bp, Homo sapiens
agcctggcctttgttttggcccagcagccgctgaggccttctcagcactgtacctccacgctccatgtctggttgggcacccctaacaaaacaccatggactggtggcttaaatgacagaaatctaatttctcacaggtctggaggctggaagtccaagaccaaggtgtcagcaggtttggtttcttgcgaagcctctttccttggctcgcaaatggttatcttcttgctgtgtccccacatgattgtccctgagtctgtgtgtctgtcctcttcagataaggacaccagtcctattggattagg

SEQ ID NO: 152916 - DNA, 435 bp, Homo sapiens
ttctgtcctcagttggttgaatccacagacatggaacttgctgatatagagggccaaatgtacatttactttttatttggacacaaatgccaagtcacctgtcacttctaaaccacttctctgttcatttaattattcttcccaagtacctgttagatatagacaaatttaacagcattgtggaatctactacaaataatgtccatatagtcaggtacagtggcttacatctgtaatccagctactcaagagatggaggtggaactacaggcgcatgccaccatgtctggcttgtgtttattttttttgagatggagtctcactctgtcgcccagcctggagtgcaatggtgtgatctcggctcactgcaacctccgccttccgggttcaagtgactctcctgcctcagcctccccagtagctgaggaccatcgt

SEQ ID NO: 152917 - DNA, 359 bp, Homo sapiens
ctctctcacactggctctctccacactctctctccacactggctttctccacactctctctcctcactcctctctccacactggctctctccacactggacctacttcagaatggcctggcttttccaaaggtgatataccactagaaaatgagggtcttgataaaatctagcaaggactatgtcctgtgtaagttatccctcatcttcttttataattgcatgtagccttatgatgttaatgataccttatatacataaccattctgtattctgtacatgacaaaaaggtaaaggtcaacaggccttccaagaagtaaactgagtgggagtgagaataaagagagagctgatgagaag

SEQ ID NO: 152918 - DNA, 447 bp, Homo sapiens
ccctgaccaggctgatgcacgggagtctttgaacccaggaggttaaggctgcggtgagctgtgtttacaccactgcactccagcctgggcaacagagctagactctgtctcaaaaaacaacagaaacaaaatgtattgagtgaatatgcatgtgtgaattacagaagtaatagattttaatgctaactataaaagtctcatcagtgtagctctccatttcctctctgcctactagcagatggaaaaaaaatgatatttaatctgcatttctgattatgagtaagtttgaacataattttaatgtgtttattgcccatttctcttttttttctttttttttttctttttttttccaagcagggtctcgcactgtcgcccgggctggagtgcaatggtgcaatctcagctcactgcaacctctgcctcctgggttcacatggttctcct

SEQ ID NO: 152919 - DNA, 587 bp, Homo sapiens
taagatttatttgtaaatagcaagtttcttctacataaatacttatcagattcttgaaaactattaacattaaggatgtagcttggtaaaccctttctccaggacagcatctggttaatttgtgtatgaatatgcagaagttcaaaatggcattctaccacaaaggagtctgactttaaagacttgtaaaatgtgtagccttgaatctttaccctggtattcaacttgggggatttgtagggaaatattaccattatctgttgagctagacaagcaaatattcactttctagcatactcaggctacaaaataatctaatttcttcctattaccatttatttatagaatacttatacagctcataaagcatttttcccacatatttttgctcatcagaacctcaccaaggtgttcttttgagccttgcttaggataccctatcctacttcaacatatcccaggtcctttctcctcttgttaagccaacaacaggactatcaaatatttttggaagtaaataatagcagaacattaatgaccaatattggctatgtgcccagtactgttttaagcacttaacatgtttt

SEQ ID NO: 152920 - DNA, 404 bp, Homo sapiens
gatcgcctgaacccagtcaaggctggagtgaaccctgatcacaccactgcattcccagcctgcgtggcagagtgagaccctgtctcaaaaataataataataagaatactaacaatgtattccttgagtgtagtattcattgggatttttatgtcatgtgaaaaatgactctatgactctcctgtgatacaaatatttgactttcacataataaagtcatttcttcttgaggttttttttttttaaatcaaggagaaagtgagttttgtactaataggtctttaacatctctctgtcacttgctcatacctctttttatcaagaagagataggactgacctcagtctgctgggagagtatcttagaatttgatctcgtggatttcattataccctggtaccctt

SEQ ID NO: 152921 - DNA, 535 bp, Homo sapiens
tcaccgtgttagccaagatggtctcgatctcttgacctcgtgatccgcctgcctcggcctcccaaagtgctgggattacaggtgtgagtcaccgcgcctggccatatttgggaagtatttttacagataatcgaagatcagcttaataaagaaatacagcaaaaaaatgtaataaggaggggttacacactgaagaaagaattttacttgagtagacaaaggcgccattaaacacttgagttgcctttggctcttggtggtcacaaaaggctttatcaaaacagcaaattttagttaattaagagagagagctcactgaatgggccaggtccaagaaaacggtatgtagattcttgtcagcagagatctgccattgcagttgtatttggtaaaattccatcccaagttatttttctgatagtggaattatattatgcttacactgctggaactctatttaccctgttggagcattcctaaggaaggaagctgagtgtggggctctgaaattatttagaattgacctgagaatgaa

SEQ ID NO: 152922 - DNA, 515 bp, Homo sapiens
acctgcctctggatggcagaggtgtgtcctgcagcctcctcctgcatacaccacccatgcccacacttgcgactgggcatccactctcagcaagctgctcagctggcccagtcttggcctgagagtggccggtggagaagcctgtctgccttctcctggaaggaccctgtgggtgggaggagtggcccaggagcaggggagggggtctgttctcagtcactggtttccttgcctggctctcggaatgtgcacggcatctggtttggctgtgcgtccccctgggaggctgtgctgggtcaagttcttccagtcttggcccaaggcctaagcataagcatggagtggaccccttcactccacacaagaatttccgtttgagcctcagaaaggattccctggtgtccaagactgacttcaaaccctggttgtgtgatttggggcaacctattaactctctgagcctaggttctttatctgtaaaatggaaagagtattagtaacaccgactacccagg

SEQ ID NO: 152923 - DNA, 317 bp, Homo sapiens
tgttggcattttggtattttggaaagggatggggggaatgcgggtgtcctggtggcagagggtccccactgggagccccccagggccccttccttggcattgaggaggctcttgctggggagagctgcctgccaccttcctccccatgattttcccttcaattactgctccctgcccgtcttggcacagcttgtcataaactcatttatactaatgtgtgagtggctaagtgtgccttcgaacttggccggcagaggggtgaatctgatggagggaattctggggggcctcctcagctccccaatatccccctttct

SEQ ID NO: 152924 - DNA, 293 bp, Homo sapiens
taaggaaatatatatttaatcattctcttgaacgatcagaactccaaagctagttttctataacaaaatgtaacacagacacggtggctccaagggccaggaaggcagtggttaagacacgaaaagtgtgggaagggggctggaaacaaagcattcttttccatcaaagcttcattcctcaaggcctcaattcaaacagtcattgtccctgctttcaaaagtctctgtgtgcttcatggaaggtatatgtttgttgccgtaatttgaactgtggccaggcagggtctggagat

SEQ ID NO: 152925 - DNA, 800 bp, Homo sapiens
agctatgctgaactcttcgagaagaaacacattcctgagagaacaaatggggcattccacctgtattccacggaggaagacttatttcaagacataagcagagccacttgtagaaggatactgctcttatctttttgtgtttttcatgacctttcttttcaggcaatgtgttgcagtttggtcccataatatgcaactaggtttgtctgggctgacttatctgggttaaaatattcaaagtaattctccatttgctatccttcccaaaacactttgttaaaagttatcagtacataggtaaaatagcttaacacagtgaaaattctaattcagaataattatctgaaaggcttaagtgaattaaaatctgatttataaaattctttttgatatctacgaatgtatttttaagttctctcaaaatatgagctgattctcagacattttcaaggagagttccttttggacctgttttaacaaacaggtaaaaatcatttttaattagttcatcattcatatgcaaataaatgctgctacagaatttcaagagtgcctgaaaggacttcctaaggaaagctaatagttccctcgtgatttttttctatttatagtttatttatcaaacactttcatagaaaaagtacaaagatcgtgatcttacctatgctagaattatctcagcttcttaaatactgtttatttaatgagattttactggaatcctcatcgttagttttatcacacaggaatggtaattgtgtcatgtgtataaaccttctggaaaacattccagacctcag

SEQ ID NO: 152926 - DNA, 367 bp, Homo sapiens
acagacactgtctctgcatgttggaatttagtctgtaaagtctgaatggtgatgatctggaccagcatagtgtggaaggtactggtctgtgttctggatgatttaggttaccatgccatctccagataaatggagtattgctgtttagggccctgacttatacacttggtcatttccacctctggtctacagttgcctaccccgcaatccatatgcaattctgcatatggctttattttctaggaggtggagggaggaaaagaggtgaggatttgcgtgaagacaagctagtgttggtccaggttttttctgctttctcaattatcctataatctttgaaaacacattggtttttttttctctcttg

SEQ ID NO: 152927 - DNA, 452 bp, Homo sapiens
ccagagtagcatattttgggatggcatattctgatctacaacaccaaagaaaaactgctcctatctattttttgcataaaggcagtcactgacttttgttatccataaataaaattcacagataaattaatcttacttattttctaaccctggtatgctacagtttacatgcttaccccacctcatattttcatctcgttaactaatacataagctgctttctccacacaatttgtcatcattccaaaaccatttttttttttcaaatttattccatgtgcatgaccgtgtccctttgcctaacatatccatcttttctcctgtgaaatttcaagttttattcttccattgttccatttgtgacctaatctgtgaagcctttcttatcttttccaagtaaaggatcactctcttcttacttcttcagttgcccctttgagctctataatata

SEQ ID NO: 152928 - DNA, 209 bp, Homo sapiens
cataagtacataaaaaagaaggagacaaagaacattcgatacccaacctcaacagctttttccaagaaaccttccctaaaaaataaaaaaagaaaacctcgaggccgatacatgagaaatgttggcttttaaaaattgtttcccaggcagagataattcctttatttgcatctctcacattctccttctctttccccgcaacttcatta

SEQ ID NO: 152929 - DNA, 280 bp, Homo sapiens
gtatttataactgccttcttctacccattccagatccctttgccctcagcagacacctgagctgcttctttacccgatggggtgacccaaacctttattattgcagagtctgggtgtattagtctgttctcatgctgctaataaagacatacccaagacttggtaatttgtaaaggaaagaggtttagttggctcatggttccacatggctgaggaggcctcacaatcatggcggaaggcaaaagaggagcaaagtcacatcttacatggtggcaggcaa

SEQ ID NO: 152930 - DNA, 408 bp, Homo sapiens
ataatgtcgttcaatctgtttcttctaaaattacatgaagtcaagccttagttacacttggccatccttcttgagctaaggataaacttacctttccacactggtaggctgagctggagggagtggagaaacctgtattaccaatgtgctggctgtggtgaaataatagcttttaagtagtctttttctaggccattgcattgtacaaaactttttttttttggctgttttttttttttttttttactttacctacattgtgaccacagtagcattaacatttgctgtgttttacaagaaacaagatttcacaaattttatttaaactgctttatccataaaagcctttgatatataaaaacttcatttgggtctcaccaattaaaaatgcaattatttctaaaaaat

SEQ ID NO: 152931 - DNA, 1066 bp, Homo sapiens
gagatgtaattgactcacagtttcacgtgactggggaggcctcacaatcctagtggaagatggaggagcaaaggcacatgttacatggcagctggcaagagagcatgggtaggggaactgccctttaaaaaaaccatcagaccttgtgagacttattcactatcatgagaacagcacgggcgaaacccacccccatgattcagttacctcccactgggtccctcccatgacatgtggggattatgggagctgcaattcaaaatgagatttgggtggggacacagccaaaccatatcaagtgctaaatagcaatttgataaaggaagtctacaaaaaaacataaaatcttacttaaaggtgaaacactgaatgctttctacccaagataggaaaaaacaaggatatttgcttttacaaattacttgaagtctagccagtgcagtcatggaagacagagtgtggattattagcttaccacctcataccccatccccgtattctttatcatagcatttttttccctaatagttacgtattcagtaatttacctctgtattgccactctttctcaataagctccaggagaggggcatctagcataatatctgtcatataattagaattataataaatacttagtgtattactgaatgcatttaattttgggaaactttctcttccctagattttcatttttcttttggagagatgttcactaatttatccccagggaaggaaaagtgaatgatctcattggtgagtttaggagaaggagctgggctagtttagctgagacggttccttttcttttagttgtagagagcacacgttatattctcctcttctatgtgatacgttttatagggaaagcccacactgcgggaggtgctgcttatgattgagtaggtaaatctgtttgattcaacagtgaaatagtattagcaagtttacctgccctgaaacctggtatgttttctacaattcagctttgctaataatatggctgatatttttatctttagccccctggcttacgtgactgaactcaagaaggaaaaggggcagg

SEQ ID NO: 152932 - DNA, 757 bp, Homo sapiens
gcttagatcttttgattatacaactgttgcttttcactgaactccaaagggtctccctggcacttgggctattcggtaatcagacaagaatttgaggaagcttttacatgccaatttaatcactctcccctctgtggctcccactgtatgggatttgtttcttcaattttctgccattctggcagctacctactctatctcaagcaactttctgtttatcttctaactgcccctgtgctgcacggactggggaggaacatgcagcatagggcagttaggagatcaacagaatcagggggaaagctgtttaaatatggacctcactctgtgcagttcccttctttcaagagtgaaatcctctccggtttttgtctgcccttgataccttcaaatagttttttcaatgtatttaatatggtttctttcatttctacccgtaagaaggttagtttggtacacgccactctgctattgttgaactgaaattgcccctttccttgtttagataagtggtggcagatcataaatacttcatcttgcttttcgtatctaaccatagattctgatgctagtccttagcaaaatatcaagatactcctcattcctttttacttttacgtagtactccattttttagagatatatactataatttattaaatcagtcttctattgatagctattccaatgatgaggcacttgaatttatggcagtgggttatacagtagtcacaaaataagccctttgccttcaagg

SEQ ID NO: 152933 - DNA, 602 bp, Homo sapiens
ggcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgt

SEQ ID NO: 152934 - DNA, 887 bp, Homo sapiens
ggacacaaactgcatcttagcgtccctagattctgctcaaccaggcacccggcagagggcagggactcaggaaacacgtggccccacctagcacctcctccactgtcaggcccaaggaggccccaggtgccctcagtttctggttggcggatgagatgccttgaaggatgagcaccacagccaaccccatgacaggcaagcagactcacctggcggtcacaccacctcctagcttggctttcaggtgtggcatttttggtgactcctcacccacctcaccctcaacctcaaccacatttaaagagccatagttgagcagcactgggcgttgggactttatcaggctggctctatagccaaaagggtgtcaggatttgggcagattaagaagggcagagtcatttttatgggtaaggaggtggctggaagggtgcgtctttgccctcagcagtgtgtacccactcgttggagaggcagagcagaacagacgggcctaaactgcctgtcctatccctatcaccctctttcctcccagagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgt

SEQ ID NO: 152935 - DNA, 664 bp, Homo sapiens
ggcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgtaaaaaaataatattatttaataaaatgccggccgcaatttgagcttacttggccaattcccg

SEQ ID NO: 152936 - DNA, 603 bp, Homo sapiens
ggcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtcccccccgccgtccccgctccacgctggagcccacccccatgggcattgtgagcagcaagcaggtgggctgtccttccaggtgtcatgtgaaaattcgatctcccctttaaccggattgatagagcaccggcttataggctcataatctattcattttacccaacgtgaattgatacgggttttcacaagaccataaatggtaatcttccgctaagaccagagagtggccatcagtaaccaacacgcgcag

SEQ ID NO: 152937 - DNA, 696 bp, Homo sapiens
ggcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgtaaacacagccgcccccaccacaccccacaccccacaaccacgccacaacacacacaaaacacccctaaccacacaacaaggaaccacaccacca

SEQ ID NO: 152938 - DNA, 549 bp, Homo sapiens
ggcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccagagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgt

SEQ ID NO: 152939 - DNA, 699 bp, Homo sapiens
gtctgtgtggagtgagttcaaaactactgctgtgcaaagttttccctctgcagtgtttatcagttgcctactttgtaaagagcaagggtttcaggcattctaaacccgctttgttaactggtagattattaagcagttacaggatataagctagtttttgggtgttcgggagattgttcagcatttaagaatacaatgattcccccatcccctactcccttttagttacttaaaatcaaaccatcttatcataaaatgcagattttatgcagatttttccagcagttttacttacgcttataaaaacagatgttgggttgtctgtcaaaggaattatatcctgtagacctggaatctgtgtttgaggggaatttgattttagattgtagattgctttgttgcctacctatgaaaacatcatttatttttgtgtagggttttgtgagctttttttttaaatggtgacagaaaatgaaaatagcctaattgtgttttttatcatcaaaggatgaaattggcttatctgaatttggctggaaaatttgatttggtatcagcaaatgatgaactgaaaatcaatgagctttaatctgctctggataatattaacaggggtttatcctaaataggactcttctaacctgtgaatcttagaacctttccactttttggtgtcaaagttttaaagcatagtagctt

SEQ ID NO: 152940 - DNA, 378 bp, Homo sapiens
aaaacattaatgactaagtatatcccatgcactgaatatgctgttttgggcccaaggttggttagtgttgccctctctctttcacctcctccccctgaccccccactgtatctgggtatatagtcatgcagttcaacctgattttaaatatgtaaatacttaaatatttatctactgaagatctgaagactcaaaggaacttttaaaaagtttttttcgtgacagtttaacatgagaattatagaatcactatagtgaaatgttagcatttaatatgaatatatatctgtatcacataatgagctcagagttgatctcacttggtaggcagagtaagagatgattaaaagcattttatttcagctatgtacctacaca

SEQ ID NO: 152941 - DNA, 274 bp, Homo sapiens
tcatgatagattcatagggaaatgatacagttgaccattgttctggcaggttccatgtgctgagtcctcgggtatatatctcacaggaagtgattctagcttgggtgggtcatctgcgttctctgttggccgagtaatcactggccgcgctgtgggcaccagagagagagagagtatgggcggttatcagtctgtctcgctgtctttagcctgcagaacctgtgtatcacccggttttgtcactgtctgcagggatgcgcgtcttctttggaca

SEQ ID NO: 152942 - DNA, 648 bp, Homo sapiens
tcaagtgcaaagttgatgcctgctccatgccaggccatgtggtcaagagaaataaaacctactccttgccttcaacaagtcttcagagcgtggaaagatgaacaaggtggcaactatgagtgtggataccactatgttcagcgtgtgtaacaggacagttattacaaacaactacaaaagcaaagccaaatggcactttgagaacaacaaataaactctgcttccatttgaaagcaaaccaagaatcatctggttctctcttcaggaattctccaagaggctggatataaggtctcactctatgagtcagacaaggggaggctcccactcataaccacatggtcgtccccaggctgaccaaccagggaacttcagcagcccaagcactgggaagcccactgggaatccactttctctgggctttgaccccaaagacccaccagagaggctcccagacaaaggactgtcccagaggctcctgaccgggccaacaccatccaaaccctcatttggaaaggcaaacacctctaccagagacacgcataatctgatgaagaatgggctccagagatgatcaggaggggccccctctaaacagcattcttttctttttttttgaaacagaatctcactctgtcgcccaggctg

SEQ ID NO: 152943 - DNA, 441 bp, Homo sapiens
tctgcttctctctctatcctcattctctcctaagcagatactcctggcttctataatccctgcttatcagcccctgtggaaaaagatggcgcctttagcaacatctctatatcaaggacgttgattgatttgattgatcaagcttggatcctatgaccattcctggtctaatcctcatggacaaagaaataggatactgggatcagtaaagcctgaatcatgtgctcacccttgtatcccagggtgggagtggggctatacagagtactgtgaggggaagtcatattttaaaaaaccacacaaagtataaagtggcagatactgtagtctggttcactcaatattccctctgtaatctttcaaccacctgctaccttctgctacaaaggctggaaagtttaaaacaccactttccagacaggcttgcagtgagggtgcagg

SEQ ID NO: 152944 - DNA, 502 bp, Homo sapiens
cccagttgtcaactacttctaataacttatcactgacatcaattgtcagtatcatccctgatgaaaatgcctatttaaatgatactggatatgaattatattttaacctcctaacagtccatcttgagtcactagcactctgttgaatcataatttctgctacaaattttgtgtatgaataagaattattgagcatttgaagagagttattgaatagcttgactctggagaaagaagtctcttacccaggcctaaaattccattttgaatgctcaatttttatttccatttatgagaatttaaaactggcactagctttctatttcccgcctgtaacattcctctgattcataatcttcctccacctttatttttttaattttttgagacagagtctcgctctgtctcccaggttggagtgcagtggtgcaatctcagctcactgcaacctctgtctcctgggttcaaacgattctcctgcctcagcctccctaatagctgg

SEQ ID NO: 152945 - DNA, 434 bp, Homo sapiens
ttgcgaacaggacaagcaaggaggctgcggccaagctggagcccccgcccaccaggatcgcggcactctctgaggacaaagtacttccgaggaagtcttcctcccctctggtcttccctgcctcctggctggggacaaggcttgcaaccctgctgtagggctgcaaggcagggctgccagggtgaggctcagaggcttgctcaaggctacacagctgacagaaattgacaaggtgatcctaacattcatatgggaagggaagggacccagaatatccaacaccaccttgaaaaagaagaagttggactcacacttcccaatttcaaaacttactacaaaggcaaggtcaacgagactgggtggtactggcataaggacagacatatagatcagtggaacaaaaatgagagttcagaaataaaccctccaactta

SEQ ID NO: 152946 - DNA, 222 bp, Homo sapiens
tggtgggacaactggatattcacatgcacaggatgaaattggactcttaccttgcagcatctaaaaaaattaacctgaaatggataaatgacctaaatacaagagataaagttataaaaatcttggaagaaaatatagaaacaaatttttatgaccttggattaggaaatgcttttttttttttttttttcctggacagggtcttgctctgtcacgcaggct

SEQ ID NO: 152947 - DNA, 462 bp, Homo sapiens
gtgcaaatttttatgctttgaatagtacacaacattactgaataaaattcaatacatgatctctatcaaaatccctttcttggggagtttgtaaaaattgccttttttttttttttttttgtagaaattgacaaggtgatcctaacattcatatgggaagggaagggacccagaatatccaacaccaccttgaaaaagaagaagttggactcacacttcccaatttcaaaacttactacaaaggcaaggtcaacgagactgggtggtactggcataaggacagacatatagatcagtggaacaaaaatgagagttcagaaataaaccctccaacttatggccagttgatttttgacaagggtgccaagacaattcagtggggaagaaatgaacaaatgtgtggtgggacaactggatattcacatgcacaggatgaaattggactcttaccttgcagcatct

SEQ ID NO: 152948 - DNA, 153 bp, Homo sapiens
ctctacccacacaaaaaaaatgaacaaaggatatacattggaaattcataggaaaatataaatgacctgagtcttaactttaattaactgttagcaaatgctggccgggtatggtggctcacgcctgtaaccccagcacattgggaggccaag

SEQ ID NO: 152949 - DNA, 714 bp, Homo sapiens
tcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatat

SEQ ID NO: 152950 - DNA, 835 bp, Homo sapiens
gcctcgggccatgcagctggctgagtgagagctcctaacttgtactttctcccctccccggaagctttggtttgttgggggaagcagattcatatcagacccaaggcaactcagctgtgattgagatagacattgagtcttttgggagacagaagggagggagagtgccagtcaaaagggtttcgtgaagaaggttgcatctgactgggacagttaggcctctgtgtaccactttaaaaggtgttgacttttctagtaaatatcctccatgtcaaagtctatctcaagatctgttccaggacaaccccgcctgcaacagggcccatttatgttccagccagcacggtgatcctgagtctgggagggtgcccacagactgcttttgtgagcagcatgccttcagtggccagtccccaagcccctcaactccatgtggagcaaggaccaaccaccccatggagaagaggaacccgcctgcaaggcgagccaagaagggacctttggaaccagccacactggactctgtagggggctggatggctggccccaaaaggataggtccatgtcctaagccccagaacccgtaaatattgccttatttggaaagaaattctttgtagatgtcattagggattttgagatgaagagatcatcctgtattatgcaagtgggccctcaatccaatggcaagtgtccttacaagagtaaggcagggctgggtgtggtgtctcacacctgtcatcccagcactttgggaggccaaggcaggagaatagcttgaggccaggagttcaagactggcctgggcaacgtagtgagaccctccatctctaca

SEQ ID NO: 152951 - DNA, 356 bp, Homo sapiens
gaatgtcctgaggctcaatattccagccatttgttcctgtctgttgtctctcaaaccagatcctctgccacttctgaaggtccctgcaaaagaggcttctgcctctaaccctaagcagccagcccaagcctgccatgtggagagaaggggacagggaggcaggagttgcaatctgtgccccgtgtgccccctgtgccatcaccctgtacaattgtggcccaggcaaagctcctctctgtacctcggtccccttgtctcaggaacaggatctctttctttctttctttctttttctttctttccctttcctttcctttcctttcctttcctttcctttcctttcctttcctttcctt

SEQ ID NO: 152952 - DNA, 147 bp, Homo sapiens
aattcaccaagtcctattacaaataatatcagactgatccaaaataaacttccatgtgggttccccttctcctatacccattaaatgtaggtgcttcatggaggctctccttagcctccttttcttttcataaaaaatgtctctcat

SEQ ID NO: 152953 - DNA, 314 bp, Homo sapiens
  misc_feature (176)..(176): n is a, c, g, or t
aataaaaacaattttacaccaattaaattattaaggaataggccaggcacagtggctcatgcctgtaatcccaaaggaaaacaaaactgggaggccatggtgagagaagcgcttgagtccaggagttcaagaccagcctgggaccccgtctctccaaaaaaaaaaaaaaaaaaaantcccgggtttggtttttcccagtggggaattttgggcaagccaattaaccctttgggccccaagtttttcaacttgaaaaagggggtttatataaacacttaatgggcttcaaaaaaggttttttggcgcccccaaat

SEQ ID NO: 152954 - DNA, 789 bp, Homo sapiens
ccaggcagtggctccttggagagtgggcctgcaaactctacaccggttttgtgttcctcaccttctccaccagtaactgcctcctggtcctcatctctgtggaccgttgcatctctgtcctctaccccgtctgggccctgaaccaccgcactgagcagagggcgagctggctggccttcggggtgtggctcctggccgccgccttgtgctctgcgcacctgaaattccggacaaccagaaaatggaatggctgtatgcagtgctacttacagttcaacttggagaatgagactgcccagatgtggactcaggaggtctttgggagacaaatggcggtgatcatggcccacttcctgctgggcttcctggggcccttagcaatcataggcacctgcgcccacctcatccgggccaagctcttgcgggagggctgggtccatgccaaccggcccaagaggctgctgctggtgctggtgagcgctttatctgctggttcccatttaacgtgatgctgttggtccatctgtggcgacgggtgatgctcaaggaattctaccacccccagatgctgctcatcctccaggctagctttgccttgggctgtgtcaacaactgcctcaacccgttcctctacgtcttcgttggcagagatttccaagaaaagtttttccagtctttgacttctgccctggcgagggcgtttggagaggaggagtttctgtcatcccgtccccgtggcaacgccccccgggaatgatggaagacttcagctggaagctggaagccgtc

SEQ ID NO: 152955 - DNA, 385 bp, Homo sapiens
gttattgaactcagtctttatgcattcaatgacccatgaatgaatgaacaaatgaatgcatgaatatgcaggcagaatacaagtcagggagcctccacttttacagtcagttgctgggtgactttggacaagttacttcccttctctgagcttgtttccctgcctataataagagttgattttcatagcttctaacttctcatctggctgaaaatccttctcagtctgagaaaggtagaaggcaaagacctggccagaaaggaacttgaaacatagaatttcttcacagaccctgtcttgaatgctccccttcctgtcctccccagttcaatcagcttctccaaaattgttggctggtaaggccttgccaccagttagcttctca

SEQ ID NO: 152956 - DNA, 431 bp, Homo sapiens
  misc_feature (35)..(35): n is a, c, g, or t
ctgctctgaaaacattagagcacagtaactactantgacgctaacactgggtgtgaaaccaatagaggcaaaccagataaaagcttgggggttagtgggtatagtgtaggcaaagtagtggtgtaggttttgtgaaaagaagaagaaaaggaaaaatacttggaggaggcacgtcctattcctattctatctcaacatgatctggtttttattttttattattagatttgtttcaaatcatataaatggctgctagtggaaaacagatcagatctagaacagttatgaagagtctagttaggactggttaggaaaagagatggagtgctgacagtactgagagagagaaatggatgaactacaggtcagacagcttctgagaggaactgatgaggcttgaagagagatttgcatttcaagaagtaatgata

SEQ ID NO: 152957 - DNA, 172 bp, Homo sapiens
gggtctaatcgaagctgtagccaccggcctacgccagagcgacagcagctctgtccatcatgaggccaaaaaatccaatgtagaatgttagacagcaagactgtggagaaaattaaagcagttaaggggaatagagtgttagctgcgtgtagagttctcactgttttgtaca

SEQ ID NO: 152958 - DNA, 501 bp, Homo sapiens
gtggccataagaaatgcaaatcaaaaccacaatgagataacatctcacaccagttagaatggcaatcattaaaaagtcaggtgctgcagggaaaccaatactgaaaaagcatagtgtgattgatgctggcagaaacacggctgtagaaaacctggacctactgggttccgaggtgagaagatgttatttttttagagttaatagattggttttactagcaactttgctggatgtcagagaaaagtaattctacggtataaacttcatatacattttgcttaatataatactccctttaaatacagttttagaggctattacagaatttcagaatagggaagtacaatctggtccaacttcatttttgacataggaaagtaaaaaccaaaaggtaaaggtttttgaatcaagacaaatgtttactaaacatgtacttactatagattatatgctatgaactatggcatatataggtactggggatactgagacaggaaagga

SEQ ID NO: 152959 - DNA, 162 bp, Homo sapiens
catgaaacaaaacacttctgcatggggctccctttcataagatctgatttagaggtctggctacaagcaacagaatcctcaggaaggctatgaacagagaaggctacctttcagaacctgaagcttttctctcccggctggatattctgcatttaccccctc

SEQ ID NO: 152960 - DNA, 160 bp, Homo sapiens
ggtcagaaaacgtgtcagggttcattcctgggccattttctaaacgttggcagtgagtctgcctgcagttacatgaaggccagtccagaccaaacggggctgcaaccgtctctgtctccagggctacgtctggaagggattttgctggaagggattttcc

SEQ ID NO: 152961 - DNA, 288 bp, Homo sapiens
ataactgcaaacaaaattctaagtagagaaagtgttattattagtagtataatcctgagctataaaataaaatgctccagtaatatctatattatccattataaacacaattagtataatgtaatccatctttctaagccatctgtgggggtttggttacttcttcttacataatctcattgaagaggatctcatggcatggaattagaggagaaaccactatgtagtgatgagatttatctgcacaatgcaagatttctagctaagcttcatgtaaaaggtatgtct

SEQ ID NO: 152962 - DNA, 274 bp, Homo sapiens
cgccttggcctcccaaagtgctgggattacaggcatgagccactgcgcccggcctgtctgtgttcttttgagaagcggcacagctctgaggcatcaggccaagctcagccctcggtaacatgcctcagttcccctcccagatggaggcatcgttgtgagagtctgattgggaggggaatatgaaaatgttttcggaagataaaagtactacacagatgtgaggtggttttgccttggaagaaagtgctccttagatgtgtctggatgttatgca

SEQ ID NO: 152963 - DNA, 247 bp, Homo sapiens
cccctgctcctcaaattgaaaaggcagcagcaacttgggaactaagcgcttggatgcactcggtacttgttaattggtgctcatgctctaaggagctgagtcttggggttaggcttgaaatcctaagcagatgagaaaccctgccctctttaaccactgctctgctctcctcttgggtgcctaacctcgcctgtgggagggcagccctgttctttgtctttctccacctccttccagcaagatcgtc

SEQ ID NO: 152964 - DNA, 545 bp, Homo sapiens
ggtatttgtcatttaggaggaaatccaccagactagtgctgcaccgtatctttcagtcccctctccccatcctcactggggatgtcttagtttcaaaataggtctccccaagaggtccatttattgagtttgaatggcaagtgctttggaaacaccctgccttatcagcactctataaaatgttctcggttatagcatccttttgataatatagttaattaacaactgatgttacagagattttaattgtgagatcaaaattaagcaaagagcaatggaatagaaagagcacatttgtagggcttaccatctctgcacatgaaaccaaggctcaaaattaggattcaaagagaagtgtaactgttatttcagaaggtggattcatacagcaatgagtatcagtttcatcagcatgggtcatgaatacacattcctagagtcccagatttctatctagtgatacatactctatccttaaattaaaaaaaacaaaaatagatcaaaattttaaaacctggggtgagagaagaaagagacttaagaga

SEQ ID NO: 152965 - DNA, 538 bp, Homo sapiens
  misc_feature (35)..(35): n is a, c, g, or t
tacgaactcgagctcgtgacccattcgcgaatcanctaattcactaattcacctaattcacctgtattaggacttcacctaattcacttcactgtattagcacttcacctcctccttcacctcactgtattaggaccctagactgctgctggcaatacgcgcggccacagccgctgggagacacctgtggctccactcccctcctccagggcatctgtcaccaatctctgcagaccagcaccctctcacgggcgcaggaccagcctggcacaaacctttggctgccatcagggctgaacacgcactccccagaaagaggccaggagcacagagggaggccgtctccatccctctctgtcctctgtgttcctgagataggtgtgagtcacaccctgcaggctccccttccttgagaactcacgaacagggggatcccagccacgggtcacgctgtgggttttaacccggaaagaacaagacaccacacacctgcctcacttccccaggatgcgtcctaggtctcctagtgaactcccag

SEQ ID NO: 152966 - DNA, 333 bp, Homo sapiens
tgggacagtggcagaggaggaggggggctggctaagagccagattgggccagggaaggagctgagactaaaacccctgaggtcttgttaagtgggtcttacgctcaggccagggacgatcacataatcagttccagtcggagctggaaccaaacccagcgtcctgagggtgcactccctgtggggtccccagtacccagcatggccaggagagggagtgtgaagaagccatgcggaaggtcggcgctgcagaggcgcttacatccaaacgtggcaaagtccacatgtggatggtgtcatcacttagagggggacaacagacctctccaacagg

SEQ ID NO: 152967 - DNA, 250 bp, Homo sapiens
gttttagatggagcagaggaagaaaaagtgaaggaggaagagaaagaaggaagaggaaaatcaggatgacataacaggaagaagttgcaaaaatgttataaagattgtatagttgaaattactgtttattcaaaaatgtgccttctgatttgtttgaatataatgaaactttcgaaaaaatgtattgaaattgatatcacatttagatacagttattaaaataaattgtaaaaaatacttttaaacaaat

SEQ ID NO: 152968 - DNA, 379 bp, Homo sapiens
attagcgcaggcaattagcacccacctacctgctacctttcccccttctcctgggccagaagaggtgaaaaccacccgtgggagcctggctggccctgtgccaccccaccctgagaagtgaggctggcacaaacagactcaggctggctcaaggcccagcagccagctcagctcccctgcttaccccagcagcctctgctcttcccaaatttctcacccaatccctttttcccaggcccatgggagctggcatccccaaagagctgaaagtgggggctgcctcctgctgggctgccccctcctccatacagcacttttgtgggaagtggaggatggcatccctctgggcaaacccctcctcccatcgtgtgctcacttg

SEQ ID NO: 152969 - DNA, 525 bp, Homo sapiens
tgaacctcattaggtttaaggtaaaagaaaattaggatgagttgacttacagtaaaggagggacaaataagcccccgagacaaatgtaaaaacacaaagaataagaggtaatagaaagaaaagaaaaccaagaatgaagcaaacccgacacgagtaggttaagatgaaaggtttagttgaggagcttagtgcagtaaactcccagggattatcaactaaattattattggattccatagtttctagaatacatgtaatccaaggtcagagtcaggaatctgtactgatttcaggtgggaggaacacctgtcttcccaggaacttcaagattgacaggaagcctcagcccttgtctgggtggccacttgagtagagtggaaataagcagtgctgtgtttaagaccgtgaacacaaagacagtggtgtagctccacctctgggaaatagagaagccttccagctgaaaaaagagagcattatcaggcaggacctataaggcagcaatactgggtccctgacctgtta

SEQ ID NO: 152970 - DNA, 502 bp, Homo sapiens
  misc_feature (466)..(467): n is a, c, g, or t
agaccttaataatgtaagtatgcacttctagggcaatagctaaaagaatagaaacagagttttaaccttcaaaacagtaaagagaatgaatagaaaactttaattgaaaagagcaaaaattaagaaaccaatggcagggcagatggaagacagagcaggatgggtgcaccgtttgtctgtcagtaacaacacaaagcggactgagtgctccagcaccaatcagattatgtatgtgttactcagaagagatgcctgaaaacgcgaacagtgtgtgtgtgagtgtggtaacatattatatgtactataatatacacataagctctttacagaagaaggctgatgtgctgatacctgacgaaagagattctaaagcaaaggcatcattagagataatggtgtagaacaccacaccgagcaacggcagcacatattttctttcaaagtacaaatatatcattataaaacnngccaggtcgtctcgcgggggatcctctaaggtcac

SEQ ID NO: 152971 - DNA, 338 bp, Homo sapiens
agtgacctagagattcacataactcattttccacattgcatcttaaagcataactccatccctgggacattcagaatttcctcttcccaagcctcggaactagagccaaatcccagatcccacacccttcttcatcccaacacagccatgacctgtgaccttgctgttcagaggccatgtcagtgtttgcaggctcattccaccaaatcactcaagggtaggggaaggaaagggctaacagcactcagggccagaataagaaaagccttgagatcccaaatcagggtgaagcaacttgttcccagagcagtgatgactccagggactcctagacatag

SEQ ID NO: 152972 - DNA, 595 bp, Homo sapiens
tatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctctttta

SEQ ID NO: 152973 - DNA, 313 bp, Homo sapiens
acctcatatggacttgtgagatacaacaggagatacaaaatgataaggacagtctctggtacactgtgagcttacatggtagctattattatactactgctactgaaataaacttttttttttttggctttaaagagacagagtctctttccattgccaagactgtaattcaatggcgggatcatagcttactgcaaactcgaactcctggcctcaactaatcctctcgtctaagcctccgaaggggttgggactacagccacacaccaccacatttgccttttggctgtgggaatgaggtttcactatgtgg

SEQ ID NO: 152974 - DNA, 282 bp, Homo sapiens
tctctctcacgtgcacactctctctctctttcttgctctcttgcccatctaccttctgctgtgggatgacacaacaagaaggcagtctctagatgcaggtcccttgaacttttacttcctggactcaagaactgtaagaagtaaatctctgttctttataaattacccagtctcaggtattctgttttagcagcagaaaacagactaagactaatctaatcatattttctctgtcactacttctagttcagatgttttagtttgattaccagaggaaagaca

SEQ ID NO: 152975 - DNA, 649 bp, Homo sapiens
ctaggtaaaaaccagggtaaagagacttaatggctgaatgagtacaagctggagtgcttgagatgaataaacctgtggtcctgtaacatattcagcaagtaaacatattgttctcttttaattccattagtgagtaagcgaaaggagcttcttgattcccaattttacctttctcttgtcaccccgagtcttgtcatcaagacacaaaagagaacgtattttcttctttttctattatccattaggtcttcttcgaaataattggaaactttttcttaatagctaatacgtatttctgagtccttcttatatgccagattctatgttacacacctttaattctcagaataccctatcaagtaggttctatgattttccctgagaggaaagcaaagctatgagaggtgacacaaggtccccaaggtcacacagctaattagatggaaccggaatctgaacctcttggttcatcagatttcaaggcatgtactcttaatcactatcctaaattctccatatagagagccatcaaaagtcacagttatttttctgatgctcacccgaaccctgaggcataatgatgatgaggccaccctgccctgtctctgcttcctaaactgtactcttccccacctccacctcttaatga

SEQ ID NO: 152976 - DNA, 553 bp, Homo sapiens
  misc_feature (352)..(352): n is a, c, g, or t
ttttgccttgtcttaaattgatctctagcagtgcctttttccccacacccacgtattatttcaggggtcagtgacatttgatgacgtggctgcatatttcacaaggaggaaatggatgcatctagctcttcaccaaaaggcggctggagaactgtgggaacttgacctggctgggtaggctctgccctctcccctgcccctctccaggctctctgagtacttcacttgttgagaatgagggcaattccacatcctttctagacctagaaactagaccctttctccacgtgacagacctgagctccacagggaggaaagaggggcctattattttttaatttaatattaattnatatttttagaaacagggtctcacactgttgtccacagctggagtgcagtggtgtgatcatagctcaccgtagccttgaactcctgggctcaagcagtagtcccacctcagcctcccgagtagcgtacaccatcaccccagctaaattttaaatttattcctagagatgaagtcttgctatgttggttaggactggtcccg

SEQ ID NO: 152977 - DNA, 1159 bp, Homo sapiens
cttcatcataatgatgctacctgaagcagtcccggatcctgaattaaaccttcctggagctgtttgcaggatacctggcatgtgcttctagatcccatgttcatggagctacatacaagaaatttaagagtgaagggttaggaaaaagctttgattccctcaacatctgggtgggttttattatttgttcaacaacaaagagacatgcacctgatagcccttctcttttcacctcacctagcaggaaagtcggagctaaattttcttcagtaaccaccaccttagcacccatacatcatctgccccctaattcctctccatcttgagtcccatctcttacttgtttttcatggtcctggcttttcagttaatttgacagttcaccacgtgtgtttctgttgtgatctgcctcaaaccttctaggtactgaggtcagggtaagagtagtttaaaaacaagacaacacatggacagtgaagggtgtggcattgggagtaccctttctgggtcttctctcccttcctgcgggggtagcatggtagtcttctccactgccccagtttattcactggggatgcggtccagtcggaaatggggctctggctcaggggcagggaaagggacctggggagaaagaggtttcccaaccaggcctgtcacagtaagcagccagggacagggagcctcctgtctctctcaggctgggacgagggctgccattctagtcatgagaatttcctctcccagaggccctactcctcaccaccctccagggcaaggattattattaactcagctcctggagagggaactgcagaatatgtgatgttagaaacaaaggacaggtcccctggggcgggggtgcagcgttggccttgagccctgagaatggtagccccaattcttcccaggtcctccttcttggggcttgcctacagtaagggtcccacagcactgccaacaactgcaccaatatcacctctctggctctgggttcctacctctattaatacagccaaaagctgcactcagtgttggctcatagggaattaagggtcaaaaacccccaggtcatttccaggtcaatagttgtcagagagctggcaggcatcactaagccccttccctccttctccccaaccccgccactcacctccag

SEQ ID NO: 152978 - DNA, 725 bp, Homo sapiens
ggcaagtttcttttattaataggtggtcaggtggcttgggagtggggcttgggttcagtgggacgaggctactttagacacagcacaagctggtgtcagtgagataactggagaaactcagtctccttatgggcaaaatggaaaaacacgggctgaacagccacagctagacagtgggttagtagctgttgtcaacactgctggtgaaggtgctttgtacgctccctgcatgttctgatcccaaccgacatcatcagtagtcacctaggttaaaacacagaaaacgctgataaaatctgtaaagaagctggtgacaaaaaggaccagaaaaattctcaggagactggaacaataggctgaaactaacaagttgaggtgtatttgggacaattgtgaattcctacactttggttaaaaaaaatcacctttagaagtactagttaaggccggcctgttttgaaaacaatttccatggtaggtgtacaaggtgcaaagttttatgtttaatacatggttcagcaatggccagtgtaggatatagttcaaacaaaagaataatgcgacccactacattcacagaagtagaaaatcctgagctgtactcaagtgtggtggagtccattagaaacaggaatatatcagccaggcaaggtggctcacgcctgtaatcccagcacagtcggaggcggaggtgggcaaatcacctgaggtcaggagttagagac

SEQ ID NO: 152979 - DNA, 141 bp, Homo sapiens
acagcgttgtgggttaggaatctggacagtgagggcagggttaatcttcagttctgtgccaccagctgggatcacttgagggtgcttggctggcatacgggttagtctggggaccactgccccctttccggcatcctctgt

SEQ ID NO: 152980 - DNA, 485 bp, Homo sapiens
gaaatctgatgttacttgttcacactaagacatgcacagttgagtcctcctgtttatgctgggtaaacgatgcttcctaagaagaaatggaggaaaagaaactaacatttactgtgcacttactaggcactaagttctgaattaacttagttagttaatgagttgtctcattcattctcaatagccacataagaggacctattaagaaatccagggccaggtgtggtagctcgcacctgtaatcccagcactttgggaggccaaggcaggcagatcacctgaggtcgggagttcgagaccagcctgaccaacatggagaaaccccatctctactaaaaatacaaaattagccaggcatggtggcgcacgcctgagtcccagctactcgggaggctgaggcagaattgcttgaacctggaggaggtggaggttgcagtgagccaagatcacgccactgcactccagcctgggcaacaagagcgaaa

SEQ ID NO: 152981 - DNA, 311 bp, Homo sapiens
tgatgatcacatttcttctaagaaatacctattataataaattcaagaagttctggggccctgattcctagttgcttttatttcaacggtttgtaaagtgcttttacacacaccctcttatttaaccttcaaagcattctattgaagcacacagagaagtcttatgcccatttctaaatgaggaaatcaagacatgataagcgtatgtgtttctaaacactgagctgatttgtaatctctcagctccaacccacccttctatccactgcttgtggtgctggggctgggcacctgaaagatattcttccttg

SEQ ID NO: 152982 - DNA, 909 bp, Homo sapiens
tttgatctaagggtttccaaagaagcatgatgcctttgagatgaagaggcatgtcgtcataggttacccccgacagggcccctgttgctgcctgccacaccttctcaccttttcaagaagcttcattctttcctacgggaccttgaacgtcacttcaccggtattcttcaaaaacagaaaatacaggctactaaagaggaggcacactgggcatgccaaattgtggacatccttatcatatcccaacctctgtgtgcatctatcagtgatacttgttacagagacattttaacatcctttcaaaaggcaatcttctgatgcttgcttttcctgaaagaactcaggcccaaattctttagggggattgtcaatcaagagaagcgaggataagatgaaaaataaaggcaaggcgaggctctgtggctcacatctgtaatcccagcactttgggaggctgaggagagagaatcacttgagtccaggagttcaagaccacctgggcaacacagcaagacccccgtctctacgaaaaaataaaacatttagctgggcatagtggcacacacctgtggtctcagctactctggaggctgaggtgggaagatcacctaagcccagaaggtcgaaacagctgtgagccatgattgtaccactgcactccagcctgggcgacagagcgaaaccctgtctcacacacaaaaaaggtaaattgtaagaacaaaatatggtacacattttcattgagagacacatttagaacttggtttttaatttaagaacttttgtaaatacatttaaattgttctattctgtaaactgtcttcagtcataaggtagttagatattcgtttcattgtatctttccaagaagacataccttatgattagaggcgggacggggaagtggga

SEQ ID NO: 152983 - DNA, 433 bp, Homo sapiens
ttttttaaacataaaatgttgaattcatcaagtgctttttctttgcaggtagagatcatcttttccattaatctgttaataggatgtattacattaatagattatctcctgttgaaccatctttgcattcctgagttaaaccctatttagctgtggtgcattttttcacccacacggctgaatttgacttgctggtgtcttagagttctttaagatctacatttatcagtgaggtttacatgggtatattttgaattcaaagtttcgctgacttcatgaaatcagttgtaaagctttcttttttttcccccattatcagaaataattctgtaacgtagggattctttgttccttgaaggaactatagatttaatatgaaagtttctaaaacaaaacatggaaaaatatctgtatgaccctgttggaggcaaag

SEQ ID NO: 152984 - DNA, 283 bp, Homo sapiens
agtttctgattcaatagatctgagctggaggctcaagaatttgcatttctaacaagttcccagctgatgctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgctta

SEQ ID NO: 152985 - DNA, 506 bp, Homo sapiens
atgaaacagttttctttgtattaaattaatatgtatgtatagcatctaacctaaatacattgtccataatttgcattatagttgaagaaacttagcagagaaaaggagaaaggagaaaaccagttagtatggtattttaccaagaacataattatgacttataattacctaatactctctctttgaccattaatcatatctatggatcttttttgttgttgtttttcccttgcccacacatcatggaggttggagtagaatccaaatgttaataaatgttaattatggatttttaaaaatcaaaccaaaacagcaaaaatcatgaaaaaagtaattcatggaagctgacaagctttcaccttaatcatctcaaggttaaataatgatcggaattcttttagttgaagcacttacgttacatcttgatgtttgactatcatataaatataactgtactattaggctctatttttcattgcagatgaaattgatgcatctttgtgtgg

SEQ ID NO: 152986 - DNA, 305 bp, Homo sapiens
gatttggttccctctgggtggggggcattatcggggaatcagatgcggccatcagacatccagcagctacttggggatgcctcaagacacctgggctcagcacagcttctggcactcagcacctctccctcctgctggtcctgttcctcttccaagggctctcagcccaaagaatgggtccaggaagaaacacagcagtgtgtctgcattcccccctcacctcaccctcctccgcccagtcccatccatcagcaagtcccgcctgctctacgtgggttcctacagccctcctcctctccattccc

SEQ ID NO: 152987 - DNA, 467 bp, Homo sapiens
tgtgagccactgcgcctggcctaaatggggtttctaaaaattgccaaaccaagtttggtattattagtgatgtgctttcctttcagctgtaactaaaagaagatatcgtttacttcttgaactttacagtgactttgcatttgtgttagtttaaaaaaaatactttctagaaaaaaatattaaagtttgtcctaataaagtttcttccaaagttgtgataatataattgacataaaacaagtttaaaatacattagagacacataatacttaacttacttcatttgaacggccaacattcagcagctacttactccagacggattagtctttaaacatcaatcgttagttctgggtttcaataaacgggcgaaataatctgctccctaattgccatagaaaacttctgagaattaatgaaactgtgtgtaagaggtggctatatattcttccacatgggtactgttt

SEQ ID NO: 152988 - DNA, 339 bp, Homo sapiens
gtatccatagatatcgtttcatccttttatgttaataagactcaaaattgccaatatcgagaatacctgtagttatgctacacctcaaagtcctggttctcaccaatcctctagtaaatctagtatgcacaaaaccaaaaccttcccatttccaatgagaatacatgaatatgcatattaagagcaaataatgctccccagagacaactactaataaagtacttgaagactgaaataatgtggttaagaatagtaataataactaccaatttagaaaaccggggccgggtgcggtggctcacgcctgtaataccagcaccttgggaggccaaggcagga

SEQ ID NO: 152989 - DNA, 274 bp, Homo sapiens
cgcaagccaccgtgcctggctaatttttaattttttgtaaagacgggtgtctcatcatgttgcctaggctagtctcgaactcctggactcaagtgatccttctgccttggcctcccaaaatgttgggattacaagtgtgaaccactacatgctggctaacatatttgtaaagaaattatttatattcgaatagctagtaaataaatgaacaaaattcaaaatgttcaaaaggatagataataaaaataagttttttatcatctcttctccccta

SEQ ID NO: 152990 - DNA, 521 bp, Homo sapiens
cggccaagagattagaggagcagggacaactggagatccaccacggagaggccctggccattctacggaagaggcgcaaggaagtcttctgagtccgctgcttcaccttttgacatcagagggccaaaagctccaccctcagatcaggctaacacctctggtttttgcacatagagagggggtgaagctggattgcgcatatgcctggttttgggtctgcagttggttcctgctggtgggttcgtggtctcgctgacttcaagaatgcacccatggactttcacggaccttcgcagtgagtgttacagctcttaaagatggcacagacccaaagagtcagtggcagcaaggtttattgtttattcgcgaaaggacaaagcttccacagcgtggaagtagacccgagtgggttgccgctgctggctgtgtggccagcttttattcccctattggccccgcccatgttccgtttctgtcctatcagagtgcctttttttcaatcctccctgcgattggctact

SEQ ID NO: 152991 - DNA, 305 bp, Homo sapiens
cctgtggacacattagtccctgaccttcttcaattgcatcttgaccttggtcgttttccctgtatcctttggattgtgcctgccagggccactggtgaacttcagcttcacaaattttcagcaaacatcgcttctgtttttgaataatgagtatctaccttcagaagctgggttacctggaaccttcttaatcttcttctttatgaggtgcccagtgtcctcacttgcaaccccaccctgcctgtagaggggagtcaggtgcatggatcctctggactttgggtgaatctatttttttttttcct

SEQ ID NO: 152992 - DNA, 466 bp, Homo sapiens
tggtcagagagaatataagaaagcctatgtgtggttctcaaagtgtgctgcttgcatgagttttcctgtctcttttctcactttatgaagctttaggaggattgtgtctcccatgtttctgtgtgcctttgccagaactaccctcttctcttctgtacataacataaatattttccgggggttgctggtcctttctgaatgtagaaatgtagagaaaaaggaagtcatgtggagcagtgctgtagcagccacaagaaggtatacatatgcaatatgggaactactgcccagcgttataagtgacataaacgttgtatttctgagtgaggtggtagaccggggaaagaataaagcatcttcctttctataatctttcacgtggttgatttttttcggtatactctgatatttgttttgttatctttgggtctaattttgttgctttcataattagtagaattattag

SEQ ID NO: 152993 - DNA, 825 bp, Homo sapiens
agactgaacctgtggcacccgccaccaaatctgccggcctattcacagtccctgccatttctctcgttaagatgaactctccgcctcaggaacgagatggcggttccctggaggctgagtgccgtttgcggtgcccaaggaggccgagctctgttgctgcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcccgggtctgcttccggctgcttatttgaatccttgctctgcgacggactattccctggctgcagccctcactcttcatggtcactggggccttggacaagttgttactgattatgttcatggggatgcctcgcagaaagctgccaaggcagggcttttggcattttcagctttaacctttgctgggctttgctatttcaactatcacgatgtgggcatctgcaaagctgttgccatgctgtggaagctctgacctttttgacttcctactttgaagaattgatgtatgcctctttgcctctgctttggcatgccattaagctcacaataaggaagaaataacagattagcccatttggtggacagccttcttctcttaatcacaagattattttcagaatttaatccttgaggaaaaggttagaggaattatatctaagttgtgagactgagttctgtattctggtgagttaatggggttgcctcccagcttcttataaga

SEQ ID NO: 152994 - DNA, 322 bp, Homo sapiens
caggcaacttagtattgtcctcaagctacctcaagatgtaccaggaaaaaaataaaatggcatgcgggcactgcacatgcagcatctcaattcagcgacccgtgatcaaaagtactcaaagaaacaaattaatgtgaagaaaagaatatagaaggggcagcagggaatgggaaagagactgtaacaagtggtgctacacacctgtgatgtcagaaaaaaggttagttgagagaagtgaagacctgactgcttgacactggaattatttttttttaggtagggtcttgctctgtcatccaagtgggagtgcagtggtgcaatc

SEQ ID NO: 152995 - DNA, 532 bp, Homo sapiens
aattgccatgaacttgggagcctaaaatatcaaaaattattctcctacagttttggagggcaaaaatctaaaatcaaaatgtaagcaaggctgcacttcctttggaaattctgaggaagaatttgttctttgccctttctagcctttgatggcctttagcattctttgagttatagccacatcactcagtctctgtctctctgattgtattacatcctcctcatttctgagtcagctcctcttctgtatttcttgtaaagatacatgtgattgttttaagtaccaacctggataacccagggataagccccttctcttaggatttataacctaatcacttattttgccaaagagtaactctttgatcctttgagggatgtggacatgtcttttgggggctataattcacttctctgtattctatcctctgcctcccagaattcatgttcatgccatatgctaagtattacctcttttccctaccaacatccccaaaagtcacaacccattcattacagcatcaactctaagt

SEQ ID NO: 152996 - DNA, 555 bp, Homo sapiens
cactctcctcctaaagtcaataaaaacaatttattccaagtaatgtaatgatttatatactcatatgcaactttctgtttataatgagcatcattgttagaagcagggaatacaaggaagggacttttaaggacataaatgacttttatattctaaatttatttaataggtgtacacagatttatcttatagaaaaaacatcatctgtactctaaattccaaaacagtagaagaaaataaattctatacatatatttgatgtctagcctgtggaatttttatgtgcctcgaatttgcttataattatgaatctttaccacccatttccatttgttacttaagtatatatacaatcaaatatcacttaatgcagatatatgttctgagaaatgagtcatgaaacaatttcttcgttttgagagtaccatagagcatacttacataaacctaaatggtatagactactgcacacctaggctatgtggtataacttattgctccagggtacaaacctgcacagcatgatactaagctgaatactgtaggcaaatgtaa

SEQ ID NO: 152997 - DNA, 393 bp, Homo sapiens
cccggatgtcttgtcctgttcgaattgttacacagttcagctagagatttccttctccctgtggagttttacccgtcttccttctggccaccccctcaatggatccctatggtatcaggttaggaatggcctgcttggggacatagtgagctcccagggcctttctgctacttgcactacccctgtattttgctccactctctaaattgactcacttccagttaaggtcagaaacctctcctacaaacagaccttcagtttctccattctgggggtgtgttcaggagaggaggctctccctttcccactccgcaattggggcactcacagtatttggggtgtctcctgggtcctgcaggagcagtccgcttccttcagagagtctgtggctct

SEQ ID NO: 152998 - DNA, 372 bp, Homo sapiens
gtcagatggtgtgttgcccccagccccagactccacgtgtcaggagctgttagggaggccagcgtggtgacatcagcatccttcccctcagaaggatgtcctgggcctgcagaacccatctcccctctgtggcttcagccagatcctgcctcaaaacacagaaatctgggaagtttctgccaggggaggagggaagctgaaatgcaggagggtggggtggggaagggagataagaggcagaaaaacagggagagagacagaggtgaaacagagaaggcccagacagacatctggacagaccagaaatgggaagataagacagtgacagagactgccatcgccaagctcgaggccttctctgggcctcagttg

SEQ ID NO: 152999 - DNA, 370 bp, Homo sapiens
tataaatcactggtggaagtgtaaattggtaaaccactttggctttatcttgcgaagctgatcatctccatattctacaatcctgcaattcctctcctagttatacaccaaagagaaactcccaagcaaggataacaggagacatgtacaagaaggttcgtagcaacactttggctagcaaaacactggaaacaaccccaaggcttatcaacctaaaaatggattaatcagttggggtatattcatacaacataataatatgcagcagtaaaaatgaatgaactagagctatatgaaatggaattaaataaagttatgtgaaaaacggaaacccagccgggcgcggtggctcacacctgtaattccagca

SEQ ID NO: 153000 - DNA, 487 bp, Homo sapiens
tcctctcaagggtccagctggcaatataaataaatggaatgaatggggctcctcagatgagtacagcatcttccatgtatggggagcagacattactgagctgctgccatgtgggaatctcagtccagttgtgccaggtcttctgagttattccaagagaagcaagaattcgtctttgtgttatagtttccagtttctaaatattggtagcattttaaaaatatgtagtccaaagaagacagtcctgtgggctgactttggcctgcaggcaccagtttctcatctctgcttgtgaatgtcaagttctagagagaccattgctttagtcacctctgtcctctccctcctcttcccactcctgcctcaccaagaccaaattccaaaagaccagttctcctcaaaagttgtgtttcataaggaccttaaaattggctactagtctaacagtaatttatttcagttgaggactttttaaactccatgacta

SEQ ID NO: 153001 - DNA, 306 bp, Homo sapiens
  misc_feature (279)..(279): n is a, c, g, or t
ctcccctctcaaccactcactcactcaaccgaacatataggacctgctatgtgtaccaggtccctaaaacggaaacatgaaaaagcatagtcctcgcctgtaaccccaatattgtgggaggctgaggtgggcagatcacttgagtccgggaatttgagaccaccctggacaaaatggtgaaaccctggctatacaattaaccggttgtggtggcatgtgcctgtagacccagctaccctggaggctgaggtgggaggactgcctttgcctgagcctgtncggttgagcggagagggtaccgagcta

SEQ ID NO: 153002 - DNA, 457 bp, Homo sapiens
ctcccctctcaaccactcactcactcaaccgaacatataggacctgctatgtgtaccaggtccctaaaacggaaacatgaaaaagcatagtcctcgcctgtaaccccaatattgtgggaggctgaggtgggcagatcacttgagtccgggaatttgagaccaccctggacaaaatggtgaaaccctggctatacaattaaccggttgtggtggcatgtgcctgtagacccagctaccctggaggctgaggtgggaggactgcctttgcctgagcctgttcggttgatctccgctcaaccgaacaggggttggtgtaaaataggcgcttgtcagggaggtagcgatgagagtaatagatagggctcaggcgtttgtgtatgatatgtttgcggtttcgatgatgtggtctttggagtagaaacctgtgaggaaaggtattcctgctaatgctaggctg

SEQ ID NO: 153003 - DNA, 883 bp, Homo sapiens
gctgggcttgctctcatgctttcttgtccttctgccttctgccatgggatgacacagcaagaagccccttgccagatgtgggcctctcgaccttggacttcttagcttccagaactaggagccattgaagaatactgttgtcctatcccagaaggagcaagcggacaacactgatatcctgaccactaaccatccagcaccacttaaagttttaaaaagaataacagaaagaaagaagtggctgaaacctaaatgccatatggagaagacagctaattgccacactctcctctttggtctttcctggtacgcagcatacaagcccacagattgaggactctgcacttgctgttctctctgcctggagctctatggctccagatagactcctgccaactccttcgccttgtccaagttaccttcattaaatgtcagcttaaatgtgtgcctactttttgccctacctagaattgcaagcacctctcaccactgtgctcccattctccttaacttaagccacttttattctcataataaagccacatattttttcttattatatcataatcgtactgtataatttatattttattactttgttgtatacttattgtatgtttctgttcacaaggatgtaaccccatgaacacagagatcttgatggtttattcactgatttatgccaaatgtgggaacaatgctggcatagtagaagtttgataactttttctgaagataatactttggcaaatggtggccgtgtgggaaatacggcggggagtttggcgacagaagacttttccccctcaggaaacgtccttgggtacccaataatgtggcccaggaaaaacaaaggggagggacaggggaggaaggtcaaagg

SEQ ID NO: 153004 - DNA, 833 bp, Homo sapiens
  misc_feature (667)..(667): n is a, c, g, or t
  misc_feature (677)..(677): n is a, c, g, or t
gctgggcttgctctcatgctttcttgtccttctgccttctgccatgggatgacacagcaagaagccccttgccagatgtgggcctctcgaccttggacttcttagcttccagaactaggagccattgaagaatactgttgtcctatcccagaaggagcaagcggacaacactgatatcctgaccactaaccatccagcaccacttaaagccacactctcctctttggtctttcctggtacgcagcatacaagcccacagattgaggactctgcacttgctgttctctctgcctggagctctatggctccagatagactcctgccaactccttcgccttgtccaagttaccttcattaaatgtcagcttaaatgtgtgcctactttttgccctacctagaattgcaagcacctctcaccactgtgctcccattctccttaacttaagccacttttattctcataataaagccacatattttttcttattatatcataatcgtactgtataatttatattttattactttgttgtatacttattgtatgtttctgttcacaaggatgtaaccccatgaacacagagatcttgatggtttattcactgatttatgccaaatgtttggaacaatgcctggacatagtagatgttgataattttttttgaangaataaatanttttaggcaaaatgtgaccgcggcggaatcagggtgtgtactgtttgcacaaaaaacatcgtttaccattctagggaaatgtcctatggggtgaaccacaataattggagggcccaagggataacacaagggggtcaacatgctgtgaggcataga

SEQ ID NO: 153005 - DNA, 1005 bp, Homo sapiens
gctgggcttgctctcatgctttcttgtccttctgccttctgccatgggatgacacagcaagaagccccttgccagatgtgggcctctcgaccttggacttcttagcttccagaactaggagccattgaagaatactgttgtcctatcccagaaggagcaagcggacaacactgatatcctgaccactaaccatccagcaccacttaaagaggtcccaaaacccccggctgtctaccaatacccatctgtgacctcttaggaaccgagcttcacagcaggaggtgaatggtggacaagcgagcattatcgcctcagctccacctcctgtcagttttaaaaagaataacagaaagaaagaagtggctgaaacctaaatgccatatggagaagacagctaattgccacactctcctctttggtctttcctggtacgcagcatacaagcccacagattgaggactctgcacttgctgttctctctgcctggagctctatggctccagatagactcctgccaactccttcgccttgtccaagttaccttcattaaatgtcagcttaaatgtgtgcctactttttgccctacctagaattgcaagcacctctcaccactgtgctcccattctccttaacttaagccacttttattctcataataaagccacatattttttcttattatatcataatcgtactgtataatttatattttattactttgttgtatacttattgtatgtttctgttcacaaggatgtaaccccatgaacacagagatcttgatggtttattcactgatttatgccaaatgtgggaacaatgctggcatagtagaagtttgataactttttctgaagataatactttggcaaatggtggccgtgtgggaaatacggcggggagtttggcgacagaagacttttccccctcaggaaacgtccttgggtacccaataatgtggcccaggaaaaacaaaggggagggacaggggaggaaggtcaaagg

SEQ ID NO: 153006 - DNA, 784 bp, Homo sapiens
ctagaatccattttgggaactgagcagtgtggccaggaaatatagattaaatggatatttaaggaagcaaatctgttgcccctcagttgctacaaccattttatccagagtcccctagtgtgactgtcttttatgccctttttttcacatttaaataaattgtttttactctcttgtcttaaactgttttataaacttatcgtacagatgatactttcaatcctttggaaagttatcaccatgaaaattgtgagtaaaagtaggctgatatcggaggagtcataatacagaatgagtagtatttttatttaatacccattggaaccctggaaggtaataagtcaaagtctgaatatccgcctcaagtaagcacctcaaagtagggtgtttaccactatataacaggctgagcaaattaccaagacacacagctacttgacacctgtcgagtttgtcggtttttttgtttgttttttagctaataatctatacttctccccagccccccatagtgggggagaaaagggcaaaaagtatacattctaagctcttgggaaaagataccatactttctttctggaggaatccagtcctgtatagttctagttaatccatacttttctaggtgtcctgaaattaaaagtgatacaaatgaatctttcttgccagggaacaagttttatgtgctaataacatattcatttcaactaataacaatgtaatagtataaaatgttgatggatcaaataaaatttaatttgatgagcaactccataaaaaaaat

SEQ ID NO: 153007 - DNA, 403 bp, Homo sapiens
tcatctctgaatcaaggagtgtacaagatttaatccattgtagggaacagaactctggacccctcaacattaaactggtgatactcagggaaagaaacaagactgaaggttcatcatttactccttaggtattactatctcttgattaccaagaccacttacaagaataattttgactgttttgagtgtgcaactgtccagattattaagtagagaactgatcatgttaatttatttgatggtgccgttatctctgactctgattcacccacacagagctcctttctggtcctagaccatgctaaccacactctcacctcagggccctggcacttgctcttccacctgcctgtaacattcttaccccaggtatcttagggcttgatccctcacttcactcagg

SEQ ID NO: 153008 - DNA, 233 bp, Homo sapiens
ctagaactatgcaacatccagatattatttttctttaatttattttcttgagacagggtattgctctggcaccctggctggaatgcagtggtgtgatcatagcttactgcagccttaatctcctgagctcaaacaatctgccttcctcagcctcctgagtgcctaagactatgaggcatgcaccaccatgtccagctaacacccagattttcttttttttttttttgagacag

SEQ ID NO: 153009 - DNA, 270 bp, Homo sapiens
atggtggcaagtaactacaactaaatgcgtgaccaagacagagctaactcgagtcattaattagactgtgaagtctggagggaagttctctgaatttaagattacagttttgaagtttggcatctgctaccacttcaaggattaaggatttactgctcactggaattcaatatttaatattttaaaaaccattcagctccagcttgcaaatgagttaaattaaaataatacacagacgttctctctgaggccgtggtttttattggtagc

SEQ ID NO: 153010 - DNA, 410 bp, Homo sapiens
taaattacagcatgttatgttttctaaaagcaagagagataaacatcggcctggagatatgtagtggctccctattcttggctgcctgactatgttctatcccaggataccattatgcaccaactctggtaatcccatctcttctgccatgcatggcagaaagacatttacgggatggggctcctgggaaacaggccagtcaactctcctatcaagatgcagatgaggaaggcctggttgctgtcagcaactgcctgtggctatgatgacgctgatgctataaaaggcaatgtgaggggacagctgagttattgaagcaagcttttctgagttctgccctacacctgaatttagtggtttaagtagcgctgtctgtgctttacagcctatcacctctccactcatgttta

SEQ ID NO: 153011 - DNA, 467 bp, Homo sapiens
gcttatatccttctgatccattcactacactgttgccagagtgatcattccaaacacaaatcttattttatgttactcccagacataaagcaccagtagcttttcactacagaatcaagtgcaggcttttcagtatgaataagatttctacagtcaagcccctgcttatctttccagtcttgctccctgttgtgccaaacagaagccctctgtgctcctgttgctattccctggctgggccagctcactgtgtactgtttgaaatgccctccctatgtcggtctggtgatcacctgtttatctcttaaggtctcacttaatgaagcctctcctgacccttctcctgtggagtcaatcacaggctcttgcctttaggggaaatctatttgcaattaaacttgttgtagatttgctgttggcttttgaaaataagagtatatcagccgggcatggtggctcacagtgct

SEQ ID NO: 153012 - DNA, 370 bp, Homo sapiens
tagtgcaggcacaggttctgcaggctttcatctcgtggaacgtatgttagagggtgtcctcgtcactcgccatgccccagaggaatcagcagggacatcaggactgagagaagacatggcacatctgacctcctgtcctggaaaccccacatctttctgactgtgctgatcacacggacaatatctagaaaagttctgctctgcacagtgttctgtctaccaggcccacccatctgaggacccagatgctaggaacacacagatactgaaggagcaaccacctgcctaaggtgcaggtacccctgcatccatctgtaggaggaaaagcaagaaactaccatttatatggattctttggccctaagaatga

SEQ ID NO: 153013 - DNA, 312 bp, Homo sapiens
ggatggtcgccctcttcgacccgagcgcgcagggtcgggagggacgcacatggagcggtgcgggaggaaggtgacacccgcctagccagccccaaggcctgcacgccatcggtgtgtgtttaggaagaaatgaggaaacaatagggcgtctgatgggtggcagaagagaaccctcaaattgccactggaaatcacagggaaatggtttgagaagagcagctgaaatgggtaaggcctaacagggctggagcagctgtgctccagtgaccagtaactgccccttgagacgggccatcactcaagagagactac

SEQ ID NO: 153014 - DNA, 424 bp, Homo sapiens
tctttgaggaaatccaagccccgaggggtccgattgttctccagtgactggctgttgctttaggaaattccagtgcctcactacagtgctcttggagcctgttcctactcagacattttgtcacctggcagtagcctagaaactaattttagtattcatgtttgtagaccctgaaaggtctacctggtacctccccacctctcttcattcagcctgtttattcaggatgagacagtcacaactacatggggcttttctggggtttccaaggaacagaaaggctagacagaaaaactgtctttctggcctcagctcaagactacaaggcatcctgctgctgtttaatatttactgaaagctcacaaagttctaatatagatgagagcaaaattatggcatgagcttagcctcttagggcctgagt

SEQ ID NO: 153015 - DNA, 230 bp, Homo sapiens
actctttctcaaagaaaaaaaagactatatatagccccaagtttgttaaaaaataatacatgaaaaaatgcttagaaggaactacattaaaatatatagcagttgtaatctcttaattgagaaataatggtttttgtttccttttttaaatctatattttctgttttctaaaaatagccagccatactggcccatgcctataatcccaactacttgggaggctgaggtgg

SEQ ID NO: 153016 - DNA, 369 bp, Homo sapiens
aaggtgggccggatggagtcagatcttgcagctaaggggattgaggtgattgtcagagggatgcagggatccctggcaggtgcagtgcttctgttcttaacaccctgggccacctccattgagtccttcaccgcgttctagtattggcagccatctccttgggggctgtgagtgactgaggcctggcaccaagtctcttctgggtatccctagcacctaggtcggtgcctggcatatttctattcagaaaaaaggcaccatcattacatgactgttgatgttagaaaatttgattaacttttgctaaataaaagaacaagccattaaacattttcaagtaaggggtaagtaccaggtgttcacttgagg

SEQ ID NO: 153017 - DNA, 157 bp, Homo sapiens
atttgtttaaagtaactcaatatttactttatttctttcagcctgaaagagactgaaacatattccaaatgaggatatactaattgcctttcatctttttgttattgtcagacagtatattgggaaattttccatttttctttaatataattggtct

SEQ ID NO: 153018 - DNA, 282 bp, Homo sapiens
acacttgtccatgcagttggagcacctgcccctacctacctctcacgggtgtcagcgctggcattattttctgtttaaactgctgggctccacctgctgctctcaggcaccccagggctgccacatcgagggctttcacagcacaggccccaggggctgtcatacggggacagcagggacactgggtggctaagggaacacgggcacccaggtgtgccgctcatctgggccagggcgggccggactcagggttccagaactacagtcactgtcctgcccatc

SEQ ID NO: 153019 - DNA, 1068 bp, Homo sapiens
  misc_feature (23)..(23): n is a, c, g, or t
gtcgtagcgtgactgactctctncctgaacgaccgcaccagagataaagtctgactatgttgcccaggctgatatctcactcctgggctcaagctatctgcaaaccagagcctcccaaagtgctaggattacagggcatgaaaacaaaaagtaaaatgatggttggaaaaaaatgaagagtttgactataaaatacattattagaacatgaaaaacatctgtgaaatgtttagtagagtacattgttacttaaagattacttacatgtgtctcctgtctgaccaactgtaaataggtgtaaacttttcttctaaagagaagataatataaatctagtttatttgaagaatgatgtataatgaaacattattaaatttgagtggtacttaagatacaaatccaagttgagaaaaacactggtaagaatgctattgaataaactactgacaaaaagagtccctggaaaattcattatattcttgttcctatctttaagagaacagggcacttccttaagagcacaggaatcagttcttcagacaaatatattcagatactccttgtgttattctccactagttccttccagaaggttttacctgaaatctctagtcgacaatctttgctgaaaatataattaatctatctcccatatttctgaactctaaagatttttgttctgatccttttagtcatgccagaaattgtaaagttatttttccaccatcatgcaatgaacatggcatcagaaaattagttcctagtctcctgagcagtcactcttctgctttgcttcatcatttttctttgcatgtcagtttctgccaatagtaaattgagaaagaatattcacaaaattgcctttggctcacaggagttgtagcaaaattatgtcttcatagctacacaaaatatgtggaaaaacatccagcaaattcctgttaaagtagctgactttgaaaatttattttgtatctgaaattatctgagattcgtcaacttttgcgaaacatcaagcctcaaaggatgtatgtacgttacattgcacaaataaagagagatcggccg

SEQ ID NO: 153020 - DNA, 1107 bp, Homo sapiens
cgttatattcttcaatctatgttacgcaagagggaaagagaactagtctgcaacgactctcttatttaccaccgctacacagataaagtctgactatgttgcccaggctgatatctcactcctgggctcaagctatctgcaaaccagagcctcccaaagtgctaggattacagggcatgaaaacaaaaagtaaaatgatggttggaaaaaaatgaagagtttgactataaaatacattattagaacatgaaaaacatctgtgaaatgtttagtagagtacattgttacttaaagattacttacatgtgtctcctgtctgaccaactgtaaataggtgtaaacttttcttctaaagagaagataatataaatctagtttatttgaagaatgatgtataatgaaacattattaaatttgagtggtacttaagatacaaatccaagttgagaaaaacactggtaagaatgctattgaataaactactgacaaaaagagtccctggaaaattcattatattcttgttcctatctttaagagaacagggcacttccttaagagcacaggaatcagttcttcagacaaatatattcagatactccttgtgttattctccactagttccttccagaaggttttacctgaaatctctagtcgacaatctttgctgaaaatataattaatctatctcccatatttctgaactctaaagatttttgttctgatccttttagtcatgccagaaattgtaaagttatttttccaccatcatgcaatgaacatggcatcagaaaattagttcctagtctcctgagcagtcactcttctgctttgcttcatcatttttctttgcatgtcagtttctgccaatagtaaattgagaaagaatattcacaaaattgcctttggctcacaggagttgtagcaaaattatgtcttcatagctacacaaaatatgtggaaaaacatccagcaaattcctgttaaagtagctgactttgaaaatttattttgtatctgaaattatctgagattcgtcaacttttgcgaaacatcaagcctcaaaggatgtatgtacgttacattgcacaaataaagagagatcggccg

SEQ ID NO: 153021 - DNA, 262 bp, Homo sapiens
ataaataacagtgaatggctacttgtagataccaagcgctttcttatacaccatgaaaatagaacctctccctccacgcagctcccctaccaaaccccgctacaacctctaacagctgctacccttgctggatccctaggggtctgggtgcaggaccccacttccagaacacactcttacctttttactctgctcagtgctggatgtcaggatcattagtaccccaaaccttagcatcacacaatatatacccagataacaa

SEQ ID NO: 153022 - DNA, 360 bp, Homo sapiens
attccagtctgggcaacagagtgagaccctgtctcaaaaaaaacaaaaaaacaaaaaaaacagtggccttgaaatctttatccaggtaaaaagcaatcgtaataataacgaaaaatgttctaatttgaaagtcaggcacaagtgcagtttgaaacctgattgttactaaatgaatttagtctatcctaaaagctatttctcatgtctacctgtgttatcagaagaaacaacagcattctagcatcctgatatcattctagcattgggatgaaacgttgccatcctaggagaagacatgggttcttatggataaacgacttagccttcagccagctttagcagtgtttgggagcagtgtac

SEQ ID NO: 153023 - DNA, 251 bp, Homo sapiens
ccctgggcttgtgcatggcatggctgtgtgtggggacaggcagatattctcacatgccaagggaagctgagaaggaagaggactttgggttgcattaatagaaatatatgtaccaaaatagagcagatgacccaaggttcttctgatctttgtggtggctggaccacaatgtcagaatttcagcttaggagggcttgcaaccaagtgtccaattttcctagaacttatctttaccttttttctttttccct

SEQ ID NO: 153024 - DNA, 880 bp, Homo sapiens
caatcatgctcatcctggactgatcctactggcacatggaaacttcctggctggggctgaagaagagaattaactctttcaggcaaagtggaaacatgaagttttatgagagagagaagaaacctttggtggtgcacagggatttgaattcaggtttgtctgcccacaaagcatgagtgcttaaccactaagttacattgttccgggacagacatacagaggttgattctgtgtccgcaattggtgggttcttggtctcactgacttcaagaatgaagccgcggaccctcgcagtgagtgttacagttcttaaaggcggggtgtccggagtctgttccttctgacgttcggatgtgttcggagtttcttcctcctggtgggtttgtggtctcgctggatcaggagtgaagctgcagaccttcgcgactctccacagcaccggacaattgcgcagtgttgaagtctcatgctggtctgtaaagccaggccagaagaggaactgggaataattaggatgggagattacatccaacttacagtttgtggattctacccctgaattctatccacaaaaccctcaagattcaagaacccttgatgctgtcatatggccccaggagtcatcagatataagcaccctaagaagctgtccaggggtagcagggagactctgtcttcagtgaaggaggacacttaaggctgaagtggccccaagaaccaccctcatcatctgtcaagcccagatataaccattctgtatcctcagacctcaaagccttaaagactctgtctaccacgtacaccacccacttcagctaaacctttcacacttgcacagtccacgccagcatctcagcatcctgagggtgagttcttcctg

SEQ ID NO: 153025 - DNA, 641 bp, Homo sapiens
tagggggaaaagcggacgtctagtgggtgacttattgatggacccaggaatgcaaaggtctctatgattttagctgagtcttcctagggaccatccagcttcctggtgaggtatatgacatgggggtcttagctcttggaagagctttagagactctagaaagaaggaaggacaaaggcttctgtctttctgaatgcagactctccacagcaccggacaattgcgcagtgttgaagtctcatgctggtctgtaaagccaggccagaagaggaactgggaataattaggatgggagattacatccaacttacaggtaggtcatcccagaggccagaaaaagacaaaagagtttgagggatctttggacctgatattaagaaactctaagaacagctaatcctgagcttctgatatatgccaggcactgcactgggctctttaacatacattatatcatttaattatttgtttcctggacaaatattaagcacccactatgtgccatccttcttcaaaacaattcagccagattacttatacagagaagaaaactgaagtgatgtgaagtatcatataatttccccacggttatatgtcctctagtggctcagctgaaattcagattctggctggcattctca

SEQ ID NO: 153026 - DNA, 324 bp, Homo sapiens
agtgtcatcccccttcgtatgaccccaagtacgaaaattaaccccctaataaaattaattaaccactgtctcatcaccaaccccaaccccttctgcttggtcatgacctttccttcatctgagagggttattttaaactttaggtaaggccatgtgaggtggctcacatgtgtaatcccagtactttaggtggccaaggcaggagcattgcttgagtgcaggaggtcaagactagcctgtccaacatggcgaaacctctactaaaaattcaaaaaattagtcaagcatggtggcacacacctgtattcccagctacttgggagg

SEQ ID NO: 153027 - DNA, 226 bp, Homo sapiens
agagataaagaatttgaggaccaaagtggttaagcaatttgattaatggcttatagatgaagaaggactacaaatttctttgattcagcttagagctctttccaccacactttacctttcttccaaggatacctttaggacagaacaaaatttgattttgtactccatatttttgtccacatttgctacaaaacgattatctagaaactcatcaactgtagccagc

SEQ ID NO: 153028 - DNA, 330 bp, Homo sapiens
accacagaatgaagagaaacagaatgaaggagaactcctccagggcgaacttgttggcttctacctgaactgtagagtttctgtgagtccagggaaatacacatttcttactacacttcaatttatctacttgcaacatggaaataaagtataacactttctccaacaaaacccatacctgctcccaaacagaccgcacacattcacatcaggactaaccagaatgaggatgacccgcatcccatcagccttcatgcgattgatcagagctggaaacccggcaaacttggggctgagggtgaagtccagctgccgctccatgtagtcgat

SEQ ID NO: 153029 - DNA, 453 bp, Homo sapiens
tggacactgttttaggtactgaacaaactgtagatagaacaaacaaggtccatctctcatggagcttacattctagtgggacagggaagagacaaaaaataagcaagtaaataaggtcatttcgaacgataagtgcaatgaaggaaaataggataatgttttcccagcaccatttattgagtagggaagcctttccccattctttgttttcatcaggtttgtcgaagatcagatagttgtaggtgtgcggtcttatttctgtattctctattctgttctattggtctgtgtgtctctttttgtaccagtaccatgctgtttggtaactgtagcactgtagcatagtttgaagtcgggtagcatgatgcctccagctttgttctttttgcttaggatttgcctaaattaatcatagtgggaagatttataggtagaggcgacaaacctaccgat

SEQ ID NO: 153030 - DNA, 293 bp, Homo sapiens
aacgggtgatgcggttggggaaggttcttggaggaggtgatacaaaggccacatcttaaaggaaaaggagcttactctggggttggaagagggatgtgagcactgaaaggtcaggtgtggctcgagggtggtgagcatggcagggggaaagcaactagaagtgaaggtagtgagccagaccacgggcctggtggacggtggttggcctctattcagagggcactgggaggataggacgacaaaggatactctatgcgaggaaggtaccctggcttatagttggaaacagcgtt

SEQ ID NO: 153031 - DNA, 446 bp, Homo sapiens
gaggtagaatgatcacttgaaccccggagttcaaggctgcagtgagctgtgataacatcactgcactccaggctggatgacagagtgacactctgcctctacaaaattaaaaataaaaaaagcaaaaatgatttgagagaaacaaaaactaagaaaattaatcaccagcataacaacatagtgagaattaccaaaaggatttcttcatgtaacaggaaaatgatcccagatagaaacgcagagaagtcagaaggaatgaaaagttttctaagaaaaaaaaaaaaggaggtaaacatgtaaataattttaaataaatataggctgcataaagctgtaatgataatgtccaagactgtttttatacatttagaagtaaaatacatttcaatataacacaaaagaaaagaaggagtgttttggttagcatccataagctatgctacagt

SEQ ID NO: 153032 - DNA, 222 bp, Homo sapiens
ttggggcagagtactcaatgagaagggataggaagttagagtcacattaaggaagaggcttataacttaagatttcagacttcagtaattccctagttgtcaaactagtaataagacaacattacttaaagcactaataaagaaagaaacatactgggcatttttttttttttaaatctagaaactcagatgtgcaaaggaaagtaagaatagccgttattg

SEQ ID NO: 153033 - DNA, 324 bp, Homo sapiens
ttagcatataagcgtatgaagtcagggtcagatgctgcagtattgaagatgagtgtgcaccgtgaggaaggatttcaagcacacgctgcaggatcagggagaagcagagaggctgccggagaggccggggagaaactggctggccgaattctggaatggaactcacaagtcaggtattataattttctccaataacacgtagcagccttagataagaagggggcctggaagacactgggggaggtgggggtaagagcctaacacagccggcacctcaagacagcccatgctcaccagctcactcagtgagcccactccaccacc

SEQ ID NO: 153034 - DNA, 450 bp, Homo sapiens
ccaggggataacaggaccctgctcctcttgctaaagccagtttgggagcacccccacccaggcaccccacgccagccaggctcgcctctgaccagatggctgaaggagcaggtagagcaggaagtgggagccagtgacccaggttcccctggtggccaggcttggtggcccatgtccatggagtcccccacccgccaacgacctccggccatgcctcctgggtaccaggccacccatgggcgggggtgggggtaactcccagctgactcgctgcccagctggcaccaatgaggtctccacctcagccctgggctgagtgtctagtgctgactccttcctacaggcaggtgagcttgggaggcaggggccctgtggacttgggaagcgggctcagggtctggaggccagaggtcttgtccccaggcccagcatcccatcagcaagagccca

SEQ ID NO: 153035 - DNA, 380 bp, Homo sapiens
attcatgattcatgtctgagagccaagagctacaaataaatggtcataagctttctttactatttccagggactgacctgcttttaaggcagtttttagcagcaaatacatcagctgagtagaatggcaatagaaaaatgactgcatctaggccagtctacttctggcagtactgaagagagcctttaaaaaattgatacatttagcagcactcaaagttttaaatttaattttctcttttgcatttgggaggaagaagattaccatattatcatgattattaagtcagattcagaaagaagtatgcattttcaagaaaaaagcaaaagtgtagcaagtttattgaatgactttagttctcttaaaacagctcttcttgc

SEQ ID NO: 153036 - DNA, 217 bp, Homo sapiens
cccagcggatggaacctatgagttatttgctgaagaaaaaagggatcacagaaataaataatggtttaatgagaagatgaatgtgaggaatgctggtttatatcatgtgatacctccttttccctctttctgcacatctgattattccctcctttaccaagggtgagctagatagttggcaatttatgctttagtttctttgtgctgtgtgtatgtg

SEQ ID NO: 153037 - DNA, 684 bp, Homo sapiens
cctctaatcatgtagttggtttttctggtgaccagctcccatcctgctagcatgctctgttgccccctcctccccacgtgagtcacctcattaggatgaactctgtggttgaaagggactcattattcataataaaagacactcctatcatataggaaattccaagggattctgatgctctgtgccagaagctggggacaaagaccagatgtattctatgttatatcattccctcctttatattatttgaaattttaacattttattttttaccaaaaacaaattgaacacagtaattttagcatatgtttatattttaactgcctcagtagcgacctgttattcccagttctccggttgctgttaagaaaatctttgaatgctagttccagaatctccaggaggtgggaccagtttcgttagtggtgatgtcgaaaataacagcagtaccactgtgcttgggccaggtgaaatcaaatcagatgattcagtctggttgatgtgctagaggcccttttcccattcatgtaaaattggaaaattttgttcactatccaagtgtttccaaatatttggttattgtgtcaatgtagattcatacatattaagtatgtatcttgggtataaatttaagttataatttaatataaattgtgtggcacaaaagtagttcaaaggaggaag

SEQ ID NO: 153038 - DNA, 422 bp, Homo sapiens
cacaacctcaagaagaagaaaatgcaaaccaagcacccattcacggcaacagatgggtagcatcctggagctgtgccatggcaggtgagccacaggtgcccctgacaacttcttttaaaatggcaagaacctagtatatccattatgtagcataagaatataaggatctctgtacttctccacccactatgctatggtagtttcaccgcaattgtccagctttgcctctcttattactgagatgtcttctccataatgtcccagcttgcaggtggacactcagctcgcactgatgcatcccagccacagggtttccatctgccctggtccctgtgcatggccaagccacagagtgtagctccacctcctagagctccacatcctaggaactgaggcaagggacaccacaaacttggagaata

SEQ ID NO: 153039 - DNA, 441 bp, Homo sapiens
cctttatcattaaccaaaggacctaagtgtttctcgggagttctgtgagccactgaggcaatgtaatcaagccgaggtaagggtgacgggaacctggatttacagccgaccggtcactcagaagcacaggtcacaacgtgaggcctctaactggcatggaaagtgggggagtcttggggactgagcccttaccccgtgggatctgagcctgtgtcgaggtagacatgctggaagtgagttgaatcggggctgcccagtaggtttgtttacaccagcattaccacaaacacataatgcgttgtgttatgtacagtagctacaatgtcaccaggcaacaagaaatttcccagctcccttattgccttctgggaccctcggcatacgtgtggccctcattgactgaacattgaatgcacacatgactgattttggaactctcct

SEQ ID NO: 153040 - DNA, 166 bp, Homo sapiens
caactcgtgttcacaccaaggagcactggcccaggcacggagcgtgaccacaggggcggcgtgctgatcctggctcaggcagcgcatctgccacacggaagggcgcaccgtacccagtctggttgaggtgggcacccagcctcactcaacagggcattcaatgtaa

SEQ ID NO: 153041 - DNA, 555 bp, Homo sapiens
agttcgacggagactctcagaagagcgtagcagggaagagctctggtcagatggcaggacgggccagtgcaatgattgcgagggccccaacaatcaagaccaggaggttctgctgtgtggtgagcacattgtcagcctgaacggggagtgggacagaggtgtatgggggtacagggtagatgagtgtcccctccctgcagcagggctctgtttgtcctaccattgaacaactcggtgggttttccccactctgatcagcccaggactctgcttgctagctgggttgcaaaagctcctggacccttttcttctcaaaccaattatctcttcctgggctttgcgtttgctctagggctcttctcattcttggatgctctagctgtgctctgtccctggaggcttcccgagactcatgagtatcagctcctgacatgattctccttcactgtcttttttattagggtttcatgcagactctcatgcacctgccgtcggaagatctgaactttcttctaggacacctaatatccacagtactccaggtgggtcctaagg

SEQ ID NO: 153042 - DNA, 410 bp, Homo sapiens
agagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatccctggcattgccatttactagagctgtgtgaccttagacaattccacttaacctctctgagcctcagtattcttacctgttaacaagtggggatatgggttcccagggatgagggaccggtgaaatgat

SEQ ID NO: 153043 - DNA, 678 bp, Homo sapiens
attaggtacttccattggagtactcccctttcaaatttagcctatcagatatatcacagaagcgcattctctgtaagttgacttcttttcttaatggtagtacagctgtggctctacaggcacccaaatcggaatctgccacctgtgagttttccttttatgtttctctctctgtccccctccaccaaatgcacaaagacaggcacataggctctcttataattactttttgagttagagtctcactcttttgcccaggctggattgcagtgacatgattatggctcactgcagactcagccttttgggctcaagtgatccctccagctcagccacttgagtagctgaggctacaggtgtatgccgccacatttggctaatttttttttctattttttgtagagatggggtctcactttgttgctcaggctgttcatgaactcctggcctcaagcaatactcctgccttccaaagtgctgggattacggtcatgagccactgcgcttagccctcagttttgaactgttagttcttctgttcattgctattgtgtctcaatcctaggcttttttattgcctctgtaaatatttgaatttagttttctcttgacttctattgagttccatctcgtgtgtcccagtgaatggcagaattgtctggctctctgttgttcctg

SEQ ID NO: 153044 - DNA, 722 bp, Homo sapiens
gcggctcaccctccacggcgtggttcacctcttggatgaacagctgcagcttcatcaccagggtggctgcgtggccatccgccttcccggacgccgcctccttggagccggccctgaaggccgcattgatccactccttcacgtcgaagtcgtctgccaggaacttggagaagtccatggcggaactgcctcaggcctggcgtccagaacttaagagttggctccgggcggcaacggggatgcagaagcgagcgagcctgcgagagcaccgaggctagcctccgaggcgaaccccagaaacgccaggacgggtaacttgcccctttgcgcttccccgctcagcgcactcagtttgcggctgggaatgaccctcgccgcccgccgttcttcttccggaagtcgttggccgttaccatagtgactgcaggcgtccggagcgctgagcagaggtgcagtggctcatgcctgcaatcccagcactttgggaggccgaggcaggaggatcacaaggtcaggagttccatacaagactagcctgcccaacatggtgaaaccccgtctctactgaaaatacaaaaacagcctggcgtggttgtgtgcacctgtaatcccagctactcaggaggcagaggcaggagaatcgcttgaacctaggaggcagaggttgcagtgaaccgagatccgccactgcactccagcctgggcaacagaccgagactcca

SEQ ID NO: 153045 - DNA, 478 bp, Homo sapiens
gtctccatatcaaacataattagtagatttcagatgaacttgaggaactattagaacaacttacctaaagcagttttgtttctcagaaaaatgacgttatagatctggcctagaatttggcatagaaacttttcctacaaggtataatgagaaacagaatcaaagcaagagtcttaagactcagtcttagttctagtttggtctttgtgatcctggccaagtcacttcaacatgaacttggttttctatgtctacaaagtaaaagggttgggctactatcgctgctgtactactactactgatctatttgtgctggattattctatatccagataaatgaggccaagtgtttctggcatcaccaaccaccatttaaacaaatagcatcccctccataggggaggaggctgcacacatctgctgctctccaccctgagaatgtggatgaattccaatcagcagccaccacctgactgat

SEQ ID NO: 153046 - DNA, 376 bp, Homo sapiens
tgctcagccaggagaccgaaacaactccggtgtcaagaatgaacacggaacaaaaatactgccccaaacaattcaacacttccctgagaaaccagcttcctttctcctccccggggcttgtggagggcttttcctgcacctcgtgagcaggcctgctggcatcgtgacttttcaaaataaaaggaatttcccgtcatcttattttctgataatttgaaatatctctcaaagcacaaagagtaaaaatttgctttttaaaaataacaaacatacaatgtgataatagtcaatttcaaatcttccaaacaccatagtaccacttgaacaagagaaacatcaaggttacatcttaaccccaaagtccattgagaaaacc

SEQ ID NO: 153047 - DNA, 341 bp, Homo sapiens
ggctggggacccccgcccagctgggtcagagtgcccggctccttgcccacctcagaggctgctgcaggtgtctggggcccacaccggcctctctgtgacttttagatctccaggactctccaccatttacccctactgtccatgttagcccctgaccatccacgttagcccctgaccatccatgtagcccctgaccatccatgttagcccctgaccatccacgtagcccctgaccatccacgtagcccctgaccatccacgtagcccctgaccatccatgttagcccctgaccatccatgttagcccctgaccatccacgtagctcctgaccatccatgtt

SEQ ID NO: 153048 - DNA, 848 bp, Homo sapiens
  misc_feature (700)..(700): n is a, c, g, or t
  misc_feature (710)..(710): n is a, c, g, or t
  misc_feature (715)..(715): n is a, c, g, or t
  misc_feature (719)..(719): n is a, c, g, or t
  misc_feature (729)..(729): n is a, c, g, or t
  misc_feature (732)..(732): n is a, c, g, or t
  misc_feature (745)..(745): n is a, c, g, or t
  misc_feature (748)..(748): n is a, c, g, or t
  misc_feature (758)..(758): n is a, c, g, or t
  misc_feature (764)..(764): n is a, c, g, or t
  misc_feature (774)..(774): n is a, c, g, or t
  misc_feature (778)..(778): n is a, c, g, or t
  misc_feature (787)..(787): n is a, c, g, or t
  misc_feature (790)..(790): n is a, c, g, or t
  misc_feature (797)..(798): n is a, c, g, or t
  misc_feature (801)..(801): n is a, c, g, or t
  misc_feature (806)..(806): n is a, c, g, or t
aggccgatcgggctttattgtggttttaatttgcatttccctgctaattagagatgttgagcatttatttcatataacaaaagcaaaaatagacaaatgggattgtatttaactaaaaatcttctgcaaagcaaaggaaacaacagagggaagggaaaacccacagattgggagaaaatatttgcaaagcagatatctgataaagggctaatatccaaacatataaggaactcaaacaactcaatagcaagaaaacaaatatgcacattaaaaaatagacaaaagatctaaacagacatttctcaaaagaagacataatagccatcagatcacactttaaataccaagagcctatccttttcttgtatttggaaccaactggatccaaagaatatggggcagaaatatttttataccccatccttactagtgcaaatacatattttggaaattgtacctcattataatatgtaccatatcctttgaaggtttatctctccagctttctgaatgctgcacccatggcatttgctcttcatgtttttcaaggtacctgccctttgtttgctttttgttgttgttgttgttaagatagaatcttgctctgttgcacaggctggagaacagtggtgtgaactgcaacctctgcctcccaggttcaggtgattcttctgcctcagcctccaagtagctgaggacnagattgctgnaactnggangcggagatgnganctgagatccgccntgnactccattgngtaacnaacaaggccntgancgtggtatnaanaaatcanngancttantccaaactgttggtcaaaaccctactgggtaagcaattactg

SEQ ID NO: 153049 - DNA, 427 bp, Homo sapiens
caaacaatgttacttgcagcctttaatgtcacagcccctaaaaacattgaaatgtacatttttcacctgctagtcatcttcagtattctggagaggaaatattctttcctgtccttacagtggttgtatatcttaaaagacgactatatgacacttgaatattgatattcaaccttaaccaaagcagtcacaagaatacaagccattcgctctggccttttagatatgttcccaacaagttcatgtgtacccaatgaaaaatgttaaataaactgataaactttaaacatttaaaaatattttatttatttacttgccacagctagataagaggaactgggttaattttgaaactctcagtttcctttcctctaaaccagtagctattgctggccactagtatgttgtttcctttgcaggaagttgc

SEQ ID NO: 153050 - DNA, 254 bp, Homo sapiens
atgtctctagatatcacaagtgtcctccgggggcaaaatcgtcgaggtctaataccatcattttagagataaggaaactgaggcctagagagtggaggtgacttgctcaaggccatatggcaagtgaggaccagacaggactgagcccagggctctggtgaaaggatccccaggcctctctgccctgctgctctctcctcacaccctcctcctccatcttccctggatttccaccaaatcagcctgccttctag

SEQ ID NO: 153051 - DNA, 617 bp, Homo sapiens
attatattttaatttaaaaaaaacctttcagtgacatgtcacagagccctgccctttggtgtctgagcacagaagagaatcacagactctgcactcagatataatactcttgtatgccaactacagggcattcatgactcttcaaggagacccactgctttgctggacagcaccagctgagaacagtgctctctcttacagagtgctcaaaactattttttcagagctaattgaaatttgcaatcaaagcagagatacattctgactaatcaacacatgcatgacttagaatcacaggagtaggtggcagaagtttagcacaataaactcttctttatcttgatccaaatcagaagtgaattattttcacagtgctacacaataactggttctcataatgagaacctagtgacaatgttaaggtctcagagaactttacaaatcaaagaaggaatgactttagtgccaagtatgttatagtccagtttgtaacggagcttctttttaataggggggtccctgcttaaaggtcaaagctcattatcaggaactagagatacaaagatgtaaaatcaagtgctggatctcaaaaagctaacatacattacaaatgttaa

SEQ ID NO: 153052 - DNA, 181 bp, Homo sapiens
acaagccgtctccctccagtgaggatgaatcctctgggtcctcaagggcagaaccaggaggaatccatggagcacttctcataagacagcttaacacttttttcagttttacttttgaaattttttaacccccatttttttatttggaaaaattttaaacctacagacaaattgaaagagt

SEQ ID NO: 153053 - DNA, 315 bp, Homo sapiens
cctggttactggtctaggccagtaactgcctgcaagcctacatcaatcaggtgcctgacagtgttcatggaataaactttgacctaattttttcttcctcaaacaagcttaaaagaagccaactaccaaaaagaaggaacctttttggaagaaaaaaaaaaatgtgtcccgtggcagttggctgtggggtggtcattcagcctattgctccgggcaaggttcgagctggcctgttttgaggtctctaacacagtagccacatgggcatcctacccacacatgggcagagcaggtccctgggataggctttccctg

SEQ ID NO: 153054 - DNA, 161 bp, Homo sapiens
  misc_feature (18)..(18): n is a, c, g, or t
catcagctcggtaccagnttcgacggagactctcttcctgatgtcacaaagaccctttgcagactgacatcatgttgcagggaaaactgtataacacagtactggggtagagggataggcgaatgggaatgtagtttattatctttgcagcaattattgat

SEQ ID NO: 153055 - DNA, 228 bp, Homo sapiens
tagtctagaggatctcgaaaactgatagaggcagggcttctgagaaggactctacccttctccctgcagtgggattaattgctgccttggcttcccacgagttctagaaaatgaggcagacagtgtcgggagaggggagtggtggttgtggctcgctgccccggagcctcatttcccatttctcccgagacaggtttgaatggctcttctaaggcagcctgaaccctg

SEQ ID NO: 153056 - DNA, 382 bp, Homo sapiens
gtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaag

SEQ ID NO: 153057 - DNA, 319 bp, Homo sapiens
tgcagtgcaagggaggacagggaaaaacggggacatgacagcccaaggtggtagtgacagcatctcagtgggaaagttgtctgaaaataaattgcccactgtagtaatagccactttcagttgtgtggcaggcactgtgctgcctgcagtacatcccgtttaatcctcacaacaaccctctaagaatcagtactcccagttttcacatgaggaagctgaggtttaaagagagcacctggcccacgaccagcaagtaaggaatagaggtgggatgtgggtaatttaaacctaaatctctgacgcactcttaacgcacatt

SEQ ID NO: 153058 - DNA, 269 bp, Homo sapiens
gttttaccatggtctcgatttcctgacctcgtgatccgcccacctcggcctcccaaagtgctgggattacaggcgtgagccaccgcgcctggcccaagaaatttttttttaattagctcagcatggtggctttcacctgcagtcccagctactcaggaccctgctctattgtctcagaaaaaaaaaaagttctaagagaattttaaatgatgtgttttttcttctcagaattttttagtaataagcagaagtctcccagttagccgttc

SEQ ID NO: 153059 - DNA, 564 bp, Homo sapiens
tctcctctttaccttcgaaggtccaaatctttccatcctctttccagacataactcaaatgccataatgccttctcaattaaaaacaatctctctcttcccagaatacctgcatgttatttatatgtcttctatagcaccaatccctttcaactttatattttggttatgaactctgcaggttccctgttgaaagatccatgccagttcttatacttactacatactcaaataaatatatgttgaaggccaggcatgatgattcatgcctgtaatcctggcctattcggaggccaaggtgggtggatcacttgagcacaggagttcaagaccagactggacaacatggtgaaactccatctctacaaaaaatataaaaattagccgggcgtggtggtgcacacctgtagtcccagctacttgtagggctgaggcaggaggactgcttgagccagggaggttgaggctgcagtgagctgagatcatgccactgcataccagcctgggtgacagagtgagaccctgtctcaaaataaaaatttaaatttaaatttaaaactgtatg

SEQ ID NO: 153060 - DNA, 764 bp, Homo sapiens
tcttaccagggctgtaaatataatttgtgagccaaacctatattcaaattctgatttcacaatctctagttgtgtatctatgaaccaattacttaatctctttaatccatagttatctcatgtcaaaaagggataataaaattacctcttcacagtgttacagtgaggattaagtgagaaaatgcataatatatttggcacacagtaagcattaactatttaaaaagcattaaacattgactcattaatgccaactcttgttattatgattaccacacaagagacctcctagcagggcatcaagtcatcctcagtggcaaatgcaagaaggtaagtgaaagtaatgtgtggtattgaacagctcaatgactaagtcaaattaggcttcgacagcattgcttcaaaaagggaaaggacaagaatatctagtcaacctcaacagccatattaccattttaagtaatctctctctctggcattttgacccttttccccaatgaaataatatctatctagtaagctttttccaggaaactctggtagccaacatcttaaagaaatggagaaaaaaatgatacgaagaaaagaagccctgtctatggggactgttccagaatcttgcccaggattgttatttttgtccagaaatattctttttttttttaatttttgagatggaatttcactcttgttgcccagactgtagtgcaatggcacaatctcggttcactgcaacctctgcctcccgggtttaagcaattctc

SEQ ID NO: 153061 - DNA, 539 bp, Homo sapiens
tcctgctcactgtcaccatcatcctcttctctagagccggaatcccctaggagcatttccttgttttcctcctctggagaagaagagcccagagccaaggagcagagggctgcagagcatggctcagatttgataaacaggcaggagatttcagcagcaatcaggagaggaaatcacacacattatccccggaattcataatgcaccgctaatgagctggaggggctgggagtggatctccacccacctcttgcagcccaggatcatcagtgtttggagaaggatgcagggaggggcagtgccatagcctgatggtcctctcaggaagggaaggcatttattaggcctccaaatgtggcttggtcacaaaggacgtgaagatgaggggctgcagagacctccagggggcagtggagctgcggaggggtgcatgcaaggtgggggacccacagcgacctccctgttgaataacctttccctgagaaagtcctaacatctgggaaatttctaaatcacattatcattgaattagtatctat

SEQ ID NO: 153062 - DNA, 1197 bp, Homo sapiens
atcataacatacattttacttttttgtagttacttgcataattgtcctttgtctccacttgaatgtcagctttgtgagggtggggatgtctgtctattcatcgtgagtcctcacttcctagcagggtctcacaaaacaatcgatgaataaatgaagaggcgtctggctaagatggggaagcttcattgctcctgggtcctccctcttacaaccaacatagcagcaccctgagaataccagaataatcagaggaggactgtgaaaagtggaaagaagaatgcagactgcctaggaacctctggacttaaattatatgacagtgaagctccaagtaaaacttattcccctagccaaaggactgggaaaaggattgcctaacagaatagaacacaggctttttacttattaatacttgtaccctagacaggcactaatgaaaaacctgacccagagtcaatggagactgataagaagctgaacctcccgcgtcccttggaggtaataaggcaatgtgagtcagtgatttaatttccctgggaagatgccagtgaggccaagggagggggcactgacgttctaccctcctcatctgcaatgagccagtgtgagtcagcgctcttgctggggtggtgacagaaagatccagcaaggagctgaacatctccctccaccagcacctgtatgctatacctaaaaagggtgactaccagctaatagattagataggagccaaagtctaataaagcataaaatgtccaagacataatggaaaaatcactcatcatttcaagagctaaggcaatcacatcttgaatgggaaaatgcaataaacagatgccaacactgagatgagccagacattggaattatgtgacggggattttgaagcagccataatgatattgcttcagtgagcagttacaaacacttagggaatacgtaaaaagtaaaatatctcagcaaagaaataaaagatattaaaaagaaccaaagggaaattgtagaactgaaaaacacagtaacaacaaaaaaaaaaaatacttactggatgggcttaatagtagattggagacaacaaaagaaatgattagccaactcaaaaacaaatcagtggaaattacgaactctgaatgacagaaaaaaagagactgaaaaacatgaacagagcctcagggacctgtgagacaataagactcg

SEQ ID NO: 153063 - DNA, 479 bp, Homo sapiens
ctcatagtgtagaccaggagctgggcaaaggtggggcataactggtgcttgggggttgaggggaaaatcactgatccagtgttgaagatatggggtggtagaatgatctccagtcattgatgcctagggctaaaagttgtcatgggagttgggaggggcagacggaaattccactggccatatggtggtcttgtccttcaaaggaggacagctctcgcactaacaccacttctcctgactgggcatcttgagccccctccccgcattcccacaggtggggccttaggaagctgttgtggaattgtagcatttggatggataatggaaaggggtggatgttcctgagatttcgaggcaaataaaaacatgccagattgtttttgaagcatcaaatgcaaattgtcaacatgaacatatttctggacttaacagttgaatgtgtgaattaattatgggcctattaagatacagaatgatcc

SEQ ID NO: 153064 - DNA, 390 bp, Homo sapiens
aagacagaaactcagtttttcacataaaccttagacttaagtgctatctcttatcacagagaggcttctgttgtaatgtgggcattagtcatttttgataattcagaaaaatcattgctactatgagcgttgagatggatgaaatttttgctgtaattacctgaattgcatgcagccattgaaatcttccttaacttgaaatgaaaaagaactttagaaaaacatgttttatctgtctcaccagttaaatgctcttagtagagctcttctagtattttgtagattcttttggaatcgtgcctgtttcacagaggcagagacatgcaaaccttagaatgggagttgagctgtttgaagtctgccttcataaaaatgtcttattgcagcagt

SEQ ID NO: 153065 - DNA, 370 bp, Homo sapiens
agcactgccacctcttcctgcagacttgaacgtgaccgtggggaggactatttcagatcactaggcctccaggggctccatttttcccctcccaatcctgctcttgatcctgggcagcatgagtgactgtggcttttgcttaaaccaattcaccatcccaaatgaagaagggagtggtagttgagagtgccagctgacagccagactcctgggatccagtcctgccttcgtctgtctgggctgtatgaccctgcacaaaccatttagcttatctgtaaacgtgggataattacaataccttcctcttgagattattatgaggattaaacgagttgattattgtaaagagtttagattcaacccagacacg

SEQ ID NO: 153066 - DNA, 851 bp, Homo sapiens
gacctcaggtgattcgcctgcctcagcctcccaaagtgctgggattacaggtgtgagtcactgcacttagcctttttcatgtttctaattgctctttctcatgtgattctctggaatagagtttctcaacctccatacagttgacattttgggctggataattctttgttgttggaggctgccctttgtattataggatgtttagtaacatccatggtctttacccactagatgctggtagcacctcctgcacctcagttttcacaatggaaaatatcttcaggaattgccaaatgttagaggaggcacaactgcccacttctatagaagtagacgttacccaaagctttgacagtgcccataatttctgtcagggtatttatttcccactcttatcacatatcttttgtctgcccttctgagttccatttccctgtattagacctttggctgatgcattagtgtgggtgtcttgccagaccctgatttcaatatatctgcttacttccatccattctcaccccaaccctatgctgcctactgatttttctgtggtatttagtggcacccaggctgcaggttttgtggttgcctttgactcttcattggctcacccatgctagtgtttgccactcctgtccgtttttcaactgtgatttcttcctaatatgagtcattcctttcttttttccttgtcctacctaagttctcattacctcctgtcagaatagtcgcagaggcctattgtagttccttaccttcagtcttcctctaatttgtccaacaaaacactgtgaactcagtcttcctgaagctcttcttcccggaacccttacctctttccctgcctt

SEQ ID NO: 153067 - DNA, 329 bp, Homo sapiens
cgaaactcccacgatgcttatgatgaggagaggaaaacaaacccttcagcagttgttgcagctcaaagcaattgggaaaaagtggctccagagagcctgggcttccaagaaggcacacatgagctgtgctaaacactgcatgtgcactgatagaccacggccagctgaaccaggccatgaacatcctacaaaaagctgaaggtctttgccaccattcattatcagaagacactgatgagactgaggaagacccacaggcaggactggccatcacttatggtcagatggcctatattctgcagcttcagggtcaaacagaggaggctctg

SEQ ID NO: 153068 - DNA, 447 bp, Homo sapiens
acatttaaagacagatctgtggtgtatcagtagccacaatatttctgtgtagatgtagtggtaggagtagtggatttgcagataagggaaacagaagtgtccaatcagtaaacattcattgatcttacaattaatgtgatgcctaattaaaatggttgctaggcttttattaattacctagaaaatatttgaaatttttttcgtctttaatttctcttacatttcatttatattcctatttattttctgaggttggcttgaaaattttgacttgaatttccttaaatttttcttaaccaaaatctaaaagtaaacagctggcagttgctgtcttgggtgggtggtggtttctcttttatcagcagcagaatgttctaagccttctgccaggagtctgactgcaaaagtctttgggtggtaaagtgggcgagaatgtgactaatgcag

SEQ ID NO: 153069 - DNA, 830 bp, Homo sapiens
aaacactgaaggcagttttgttcttgcagtctgtcagattttctccttttcccagggtagggatcgaggttctgaataagccatttcattttataataaaaagcaaaactccctcacacatgctggttattctagaaaaatttatatatatatcactagggacttaactaagaatgtgattttttatctttttaagggagagtctcactctgttgctcaggttggagtgcaggcatgtgatcatagctcaccgaagcctcaacctcctgagctcaagtgatcctcttgccttaacctcccaagtagctaggaccacaggtgggcatgaccacacctggctaagttttaaaatttttctgtagagatagtgtctcactatgttggccagactggtctcagatgcctgggctcaagcagtcctcctgcctcaacctcccaaagtgctgtatgattgttttaaataggaaaaaatttagaattttataatatcaaggcacttaatttttagttagtgatataccatccaaaaggcatctgaggctgggcacgttggttcatgcctataatcccagcactttgggaggccaaggcaggaggatcgcttgatcccaggagttcaagaccagcctgggcaatgtaacaagatcccatctctaaaaaaataatgattaaaaaaatagagacaaaaggcatctgaaacataggaacctaattaaaacattatatgtatatacatattttcattaagcgtatgtgttaaaatatcatctagaccaatgttttaagggattgtttttctaaatatattaataaaactattaaaaggccaa

SEQ ID NO: 153070 - DNA, 887 bp, Homo sapiens
acatattagtgtaatgaaatttccactgaaactatccctgccaccaaaggaaatatgagaagtctctcaaatcttctttcaggagaaaaatttagcagagaaggtatattacaacatctcccttttgttaaaaatcaccagcaaaaagggacttcatatccctcagagaataggactcacaccacatataacagctgacagtactcacatctctgatttccagcagggaaataagccgggatgaagcctgaagaaccccaatctcaagaactgacgaggtagactttcaaggttacgttccatcaatcactggaaaacttctcctggagcctctgctcctcagctgttttcatgtgaaggattttcttagccctgttcagacagctttactgctgaaaggttggggaacacttccttttaaagactgtctttattaatgtgttttacttcccctgagagatctttagtcccttctggtagtaacctcgactgacatgcatggagatcagcaataactttttctgtgtttcaacattttaatatttcctcctcctcccactccagctctctgtacttttccataggaaatctggttgattgactttcatgagtatccagccagcttgatgcccgatattcttttggcaagaagtaatccttttcataggtaaagagttagttcaagccgctcatttggcttggaagagagaggtgttttgaggaatatctgaaccatatctacttggaagtagagacaaaaatctccaaagtgtctgataaatggtggtagaggtagcttgactatcactctaggtcaggattggtgcttaaaacagaaagccatttgaaaaactgatgaaaactatgggctctctccccaggatatt

SEQ ID NO: 153071 - DNA, 263 bp, Homo sapiens
actgagcatggtggaggctcacaggcgagaggtctttcccctgagcacggtggaggcgcaaggatgagaggtgtttccactgaggatggtggaggtgcaagaacgagaggtgtttcccctgagcacggtggaggctcacagatgagacgtgtttcccctgagcacggtggaggctcatagacgagaggtgtttcccctgagcacggtggaggctcaagaacgagaggtgtttcccctgagcatggtggaggctcaaggacgag

SEQ ID NO: 153072 - DNA, 420 bp, Homo sapiens
caagtcagttttgtagagaagaggctgggtctgttggaggcataagtcagagacaggagcatccggacggtcattggagataagccactggagctgggaggagagaccagagctgtgttgtcagccacccaggcaacccatttcccaggcctcctttctctcggaccttcctgctctctgcatatctttctgagaatttgaatcgttctcctttttcttaattatttttacccattccctccttgtccatcccaacagtaattatgattaggcaaatacacagcccaccccatcctcaaagacaactgtaatttgggccagtctcagcaaagctggagagaggagtcagcattggttgatctagaggcaggcttgtttctggccttccacgttgtagtggaggggaagggaaggagggac

SEQ ID NO: 153073 - DNA, 538 bp, Homo sapiens
tgctgttgtttttgctgttgctgttgttgcggtggttgttgtttacttgtaggagttctttatatattttgaattttatgcttttatcatatgcatggtatgcaaatattttctccagttatgtaggttgctttttactctctttgccatggagaagttcttaagtttgatgtagtcccttttgcctatttctctttttgttgcctgtgctattggtgtcatatgcagaagattattgccaataccaatatcagcaaggtttttctctattttttcttctaggaattttatagttttatgtagtacattttggcctttaattcatttttagttaatttttatgtttttaattaagtgtctaacttgactcttttccaggtgggcatctatttgttggaaagactatcctttccccattttatgacttggcatcattttcaaagatcatctgactacataagtgtgggtttatttctaggttctctattctgttccattagtctctatgcctgtctttatgtgagtaccataccttttt

SEQ ID NO: 153074 - DNA, 191 bp, Homo sapiens
accacccgagacagtgacagacaggtgacagcgagtgcctgcgtcccagatgcaaatcagtaagaaccacccgagacagtgacagacaggtgacagcgagtgcctgcgtcccaggtgcaaatcagtaagaaccacccgagacagtgacagacaggtgacagcgagtgcctgcgtcccgggtgcaaatcagt

SEQ ID NO: 153075 - DNA, 345 bp, Homo sapiens
acagctgatgttacacagaagtttttctgggggagacagaacacaagaagatgatggagcagaatgctgggtaggacgtccagagcgctcacagcacactgtgagtgagaagctagcctttgctaagagagatgccctggagcccaaggaaggagattccatagggcatggccttaattattcaagcaccaggaaaacctgaggagcagtggggaggtgtctcaatgttgccggtccctttatgatcaaaagccaaaagctttaaagtctatttcagatatcaaaatgcatccatttgggaaccgtttcctgggtgcttcccatccattctcgaattctgcaaac

SEQ ID NO: 153076 - DNA, 444 bp, Homo sapiens
ctttctccctaatcatgagttcaagatacaaacatttaggcaaataaatatcaacaaaaaatacatcaatgctactactaaatgctttataatccacaaattgctctgaatttatgctacccaaaataatatttatatatacattttcacaaccagggtgacaggtaaaattggtttagttaattgtttcaaaggaaggatgaaactggtggtaacagaaaaaagataaattatattcatgttatattattgtttacctaagatcaattgactaacaaggaaaaaatgagagagaaaacaagcttccttgtgtgtaagcatttttatgagcatgtgagcattttcgtgagtatgtgtgcgggtccacgggttcgtgcagtgagtaagaggtggaaggtatgtctgtggctgtgtagagcaagaaagagagtgagaaggagatca

SEQ ID NO: 153077 - DNA, 923 bp, Homo sapiens
tacttcaaagctgaagggtttttcttgggagcagaagcagaggtgaccagagtcctaaatcatcaagacaggatggaggtgggtccagccctatggggcttagcaggtgttctccccgtgtgtggagacgagagattgttataaataaagacacaagacaaagagataaagagaaaagagctgggcctggaggactactaccatcaagatgcggaagactggtagtggtcccgaatggatgggctcactgatatttattgcatacaagacaaggggacagggtaaggagggtgaatcttctaaatgactgacaaggtgaagcaagtcacgtgattacaggacaggaggcccttcccttttaggtagccgaagcagagagagaaggcagcatacatcagcgttctcttctctgcacttataagaaagaccaaagactttaagactttcactatttcttctaccactatctactgtgaacttcaaagagggaccagaagtacgggcggagcatgaaagaggacaaggagggtgaccactgaagcacagcaccacagggaggggtttaggcctccggatgactgcgggcaggcctggataatatccagccttccacaagaagctggtggagcagagtgttccctgactcctccaaggaaaggagactccctttcgcggtctgctaagtaacgggtgccgtcccagacactggcgttaccccttgaccaaggagccctcaagtggcccttatgtgggcgtgacagagggctcacctcttgccttctgggtcacttctcacaatgtcccttcagcacctgaccctatacccgccggttattcctaggttatgttagtaatgcaacaaagagtaatattaaaagctaatgattaataatgtttataataatgattgataattgtccatg

SEQ ID NO: 153078 - DNA, 101 bp, Homo sapiens
tcctgagccgtgttttggtttttcatcgtgttgacctgtgaatggagcatttggttttgtttttcacattctattgggtgctggaaagttttaagtcagat

SEQ ID NO: 153079 - DNA, 375 bp, Homo sapiens
atcctaagtcgaaccatcattaagtcagggactatctgtatacactttcagtgctaaaaactacaccaaagaaaaaacaagtgtcaaagttctccatgtaaaacagtgatccagggatatgggtgagaaaacccatctaaaatgcaatgtgatatttaggataaagctgaaacacaccacagcgcctcagcaattgaggctgtgaatacaaccacacaatcagcaaagaaaagcttgttctattcttcatctacaccactcacacacaacaccaaaggtgttctcagcacacctccatccacctcagatctattcttcatctacaccactgacacacaacaccaaaggtgttctcaacacaactccgtccccctc

SEQ ID NO: 153080 - DNA, 412 bp, Homo sapiens
gttgagactggttgcaaaactgcaaaatccaattttgtgtactggattcaatttcttcattagctgacactaaacacagagacggggcccttgtgactagatgaaccataaactggctccaggaccaccaacctggtacctgatggcttgtttctgctccccactctttccctccatgcatctttctctgagcttctgctcaaggcaggtgccaggacaagccagcgtctcgagcggttccccttcagcggtgagaagtaacgtcacaattaaggggcaagaggggccagaggacagaacagtgccagttcctcatccagattgaaatttgcttccagctgcctgtccccacaccagaaagggcactccctgctccccatgcaggcttctcatcctcttttgctggcctcct

SEQ ID NO: 153081 - DNA, 367 bp, Homo sapiens
aggggatagggagggatgaaaagaaaagggagcttaaccaaccacatttctgtttctgcacccgacgtagcaaggactcaacaaatgtttggtgaatgaacgtgtgtcacctgctcttctcatttattgtaagaaactggtactcagatatccaaccatcagcatcactcaaacatcctgcagatcattcaccaaatatttactgactacccgctctgtgtagtagcaaactcccagctattcacaaaggaccacaggggagaagttaaacaatagacgttttccaagagtggtgattcaagaaaactaaagcaggggatgtgatggagagtgatggaggagtatggcttctctgggtgggcgcagc

SEQ ID NO: 153082 - DNA, 391 bp, Homo sapiens
accgacaccttctacatgttaatgatattataatgagacaagtcacatgaaaatgaagaaaacagtaataggagatggaacaacatggcataaataacttctcctgtgatgagggtctgcaagggagtttgggaaagctttgtgcaatgaacaaagtaggaattccctgggggatgggccatggttgcaagtgtgagtgctaagcaatgaaccctagaaaacaacagcacctctagaaagatgggcacgctgtctgaacgcgcatcctgctctccccacaatcacaggaattactgcattttaagcttctgattgaggattgttacacaaaaagactgaataatcaagaatctcctactatttgaggaaaattaacaatataaaaaaggga

SEQ ID NO: 153083 - DNA, 575 bp, Homo sapiens
ttatctttatatacttctatactatttaatttatattcagcttatccctacaatttaaaaaaagcacttgaaacatttgaaaactgacagaaacaaaaggaaaatgtgtttagtatatctgcacacacacagaaacatggaacacagactctgagcaagtctctcccttccctacctcattttcctcatccagttggcctagctacatggtcagggattactccatgtgctggtcatcatctctaattacattaaacattgcaataatgattgctgtcttttaatgacagcctgctatgttaagcagtatgcttgaaaaatgacagcctgctatgttaagcagtatgcttgaaaaataacagactctgggtaaaagtgttctgaaccaactgcaaaacagactcaagagtcagggaggattgccctgtcagctggaccaagaatgagtcaagactgccatttgtgttgaggcttagtattgcttctccccaggtttagacagaaggtagaagcaaatgtccgttcctgctgggatactctggctcctggagtccacaataatctcaaaactatct

SEQ ID NO: 153084 - DNA, 288 bp, Homo sapiens
ctggtcacctccctagggccaagtggccaagaactgcttccttcttccagctggggtggacactaagtcacagggctggaatcttgccttacgtcccgtgggcagggtgacagctggagagagacaaggcctgaggttggaagcacctactgctcagtattagccagaccacagcgggagtccctgccccagatcaggctctgccggaggctgcagggccgtgcgttccctgagcaggaccccagaagtcagtccagtccatgaggattagacccagagcctcaaatg

SEQ ID NO: 153085 - DNA, 365 bp, Homo sapiens
actaaggtctgcaaaccatttacaaagacagggccaattaaaagagcctgcaaatatgtcagtgccgcacttctcaaaatgtgttctttaacatctgccagatctctacttgttacaaacactctcacatgacaataattatacttttatttctaatatgaattgaatactaatagaaaataaggtggtaggccgggcgtggtggctcacgcctgtaatcccagcactttgggaggccgaggcaggcggatcacaaggttaggagatcgagaccatcctggctaacatggtgaaaccctgtctctactaaaaatgcaaaaaattagccgggtgtggtggcaggcgcctttagtcccatctactcc

SEQ ID NO: 153086 - DNA, 219 bp, Homo sapiens
tgttgaccaagatcacttacaaccccaccatctaccctccttaacctctacttctacctacgcctattttacaccaaccccgtgatcgtggggttttagaacccaatgatcactggatatacacttggagagaggaagcactgatgcccagaagtgggttccaaatgaggacccagtggtctctccttggccacagagcaggagtgtggtctcaagatg

SEQ ID NO: 153087 - DNA, 550 bp, Homo sapiens
aaaaagtctaagagtatttcaacttcatatgatgatgtcatacttaaagagtattaaatcacataacattttacaaacaggtttcatagatctttggttttgtatgaggtatttgctgaatttcattttgcaagtttcttccactacattgctgtatgaatatcttaatatttgtcaaatttatgtttcccttttttccatctctttttcagacaagaagcagtactgacatactttcttcctgttccccttaaatgaaattcaatttatgtatgggaggatcccatataaaaaactatggcatagaaatagtcaataactatagataaaaacctctcctgctactgtatcgtataacaaaattaaattgcaatgctgccaatctagttccttattaccttgaaaaagcttgggggaaaaaaagtatggcctactgtattattaaacttgtctcggctataaaaactgaacttgccaaaagacatgacattaataatacaatcttgaacaattataaaaaagttacagctccttgcagataaattctctt

SEQ ID NO: 153088 - DNA, 403 bp, Homo sapiens
tacgccggtcgcaagtccagttaggtatatagtttaagtagatgtcaatctaaacaaaaacattttagaatcagcctttaatgttgtcttagtaatttcagagcattcagccattgctttaccaccttagcatacttaacagtagaaagataaacttttattctcaattccacgtggtaatctttgtttccttttataaattacttataaaagtttaaaatggagaaatgtagtcagatatggaaaaaaatcataatatattgtaaatgaagttacaaatagaacacagacgtgagggacggggtgagaaaccaagagggctacaacatcagaccaatgaatcagttacctatatgaggatactggtgatttttagctgtattttctccaaaggggacaataa

SEQ ID NO: 153089 - DNA, 420 bp, Homo sapiens
cagaaaggtaattggtttgaggagggctgcatttggcacttggctttcctacccccagtctccctcttggtcagattgaccaggaatcacaatggggccatctgaaaaatatgtcctagagatacttgagtggaatatttaagagtggaatatgtaagctttttagacttagtaagtagatttactaaattcatatttatttatatgaagacataatgtcttcagtttcttttttaaaaaacagctgtattgagataaaatttacgtaccatagaattcacccatttaaggtgtgtgattcaatggtctttagtgtattcacaaataagtgcaattattgccagttaatctgagatcatttcatcacttcaaagggaaacgttatctgctcccccatagccccaaacagccatttatcta

SEQ ID NO: 153090 - DNA, 267 bp, Homo sapiens
agcggatgttgggggagggggggaggggggtttgctgcacgctctttattatccccgctcaggttcactgtgctggggaaagtgaatgactcctgactgtgttcgccctggtgatctttccctttttgggtcagatggttctcttcagtttaatgatcttccatctgctgaccagcctgctaagctctgaagaagaaatttcaactaacatcagaccaattctcatctgccactctcccccagtgcagcagggcctgcaatgacatg

SEQ ID NO: 153091 - DNA, 399 bp, Homo sapiens
atggaaatataatgagtaatcaccattaatatttactgcttattcgataaccttaggtccattccagtttgcgtaatattttttatagttataaatccaaactaatatactaccattcacaaaggttacgcgatgcacaggcccgtattctcttgtctttgtctctttcttgtataaaacacaggaaaattgaaatatgaaaatatacagaaaaatcttaggcagtatttatcaattttaagaaacaactatttacaggtttttcaataggcattacattaaaaatgaaatatatagttaataaatatgaaaactgtggatataatcaacacatttattttacttcttgaagtgttaacatgtgctgtctcaaatatcaacagtgtacacgtgagaaaa

SEQ ID NO: 153092 - DNA, 123 bp, Homo sapiens
cagcaaccgcatctgcagagcactccacccagcaaccgcagagcactccacccagcaaccgcagagcactccacccagcaaccgcatccgcagagcactccacccagcaaccgcatccgcaga

SEQ ID NO: 153093 - DNA, 571 bp, Homo sapiens
ccaatcactgtcaactcaatcgcctaatgattagggaaacattaagtttggctaatttggttttctgtggccatcatcacattcccagtgacaggccaatccccaccctgaatctaccctgcctgacagtgccagatgttttaatcatacggcttcattcattaatgtctatcagcatcgctggccgggtttgcagcaaatacctttatttgaaaccaaaactaattaaatactatcttagtaattaccttctgtagttacccttccctaagtgggccaatatgacaagggctgaaaaataaaggcttaaatgggactggagagggagggagcctcaccatcattgaattacatttcccctctgtgtgtttaataaatggtatgcttgtgcggggagccatccctcccatctaaactctgttcagaaaagtgtatcttagttttgccttactccaatcagtttatggaacatactgctttcttagatcatgatgttttaataagactactttacacacacacagcattcagaagatgtcactgaaacttctttaccaacataatcatcctt

SEQ ID NO: 153094 - DNA, 287 bp, Homo sapiens
gcacccgatcccagcagtcctttttattgtcgttttcaagctacacatctaacaccctcctacccccactcccccgggttgtaggtaagctgggcctggatggagtgaagatgcaggataaagccctcctggagcaccagtgagcaccccaaagcggccctccctgcctctgccccaggcctcccgccatgctgtccatcagctcggccttggccaccttgtcctgcctgtggatatctgagaggagtcggatttccctcatccactcatcccagcccctacactgt

SEQ ID NO: 153095 - DNA, 430 bp, Homo sapiens
tttatatgtaaccaagcccccttgtcagtactcacttctactgccaactgagctgaaaattgaaattctggttcagtctgtagagtcagactctgttcttctgttgtgttaactaattcattgctaaccttagctgcagtgttgtgcttactcaagagcatctcatactaaagactttaaatgtcatttacaatctctttattcctttccctcattgatcaaacttatccagagcaacaattatttccttctgggtgctaattttttcctccatttcatggcactttcaaacaaagcttgcaggcacactgcaatccttcattaactgaaaacatgcaaagtgcacaagcccttccaatggaaagtgcaatgcaaaagccaaatgaggtaaattgcattacttgaccggccctgggacagtttaaagagt

SEQ ID NO: 153096 - DNA, 526 bp, Homo sapiens
cgagaggcagagggctaggtctgtttcctgtgccttcagagagcagctctgggagcagagccaggtattccaatgcaaggagatattggatttaagttaaagcctttgataactgaagccttaggcaaatggaactggctgccccataagtagcacgtgagaggtggagctattagagggtggcctgtcatttggtgcagatgcagcagaagtgttgatgggagtgggtaggattcacaggactccagtggtcccttccaagtctgaggttctgtgaacatcctgcacttccaaaggacacaagtagtcatggtgtgcaccacagggtgtgaaaaaacacacaattacactggattatatgaggagccttggaatgtttccgttttcatttcaaattctttttcatttagtaatgcttgcctataaaaaggtaaacatttaaaaatagaaaagtctaagaataaattctctctcaacccaatataattatccagcccagtaggaagatgacaatcaaagacagaga

SEQ ID NO: 153097 - DNA, 411 bp, Homo sapiens
aacaaactggacctaaataagacattaatatgacacagcatccaataattgcaaaatatactctttcaagcagaaagagatcatttacaaaaattgaccatatgttgaaccctaaggcaagtctcacaaattttaaaaaaactgaaataatacacagtatattctctgaccacaatgtggattcctgaggttcaaaaagagctgggaggaaatcactttttccttttttgtttactgctatcccagcctccaggcaatacaacatttatggagcaacagctaaggctagacaggcacctaaaagccttgtctctgaccaaaggaaacagtcccaagagcatggaagaatcccagtgcagataggaagattaaaccaaaaattctgacaaactgctgaagactgaatgtagg

SEQ ID NO: 153098 - DNA, 191 bp, Homo sapiens
catccttggtcctagcagtgttgcagtgctgtgccttgtgtggctttcttgtttgtcttgctttgtgtttgtagagcttcttgaacctgtggatcaatgtgcttcagacagctttggaccaatccatggtcattagttttgtaaatactgcttctcccctgttttggtccattccagctgatacaacaaaa

SEQ ID NO: 153099 - DNA, 595 bp, Homo sapiens
gtgctgggccagatccttcagggatagtgccagcctgtgtgctcacaaaacaaccctggaaggcagacagtgtatccatttgacagatgaggaaactgagactcagggagtcctagctgcagaggcagagcttggatgggaatgcaggcctgagtcctgacctggacatcctcagcagtgtgtccagagcaccctcccctcagcgaaggagcagatggagtgtgtgtgtgtgtgtgtgtgtgtgtgtgtgtgtgtgtggcggggggggtgtccaatcaaagtcttaactaggtcaggcgtggtggctcacacctgtaatcctagcactttggaaggctgagatggaaggatcacttaagcccaggagttcaaggctgtggagagctagtattgtgccactgcattccacctgggtgaaagagcaagaccctctttctaaaaaaacaaaaaacgaaacaccaaccaaaaaaccccaatgtacttaactgcgttgctgaatcacagaaggggtatcctaattaggataccccattatgtgtgtatgtatatatgtagctgtttcagacttgcattttctcccaccacatatctaacg

SEQ ID NO: 153100 - DNA, 431 bp, Homo sapiens
gactattgctcctttttctctcctcttttttagaggaaagtttagaattttggttctgtattacaggggtaatctaaaaattttgacataggtattggtgtttataattgctttgtagtcaagtgtgatattaatactgatttatacaatatcactgtataaaaatatgtgttataaagtagcattattggggaggccgaggtgggtggatcacgaggtcaggagatagagaccatcctggctaacacggtgaaaccccatctctactaaaaatacaaaaaatcagccgggcgtggtggcgggcgcctgtagtcccagctgctggggaggctgaggtaggagaatggcgtgaacctgggaggaggagtttgcagtgagccaagatcgtgccactgcactccagcccaggcgacagagagagactccatctc

SEQ ID NO: 153101 - DNA, 636 bp, Homo sapiens
aaagatcctggaaggtgccagcaagtgaggttaggtttcccactgtagatgtaatggaaacatggtttccccaccaacttcgaggcttgagagcattcagaaaaagtttggtcaaccttgtaggggaaccagcccgctataccacccgcgggttctccccttcccagtggagacgagggaatgagaaaagaaataaagacaaacacacaaagttcaagagttaacaaaagtgggtccaggggtccatcgcaatgtggaaactgcgacagccctgagctctggattccactgatatttactgaataatccttaaagtccaactaattggttaacagaacaggacgtgaaagcagacagcccgtcagaccacaggcctgtgcatcaaaggagcggtccactccaagcaccatcagcagggcagcagagctctctgcctctgggaacgagcgagagatagaagactttccccttatcctcagaggacttctcctcttttacaagcaacctcctgctgttcccttctggggaatggagcaggggtcgcttcccttcccacaagacctttgttcagggactcaagtgggaggttgagcaataagcaagctttcttgcttagaggctccgcacacttcctgt

SEQ ID NO: 153102 - DNA, 484 bp, Homo sapiens
gtcatgaatcatttatgcaacaactggcaatgcaacggattgatttacagacttctgggtgtaggaggagcaccacacatctatggaccatcccctttcccactctcgcctctggtggcagcagatgcaccctggtccccaagagctcactggggaaggcaagtgttagagaggatgtagtgggatgagctcagggccaaacagcatttagagaaccattacaagccagccttggtcaggtagtcaaacttacttccaggatgtctggcaaagagccatcagttgctgctctagaaagtccacaacatggcctaatccagtagttgttatttaagggaaaacaggggcactggggagcagccagatcacatccttgctttttgcacatttggcagaatgtttaaagggagtgggggctattacacttctccctgtggaaatatgccatatccttgttaagttgaagacagccttgtctgtaaag

SEQ ID NO: 153103 - DNA, 393 bp, Homo sapiens
taaaacaaaactatgtgagatggtgacacatcctatagggaaaacaggcagataaggatgaattccagtgcaagaagggaggtgttgcactttatttttatttttagtacagtggccagggaaggcctcatttaataaggccatgattttgcataatgaagacctaaagtcaaagtgaaagcctgtcatgtagatagggattaggcttagtctgactttaaggagtaaaacagtagagaacatggagttgaagcagcaaggaaacaacccaacagttaagtgtagctgccatcttggcaaacagggagttccccttcataccaagggtaagctggaattcaggttagaagaaatttggaagtagggctacacacacatatttatctatggatt

SEQ ID NO: 153104 - DNA, 289 bp, Homo sapiens
ttaatcttctctgtaagcctccagtctagccaacttaaatctagcttgagttttcccctcaagtatgttcatgtaccattccctttgcctaaaatattctatccttagctacctaagccttttccatacttcagtgttggagcaaatccctccccttgtataaagctttttttgtgtgatcactacaactttgggtaagaacttcctactcctcccaaagtacttgctagcttgtttctctttccacatttgtacacttacagttttttttgctctctaaaggcacccc

SEQ ID NO: 153105 - DNA, 236 bp, Homo sapiens
ttcagaaccacaagaaatatatctgaaatgcaattcaaggctaatgtaacaacaaggttacaaatctgagcatatatgtcagaacagaaaagttacagttctcatggtaacattatatcatcagcattatactgcctgcacaataaaatacgtatttagaaacctaactggtaatttaaaataccacatgttatatatattaaatgaggataagttaacattcctaggagagcctt

SEQ ID NO: 153106 - DNA, 310 bp, Homo sapiens
cagtaataacaagcaaaataaacagtcaaaccttaacatgtccctcctcccttaggacctcagctttaccttgtagtttaagaattagtcactcatttggactggggcaagtccctatggattcagagagtttgcaatcaactaatgggttatggcattattgttagtggatgataccccacaggaggctggactattgcatcagtcagggtaaagacatacttgctatgtgtgtgacaaacaaaagcctacccaaggtggttcctcagagaactctgaatgaaagacatgcagtgcttgcttgttccac

SEQ ID NO: 153107 - DNA, 589 bp, Homo sapiens
ctggcatttactaatacaaagaagggtttctatctataagataatttaataggatctttctgcacagattaagttgattaccataaataaactagaactgatgtattcaaggggcatggctgtttgaagaacagaaggtagccacatgaatgtgttctatttagtaattaacagtatgtaaaatgaaagaatacctaaaccaaaatggctccacttaatcaactgttttgttggtagattacctagacccagatcctctatcactatcttctcaggagtcctaagcatattaatgcactgctcttgagtttttagaatttgttcagagtgtttaaaactacatacatgtaacatctgttttatacaagatacttcaaaaaccaaagtgattactataatacattctattaaacctaaaccaacatgtgttcaaatgcagagaacaaaaaggaatgttttgtcagatgttgcatctgatggattgaaagagttctataaaatagctcctctatagcttgtgctttctgtatttttgagtctttaggaaagtttaatgctggggaatatctgtgatgtgtgtgtgtgccta

SEQ ID NO: 153108 - DNA, 449 bp, Homo sapiens
gctcccaaatcccgaccatcacacacacacacacacacacacacacacgtgtgcacgcaaattaggaaacatgaaacgaaccatttgctgattggaagaaaagtgttgtcagcagcagatgaaacaaaccgaagcagaaaggaagggggaagagaagacactgttagttattaagcccagtagacatacaaagaggacaatgctaatccatggtaagtttgtacagtgttgaatcgttttgtgcccctcaaaggaggtgtctggcaactaacatctcaaggtgagtttttcttttatttaaatataaaatgtggcttttgtacttttgaattttgaacatgactaatacatacaaagtatattaaaattaaaagacagatgtttgttgctatatacaattatatttccaagtacagaatagtttgcctttatataatccctttttacaa

SEQ ID NO: 153109 - DNA, 625 bp, Homo sapiens
tattctctaattcatagtaccccccccttttgttctcctttctcctttttgcctttgttagatgcccaggcacgccacggtagcaagcgttatcagtaccagctcacattcctttccttatttgaaaagaggactaactttctagctcattacagacaccccttccccttcctctccactttctcttacatgcccaccctatctaaaaagaaaaaaaggaaatgtttagccaaccggaattagattgtacgacccgaccccggccaatggggaaagggtacaggggcaggacttgcgtcaggaataaaggccctcgtgcccctttgttcaggtgtgctctcatggcaactggccaaggaggtacccctctgcgcagaagaagtcctattcataccccaaaaggtcagcttagggttccaaggtacacttaggacatctctgcctcatttcctttgagatttttatctcctttcccctgcttcctgttatctgcagaagttggcgtatcaacaggtcaagtggggttatatgcagaacgaaatatatacggtttgcataaacacagtccttaattccccctgcaaacactttaaagtccctgagaggagtctgggaaagcctggag

SEQ ID NO: 153110 - DNA, 465 bp, Homo sapiens
ctcctgctctctgggaatgcacactggtatggtcggaagtggatacaagcccttgccctcattacccacatcttacgtgtcagtaaatgctctcagctctgtctccaaattacaccccaacccattacatctctatcttctgtccactgtgctagtcctggccactatcactaccaccaaccatatcatgtgtccactctgtaagccattactcactcagcaaccagaatcatcttttaggtcacgtccctgcttaaaatgttttggtggcttcctgttccacataggatagaaccctgactgcttatcacaactgggagagcctgccttcctcttcagcctgtgtcttgctatgctgttacggctcgggatgatgtagcctcctggcccctcttgctattcctcacatccatcaaactcactcccacttaagactttcacgcatgcttttccctccacaggtga

SEQ ID NO: 153111 - DNA, 405 bp, Homo sapiens
gaaggtggacggggagtgctggattggtttacgctccctgtgagcaatgtgaaggcagacggggagtgctggattggtttacgctccctgtgagcaatgtgaaggctgacggggagtgctggattggtttacgctccctgtgagccacgtgaaggtggacggggagtgctgggttggtttacgctccctgtgagcaatgtgaaggcagacggggagtgctggattggtttacactccctgtgagccacgtgaaggtggacggggagtgctgggttggtttacactccctctgagcaatgcgaaggtggacggggagggctgggttgatttacattccctgcgaacaatgtgaaggtggacgaggagtgctgggttggtttacactccctgtgagccacgcgaagg

SEQ ID NO: 153112 - DNA, 407 bp, Homo sapiens
cacatggtattttattttccattcctgagttacttcacttaggataattgccccccgttctatccaagttgcacaaaagacactattttgttctttttaatgcctgagtagtagtattccattatatatctatatctggatcatctatctgtccctctctctatctatctatccatatatatctcacattttctttatccactcatggatgggtatttaggttgattctgtatctttgcaattgtgaattgggccgtgataaacatatgagtgtaggtgtcttttttatataatgacttcttttcctttggatagatacccagtagtgggttgtttggatctatgtatttaataaatagaacaattgagtatttcttttggcctagagcataaaatagttgctgaga

SEQ ID NO: 153113 - DNA, 777 bp, Homo sapiens
ttctatacaaccattttattctattcaggcctacagtggattggagggagcaagcttctacattcactctgccaattcaaatgtcaatctcatcagaaacaccctcacagatacatccagaaacaatgttaaatcaaatatctgaccaccccattgcctagtcgtgttgacacattaaaattaaccatcaaaatagatgcagaagagtttcctggcctagaatccttagatctgcatgttcatgagaaagattatattagctcagctaatggtcattagaattaagagtatagatttttagtagccaaacttgaaataaacaaatatgtaaaccaaaaggccaattagttaattcccactagttgctcctatttattttatttgttatgtattcaacaatttccctatgaaataattattgatgacagaaacataagtataaaattttaaaattaaaaaatatacacatatagaacagtgagatactcaaaagacatcttcaaagctctgtgtgtatgaatggagcaaataaataggtaggcaagccaggcacagtggctcacatctgtaaccccagcactttgggaggttgaggtgcaaatcagttgcggtcagaagtttgagaccagcctgaccaacatggaaaaaccccatctctgctaaaaatataaacaacaaaaaaaaattagccggatgtagtggcacatgtctgtagtcccagctactcgagaggctgaggcaggagaatctcttgaacgtgggaggtggcagttgcag

SEQ ID NO: 153114 - DNA, 484 bp, Homo sapiens
  misc_feature (127)..(127): n is a, c, g, or t
  misc_feature (459)..(459): n is a, c, g, or t
  misc_feature (466)..(466): n is a, c, g, or t
caactgcattgttttaagccactgcatttgtggcaatttgtcacagcagccataggaaactgacagagcaaccaatttcaatgtttagaaagaggcacaaacaaaacacatctgtgagctcaatccnacctaaggaccacttttctagtccagactgggcagagtcaagggcaaggactatttcctgggtgcccagcacggagcctagcacacagcagctctctgacattcaccccaagttaacgcaaggtcccttacctttaccacatggtcataaaattatccagggatttctggaaaatagagctgcttaactgaaaggagttctattcccaagagactgtttaatcacatagacattacccagaggccttgggaaactggcctggagtagaggagggaacatccattctcactgcaaacagaaaaaagtgagggctcttcaggtcctctggaagnaaacctnccaaacctctccctccca

SEQ ID NO: 153115 - DNA, 198 bp, Homo sapiens
gattatggagattcttaaatgtcagactaaagattttatatatgatttttagttaagaagaaactctctttatggataataatttgtgaacaggtccaatggaagagtggaagcctgtaatctcagcccctggggaggctgaggcagggagaattgcttgagcccaggaggcagaagctgcagtgagctgagattgca

SEQ ID NO: 153116 - DNA, 729 bp, Homo sapiens
tccccaacggagaagcttgctctgttccctgacccctggtaggggtggagcccagccttaaagacccaggcaagctgaacaccaggcctggaaaggtgatcttcttctcagagtctggctgccaaggcagtggcagggaggtctggggagacatcgttgatgcctcaggctgggcccccgtagcctccataagggtagttcgaggctgctgggtgctgtacgaagagccagagttccggggtcagaagctggtcctgcctgaaggagacatggaactcagaaccccagggacaaagtggagtccccaaggcatcggctccctaaggagggttgtctgggactacagcaccccggaaatcagcctcttctctgaggagggcctcaagggggagcaagtgaagctaacagaggccttgaagaattcccagggtctggagaagcccctgcaggtggcatctgccaccgtctctgcaggactatggctactgtaccccaaaccattattcgaagacactccctacatcctggaacctggagagtaccccacctcagaggcctggggcacatcggaccccagcgtgggctccctgaagcccatgagattgggctgccaagtgtggagaagccaggggagcccaggctgtggtgtatgaggcccaggctttcagggccgcagctggaagtgagccgagaatctacaacttcagagcagaggacagcagagcccca

SEQ ID NO: 153117 - DNA, 149 bp, Homo sapiens
tccctggactgtttgacagtagcccttcaattctgcaggccttgggtcaggcaggatcctggagacagggctgccttatctgggctcgaggcaggagtttgtgtggggagcagaggtgtcccatctgtagcactggcagcaggcaccag

SEQ ID NO: 153118 - DNA, 504 bp, Homo sapiens
gaaaaataacgcagagagctagggtaaaaagaaagaagagtaaaagcactattttattaaggcaatagataaatttagtgggattttgattcagtaggcctggggcggtgtccaggaaacttcatttttaactatcagcccataggattctgatgcaggtggcctgggaagaccttttagaaacttagcagtagatactgttaagaataacaagcaaaaggccaggcgtggtggctcacgcctgtaatcccagcacttttgggggccgaggtgggcagatcatgaggtcaggatatcgacaccatgctggctaacacagtgaaaccccgtctctaccaaaaattcaaaaaatttagccaggcacggtggcgggtgcctgtagtcccagctactcgggaggctgaggcaggagaatggcgtgaacctgggaggtggagcttgcagtgagccgagatcgcgccactgcactccagcctgggcaacacagtgagactctgtctcaaa

SEQ ID NO: 153119 - DNA, 271 bp, Homo sapiens
ctaaaatttaaaatatccaagtctacatattgaaaggacacacactgtgtcagagaaaactgataaggaatggacaagcaaaagtattgtcacaaaaagagaagaaaattaggctagcttcagacttcaactctagaacagaatggatcatcatttttaaagttctcaaggcagggaaattaaattttatttgagtgaagtgggaagccaatcgtagggcgttttttgttttttttttcttttttggggagacaaagacttgggccccccc

SEQ ID NO: 153120 - DNA, 723 bp, Homo sapiens
acagataaaaaataaatttggagaagctgaatgttttctctaaggacacacagcaagttagtgggaggctgcttcctgcaactgaaggtcattcctctttgttagaagactaagggtccctgacctgatctgtggagcaccagggtggagagagtggaataagcagcaaaacgaaaaattggatgctgttttcaaaagttttgttctcattcttggattatagattatctaaagggaaaatttaactcaaccaaaaaattcgttcagctccatgaagctaaagatgctataaactgactctttcctaaagagcaccaaacctgaaatttttcctgctagagaggaactaatcttcaaggacacctgtctattgctagacattaagaaggaaggtgaactccgttctgtcttcataaaacacatttttgtctttccccctcactcctccactgaacccactatgtttacaagtacaagctatgactgtggaggtggaaaatctgatactgtcagcacaagtggaacaaaatgaaaagagaaaaaaatctacacacccatctggacttccatatgctctgtagcccagaggctaatataattccttgaatgttggttataaagcaatgtgatatggatgactgctatgcactgagcttatttagacaagtgttctttctactcaataaacctttgaaaggattaaagtacaatcactcccaatta

SEQ ID NO: 153121 - DNA, 329 bp, Homo sapiens
  misc_feature (12)..(12): n is a, c, g, or t
  misc_feature (22)..(22): n is a, c, g, or t
caggagccccgnaacaggacangcaagaggtaagcaccatataaggacacctgtgtgccagtggctggcccatggggtagggaggagcgatgaaggagcagcccctcggggccatcatggtgacatgaccttcacgtgcactcccgtggcctcccactgacctccgaatgtccagtgatgggggtggaggcagaggaagccccagcccaggggcctgtgcaccactttccaagatcacgggactcgcgcatttgagatgagcgacttggccggcgtgtgtgtggacctgcctgccgagcaccccggtggcagctgtgcccagttgcgcc

SEQ ID NO: 153122 - DNA, 256 bp, Homo sapiens
acccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgt

SEQ ID NO: 153123 - DNA, 464 bp, Homo sapiens
ggctcccaccgtctataggcccatgctcagcagggtcagaagtagagaagggctctggagccctggggagctgattggaatcccaggtgtggctctcatgtgtgacccctgggcaagtcacttcctctcagagcttcagtttctctcatttgtaaaatggagatactgacatccactccagaaggttctgtggaggactggcgatgagaagagtgtgcctaggtcagtgctgcacccgataaaggcacccgcatcgcctgctcgcccccacccccactgcctctggctcctatgcccccctcgctgctcccaggacttcagggcacctgggtgagtaggacttgaggagtgaccttggctggtaaggacttgctgccaggcctgccctgggatgccctttgtgcccgctgagaagagaacgccacctgggccagctgtcaggtgtgtctgctcaggctggggcc

SEQ ID NO: 153124 - DNA, 287 bp, Homo sapiens
cgcctggcccctaaaagtatttttttaatatataattcacacagtactgggaaggtaagtatgttaggaaaacactgtcatccatttccacaccaaacagaaatagctgttcagtgatccacttccaggattggacctacagtgaggtagaaaaatcagtaacacccattctgtcctattttgttcatcacggatttcttgacattaatttttattttgtaaaatattacactgaaacatgattatggccgggcacagtggctcacacctgtaattccagtgttttg

SEQ ID NO: 153125 - DNA, 308 bp, Homo sapiens
tgccctcctagtccaccaaaactgctcttgtctaggccactaaagactttcatgttgcaaagtccaacggtccagcctcaggtctctgcttactcaaactttctgcagcatttgttcatttaatccttgaaacactttctgctctttgattcagcctatttgaaccaaagcgcagctgctcatcctggcattcgcaaacagaagtaatcaccaaagaaacttctctcggccgggcgtcgtggctcatgcctgtaatccccactttgggaggccaaggcgggtggatcacctgaggtcaggagttcaag

SEQ ID NO: 153126 - DNA, 258 bp, Homo sapiens
cctttagttgatcatacattcatcatgaaaaaagtatgcctacagacatacaaataaatacgtttcttataagtaataaagatcaaaatttgaccttcagccagtagatggagaagtttattcacaatgctattaaaagtctctgttatttgcagaagcatggagtaaaattgctgctgattcaggtattcgaggattgttttcatggttattttctggctgctctgcaaaaaacagctcttagagttactctctggc

SEQ ID NO: 153127 - DNA, 197 bp, Homo sapiens
ctcctcaaagttggctcttgtgtccttttaagatgacaccactggtcttgcttatagcataagttctgagctttaaaatcttataaatgcctgtcccacacttggaatcaactatttctctaaggagtcctggttctttttcattagaaattgtctttaaaggctgggcatggtagctcacacctgtaatcccaaca

SEQ ID NO: 153128 - DNA, 544 bp, Homo sapiens
aagcagatccctgaatatacacctagcatgtttctcatagtgagaatgaccttaggaagccgacctgggagattcatgacctcttgagatcaatgaccttggactccacattaacccacaacttctcccagtcattagtccacaggaagcccatatcccttgctcacaatttacttacttgttgagattttttctcataacatggaaaaataatcttctgaaggcatttcccttaatgaagcccacatgtctgatacagatttctttcccaaggtcctggagtgtttggttatgttttaacacatctttgcccttgagatccccgcatatcaggcatgtgattgctaatattttacttattaactggtaagcacgttgtaaaccataatcgcaatactgtcttccccagcctggtgtttatatcctaaaagtaacagcctcttaggagaaggctcttactgccattatcctaaggtgtcatatttctgaatgtgtccaaatgtcacatatccaaagtgtcacatctcatttatgactctcatta

SEQ ID NO: 153129 - DNA, 141 bp, Homo sapiens
aatgtcgattcactggctagggcagatggggaggtcattgtaagaagagaccacagagactagacaatgacaggccctggggagtcatggtaaactcgagagtggcgagagcagtgtgtttgtggaaagcaagtttagatg

SEQ ID NO: 153130 - DNA, 287 bp, Homo sapiens
tttaaactgtacgtgctggaatttaactgcctccaacagttctttttccctttgccaagacagccatcaatactcctatcacggctgctcctttggttggagtaagaatgatgcagagcctctagaaaacccatgctctttttgaccactttgaggttattggttactacagcataacctagcttattctgtctgatagtgcttgaagattcaccacctgaaaatctatgtttcaaaagaaacagactagtctgaaatccctcttttaaaaacatttaaataaaact

SEQ ID NO: 153131 - DNA, 524 bp, Homo sapiens
attcgattctcctcagctcttcttgatccagcctctgtttatccattttgtacagaaacattgtagtggctgttgagagaaaggagcatcccttttagccagggcttggggagctccttagaggaacaggcatttgagagaggctttcaatgatgagcatgttggggatgtggggctggtgataggcaggacagttagggacatccttccagaagacatcctggggaaagacatagaggggggaagtcaccaggctgacttggtaggattctgcacactgctcatttgggttgcaccaagagctttagttggaattactgggttgcaccaaagagttttagctggaaatattggatgggaggattcctacatattttgttgggggaagggtcgtctagtgctgttggatttcttttctagtttttctttttttgagacagggtcttgctctgttgaccaggctggagtgtagtggcaccatcatggctcactgcagcctcaaccttttggactcaactggtcat

SEQ ID NO: 153132 - DNA, 658 bp, Homo sapiens
tgctgaggaagggctggtgacaggaagaggggtggtgtcccctgtggataatgaggaagcatcggtgacatgaagagcggtggcgtgacctgtggatactgaggaagcgtcggtgacaagaagagaggtggcgtgacctgtggatactgaggaagcgtcggtgacaagaagaggggtggcgtgacctgtggatgctgaggaagggctagtgacaggaagaggcgtggtgtcacctgtggatactgaggaaaggctggtgacaggaagaggggtgtcctgacctgtggatgctgaggaagtatcggtgacaggaagcggcgtggtgtcaccagtggatgctgaggaaaggctggtgacaggaagaggggtggcctgtcctgtagatactgaggaagtgtcggtgaccggaagaggggtggcatgacctgtggacactgaggaagcgtcggtgacaggaagaggggtggcgtgacctgtggacactgaggaagcgtcggtgacaggaagagaggtggcgtgacctgtgacactgagaaggtgatgtgacatgaagaggggtggtgtacctgtagatgctgagaagggctagtgaccggaagagcgtgttcacctgtggatgctgaggaaaggctggtgtccggaagaacccgcgactagg

SEQ ID NO: 153133 - DNA, 352 bp, Homo sapiens
tgctgaggaagggctggtgacaggaagaggggtggtgtcccctgtggataatgaggaagcatcggtgacatgaagagcggtggcgtgacctgtggatactgaggaagcgtcggtgacaagaagagaggtggcgtgacctgtggatactgaggaagcgtcggtgacaagaagaggggtggcgtgacctgtggatgctgaggaagggctagtgacaggaagaggcgtggtgtcacctgtggatactgaggaaaggctggtgacaggaagaggggtgtcctgacctgtggatgctgaggaagtatcggtgacaggaagcgggtcgacgcggccgcgaatttagtagtagtcgacc

SEQ ID NO: 153134 - DNA, 607 bp, Homo sapiens
  misc_feature (446)..(446): n is a, c, g, or t
aaagactagccgggtagagaagcttctgttttgagatggtgcttaacagggaccagggatgagaggcatggtggcaaccacaaggtggccaagacaatttgtctccagttggatgggatgtctgcctggacacagtctgtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgcaagcagtccttttggtacgcttcacaggacccacagttaaaaacacaaaactagtcatcatgatagtggtcgtttgnccagagaattctctagaaatcacatcccccctccaaatttatatttccacttccacacttcctttaaatctgaatatatatgaatccactgagtgggtgctcacaccttaatcccatactttgaagctgagtggtgataactgagccagagatcactgagc

SEQ ID NO: 153135 - DNA, 517 bp, Homo sapiens
tgccaacagacattctgagaacaggaacagcaaaaaatgtctgtgattaaagatgtgtatgatgtgagcttttgatgtttccaagtcctgcaggggaaaaaaacctgtctaaccttgatccaaatctagctttttcacaaaatacctattaaaagcgtcactccaaggcgtacagcttagaaaatgctgctctgtatttctcatcccctaatcagtttgcctacgccaagtcctctagggagcagcacatttctggcacttgacggatgggccaggtggtcaacacctggagagcatctctgtgccccacagggcccagcccactgcaggtgttcaggctgtttgaatgaacccaacaagaccgaaacattctgtacatttcattgttcaagtggtatctgagttttagtcctaggaagggcaggacatggaatggagggatgggggaggaaagcctgcccatgcaacttactccttgcaaatggaccaagcctgtcctatcttttcttttcttctc

SEQ ID NO: 153136 - DNA, 417 bp, Homo sapiens
gtggagaggtaaggcctggtgagagctaaggggctgttcttttactacctgctcgtgcctggtgtctacctcccagtcctgatctctcacagttcaaaggccctgatcctcatgggctgaggagagatgagaggtttaggggaacataagagcgttggaaaggtgcgtccacagacgaaagctgcaggcatcagagaggaaggttgcctagaaggttgatcccctaagtgccttgctgatgacctgtctgggccctgcctttggcttctacaatacaatgtcagcaggaggcggggaagggataaaaccaagcagtaataatacaacacagacctcaagcactaggagcagagcaactataacctttctaaggagaagtccagccgtgtatgaatgcacccacacatacatgcccat

SEQ ID NO: 153137 - DNA, 315 bp, Homo sapiens
tcaatatactcaaagccagcattccttttccttttgaaactgcctgttctttataactacccaattttagcatgttttctagacttaatcacacgacatgttggactcaactttgacttaattttcagattacaagctgttgatgtttcccatatcattggttccctatcctttacattcacgctgaattgtatagttcccaggattatactcagaaaagtgcacattgccaaataggaaaatgatactgtatggataaacttgatgtgcttttaatggacaaaagctaaattataaacatctttttactgctgc

SEQ ID NO: 153138 - DNA, 288 bp, Homo sapiens
ctatgtgggggagctctcagagggtcaatcgcagaaattgctcagccccactcctccatctcttccagagaaactcgctcaaccacctgccacaagcaggtggcgagaatgtggccgctgatggggaggggtggacggagggccccatgctctgggggacttcacggcagtttccaggaatgagcttcataagaatgaccttaaatagatatttccctcctagtttcttcttcttcttttttttttttttttgattaaacagcttcattgagttgtggattcaacgtt

SEQ ID NO: 153139 - DNA, 257 bp, Homo sapiens
ttaagataaagatagtaagccctacaactaccactaagaaaataacccaagaaaaatagttttaaaaatcataaaggccaggccagtgagccaaacacctgtagttcccagcactttgggagactaaagcaggaggatagcttgagcccaggagtttgacaccagcctgggcaacatacccagtcactataaacaataaaaaacttaggcatgatggcatatggctgtagtccctgctgcttgcgaggctgagcggg

SEQ ID NO: 153140 - DNA, 419 bp, Homo sapiens
cgtctgtaatctcagctactcgggagactgaggcaggagaattgcttgaacccgggaggtggagtttgcagtgagttgagattgcaccgctgtattccaacctggacaacagtgccaaaccctgtctcaaaagaaaaaaataataataatataaagtggccaggtgtgttgactcatgcctgtaatcccaccactttgggtcgaggcaggaggatcactggagcccaggagtttgaaacgagcctaggcaacagagtgagaccctgtctctatattaaacacacacacacacacacacacacacacacacacacacacacacaaaggcagccagactatgcactaggaactgccctgggaatccctttgtgttctcacaacaatcccatttcacagatgaagaaacctaggcacagaaa

SEQ ID NO: 153141 - DNA, 199 bp, Homo sapiens
caatactatgattatggtttgattgtctgtaaagctagtgtcatatttaataggaacacatgagagacatttccactgacatcaggaactagccaaggatgttcactctttccacattgtattagaggtacagtgcaattagaagcataagaaaggataaaaaagtgaaatgtttaaatgtcagtacctttcacatata

SEQ ID NO: 153142 - DNA, 728 bp, Homo sapiens
tatgaaccagaaagtgggcccttaccagacactgaatctgctggcacctggacactggacttcccagcatccagaaccatgagaaatgaaactctgttgtttataagccactcagtttacggtatcttgttgtagctgcccaaatgggctaagacagtggggcattctttattctacatattagtgaataataccactttacatttggatcacacactacagtctaaaacactcgtgagtgaatctggaaatctgtaactaaatttgtaaatttcacacagtaggctaggaagagcagctaccatcattcccattttagagataaggaaaaactgaggtttagaaaggtaatgggagtatgtggaactggaacaaaagccccgagttctggctttttcaaggccctgtgaacagagcgcctgctgacaagcagcactggccatgtggcacgattagaaacagaccttcattatctgtccatcatataacctagcttttcccaacacataatttcctttttaaaaatgccgtggtgaagataagggtaatgcatatttagtataagcaacttcaaaaatacaaaaaggtatgaagaaaacgagctgagatctcattggatttataaattaatactttgctctttttacttaacaggatatcccattaagaattctttcaaaatattcataatagccagcaatatcacatcatgtggctgaaccacaatg

SEQ ID NO: 153143 - DNA, 134 bp, Homo sapiens
tattgtttcttttaggactcctcttattgcaaataacagaaaaaaatgaactaattccatcaggtttcatcaaggaagaagatttatggactcaggtcagcaaccttcaagggtagttggtcctgtgactgaac

SEQ ID NO: 153144 - DNA, 330 bp, Homo sapiens
acttggatgaaaaaaaaaataagacatagaaccaaatctccacgtatcggcttaaagacttcagtgaggaatacatttgaagtgaatcccttggtaaaaccaggacagagagatggacgggggttgaaacattgctgatgatgggtgccactgcaaacataaccctgaattaccttccatgtgtgccaactttaggagcactgcatgtaaacacccccatttctgaagaggtcattttctattactgacacacttgaacaagtattctaaagccaactcttactgtagaataattatctgagtctgggaatgggatgtggggcatcagta

SEQ ID NO: 153145 - DNA, 561 bp, Homo sapiens
agaattgagtgagggtgtaggatgagtgtggctgtagtgggaattcgaggagatggttagggaatttgtgctggtgttgcagtttgatttgtagcaagaaaacttggtacaaagaggttgtgaccctgtgtgaccccgagggagaatttggatttgtgctagatgaaagggccattacagtgaggaacttggccttcaatctgaaggcacatgaaaggctctgatgtgtctggtcatgtttgttcctgcaagaatttaaaacaaaggaagctgggaggcaaacaatgcttctgctttataattccagttccaaacctcagagggggagctgtaaagggtgaccctgtctacggcaccaccccgcgttccagtgtattggaagtggatggtctctgttttgcatgagaaagtgacctggtctccttccttgtcatgtttcagttgaaacagagttcctcaaaattggaaatgcacacacacatacacacagacttttgcccactttggaatagaaattaattgcactcggaaaataaattgcagagcatggctgagtacaga

SEQ ID NO: 153146 - DNA, 546 bp, Homo sapiens
actcccactatccttctcttctaactcaccaagattttgaatccatggagccctaatttttcttccaatccattatttctcttatatacccttacttcctctctatcacttgaaatatccctatcttcttaatctctactgccgctacctgcaaccaactgtcttctctcccggcttacctgaacagataagcgctattggaggaaaatctcacaaccaccagatcaaccctactctgagtttatggtctccacattcagcactgctgagcaattcctctctctccctctctctcttgctctttctttcccatggctcactgcagcatcagcctcctgagctcaagggatcctcccacctcagtctcccaagtggctgggactacaggtgcgtaccaccatgccaggcttttgttttgttttgttttttggtagagacggtgtttcaccatgttgcccaggctggtcttgaactcctgagctcaagcagttcacctgcgtcagtctcccagtgtaccgggattacatatgtgagccactgcaccca

SEQ ID NO: 153147 - DNA, 535 bp, Homo sapiens
ttgatgcgaagtgtcacaattatatacctcactgcagtggtgaactcctgggctcaagcaatcctcctgcctcagcctcccacgtagctgggtcacctgggcctgggacaggacaggctgctttctgcaggagggaggaagggggacccactgagggacaggtcttcttgtgttcccagaggccagcaggggggcttgaccccagagacacgcctatccatgagtacccaaaggggatcctgagttgggggctggaagaaggccagtctctccaccaagggaaaggggctgagggaccctgccctttgctgcctttctaagaagcccccaaatgccccccgcttccagcacccaggccctgtgcacagccgcagcctgagtcatcattctcatttgaatggtggccgagaaatcagccagggggctgcccagggctgagggccaaggctaggaaaaacaaggctgttctgttacctccaagctttggaacgtcaagcccggctagggagtggggggcagagggcaggcagaagca

SEQ ID NO: 153148 - DNA, 518 bp, Homo sapiens
cattctgtcttcactgctttctcagcttccccttcccccatctgcatccctatgggtgtgatccttgggccaagaaaaacagctggaaaagtccacagatggtggtgggagaaacagtccttgagtgctggggcccccgctggcctttggtctgtgatggtttctcctgtgggagctacagagcaggatctggccccagggagccagaaatgtcctagaccagatagtgtaacagcattagttaccaaattgccagagattataatgattggacattgatttgcatgtaatttagcatatattttgcacatgagtactaaggaacacattctggttcctgagctgctcctgtttttccaggtccatctctttccaggcaggttcttcacaattaccaactggctaccttcatccctgggctggaaacaagggttctgccaatgggatgccttctttttgagacggagtctcgctctgtcgcccaggccggactgcggactgcagtggcgcaatctcgg

SEQ ID NO: 153149 - DNA, 308 bp, Homo sapiens
ttaaagtcagaatgtcaaatgggaagactatgcttatctgggtcttatgaacagaaaaatacagctgggtctttaagaatactttctgctagggttttctacgggtttttagattttactatttgaccgtctctgtgctccttttcaaggctctgccaaagtgagtgaacaggaacactgtacctttattgtggctggagagctccaagaaacttctactagagatgggtccaaaacagctcactgccctgaaacaggagatgtgtagatctaaacccacctttcatctggagactcacaggcctacg

SEQ ID NO: 153150 - DNA, 244 bp, Homo sapiens
tggatactttgtcttttgatgcacatagtctgttttcatcgctaatttattcctttaatagattcagtactttctccctgtgtgtaaatgataaaagtatttaccttgaccataacagctcctgtgtcacccctagggctcactccaggtgggctccaatggaaacaggtttaaggactatggcagaaactgccaattttcctcagcatcctttttctcctttatccttttagtcattgacact

SEQ ID NO: 153151 - DNA, 501 bp, Homo sapiens
gttctttgtgttctgtatatattttagatattaactccttattaattgtatggttcacatatattttcttccattctatagattgtctcttcactctattgtttcttttgctgtacagaagtgctttttagtttgatataattccatttatctatttttactttttgttgtctgtgctttctgtttgcatttgcctgatatatctttatgtatctgtgtattttccttcacttttaacctttgcctagaaattgctaaggtgcaagtattataagcaacacaaaattacattttgtttcctagactgggctaaaagtcatgtatttctagacaaagtacagaatgatctcactgttactgggagaaaaatacacatttgttctcattttatgctgttttttacacttctttttagaaaacatttctctttgtttctttattgtctcatttcctattgaaatcacctttgcaaaaattatgacagtgagagaaatctgacag

SEQ ID NO: 153152 - DNA, 317 bp, Homo sapiens
tgccatttactccatggcccgccttacatccccacaacacagatatgacacagattatttataagccgtttttattcacatacaaccctaatgtttttttttcttgtcaccaatgggaagagataccctggatgtgaggcgggccctgagatggaggttagcatgcaggatgtttgttaggtgtggttattagaatcaagagaagtgaaagaacagaaaagcaggagtgggtacagggaggagttgagtgaggctacagtgcctgtgacagcctctgtgtactccatggagagccattgcgaggtgggatggctctt

SEQ ID NO: 153153 - DNA, 310 bp, Homo sapiens
tgagagaggatccgggtgctttaggaatgattaatagacacagacaaaaaaaggaaaataaaatgggcagaaagaaacattaattttgcatgtacttgagcaatcacagtggaaaggggcaagaggttaagaaaacactccaatatcctccgtctccctacattgttttcagtatccaggataaatcagattatatcaaaatataaagtgctcttagctatcctataccaacccctgttttatacttgacatcaaggttctacttacctaaagaactggcttgacttcctacagcaaagggataaagcag

SEQ ID NO: 153154 - DNA, 244 bp, Homo sapiens
tttcttgtaaatactacaactctgtgtatgatttcatttgataaaagatctataatcaaatagtttaaaaaccacagacctctacatagcacctaacactgaccatacagtagatgtaaaacttggtattacattaaaggatggggggataacacgttcgcgagggataacacgttcgcgagagataatcgcgagggataacacgttcgcgagggataatcgcgagggataacacgttcgcgag

SEQ ID NO: 153155 - DNA, 261 bp, Homo sapiens
caagtgatctcccagtcaccctcccaagtaccagggactagagacgcacactaccatgcccagctaattttttgtatttttagtggagatggggtttcgccatgttgcccagcctggtctcgaactcctgggttcagtctgcctgcctcggcctctcaaagtgctgagattacaggtgtgagcccccatgcctggactgctttcctttcaagcagttcccatggctagatttaatctctttccttctctatctcctaatgg

SEQ ID NO: 153156 - DNA, 531 bp, Homo sapiens
catgaaccgattttaaagaagtaagttaggccgggcaaggtggctcacacctgtaatcccagcactttgggaggcccaggcaggcggatcacgaggtcaggagatcgagaccatcctggctaacacggtgaagccctgtctctagtaaaaatacaaaaaattagccaggcgtggtggtgggcgcctgtagtcccagctactcgagaggctgaggcaggagaatggcatgaacccgggaggcggagcttgcagtgagccgagatcgtgccagtgcactccagcctgggcaacagagcgagactccgtctcaaaaaataaaaaatagaagaagtaagttagcagcgtaaaagctcaatttgtccatcagcttcagtagtaaaatcataaagatttcaaatatctacatagcattaattattatggaaacatttgtgcctcgggtggcattgcagttggattcagtaagtgctgctcactaacaggctctactgtcttctttctgggtggtctcttactgtattttctctctac

SEQ ID NO: 153157 - DNA, 308 bp, Homo sapiens
cagtaagattgggcaagtcaagttccattttcatgctgcatccttacagggtaatctcaaataacacacaagaaaatgagcagatagtactggctgtaatctaatattactaaaattgtctttggaaaaaatgggttgtgccatagaacaaaagttgtaatatcccatgtgtacttgcctaattttccttcaatattcctttttagttggggtacccaatagggtgataaattataacactaaagaactcatctatcaaaattagcatgaagtccagtgttaacctctgctcacaccacccctgtctt

SEQ ID NO: 153158 - DNA, 206 bp, Homo sapiens
taagcaggggcaaacacataggcagatcccctcggttcccatcagagaaacaaatgagtaaatgaattaaagtcaaacaacttgacctcacctgccagcctcaaggtcatgagcagtgactggtggaacagaagagtgtcacgctgtaaaccatgtctgtcatatgaactatgtccccgctagcactgggaacactgtgacctaag

SEQ ID NO: 153159 - DNA, 516 bp, Homo sapiens
taaaatctacccacagggtgggaagaacacaaatggaatacaaacagtaatgatggacagaagtttattctaaataaatgacagccacttaaagagagtggagaagaaaagaattaaccaaaataactttcaaaaacagtattttaactaaataagatgaaaaacaaaataaacatagcaaatattgtacactagttagcaaatttttttccacagaggtatgtgttaacaattatgaaactacctttatgttcattccaggactgaacaagaaaataaatatgtcatgagtaagaagaaccaggtttctcactgtcactatcaaaggcaatggggagggctagaatgagccatgtggtgttggcttagattggaggtactcatatgaattcatattttgtaacatatatgcagatacatcaatacggaaatagaagtaggtatatgtatttcctagctctgtcactagagggggcctacaagtaatgatatccctgtggaaagtaggtatactca

SEQ ID NO: 153160 - DNA, 2225 bp, Homo sapiens
  misc_feature (1)..(3): n is a, c, g, or t
nnntgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtatagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccacggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagggcaaaatctggacttctgtcagaatttagaagtgatttctgctgtttgccttggcatatcatctacagagaattgatgacatcctgaataaataatttgactcaatagccaggccatctatgagtggttgaggagatgaaagggaagtattatagtttcctttctgttcccacaagtagccttgctgttgggtgaatagtttgactctaaagctacgtgaaaaaaaaatcattagtttgtatttttcattgtaaacatatgttcattaaaaaaattttataatacacccacta

SEQ ID NO: 153161 - DNA, 3514 bp, Homo sapiens
  misc_feature (1)..(3): n is a, c, g, or t
nnntgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtatagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccacggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagggcaaaatctggacttctgtcagaatttagaagtgatttctgctgtttgccttggcatatcatctacagagaattgatgacatcctgaataaataatttgactcaatagccaggccatctatgagtggttgaggagatgaaagggaagtattatagtttcctttctgttcccacaagtagccttgctgttgggtgaatagtttgactctaaagctacgtgaaaaaaaaatcattagtttgtatttttcattgtaaacatatgttcattaaaaaaattttataatacacccactaaaaaaaaaaaaaaaaaactcgagactagttctctctctctctccttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 153162 - DNA, 537 bp, Homo sapiens
gttccacatttagtcaacactgtagaatgaatagctatttcatgttcaaacgacttggcttcacttttaaatcttagtaataaactttcaaaacaatttcatttcaagcaagtagctgaaatttcaaatatattaataattctacttttcacttttttttttttttattttgacacagtctcactctgtcacccaggcgggtctcaaactcctgacctcgtgatccgcccgcctgtgactcccagagtgcggggattacaggcgtgacccaccaggcctggcccttggttggtattcttaccagtagtcggggtcataaattatagaggaggacgatcaaatacgtggctaaatggcctgttagcactcagtaaaatttcttcctaagggtagcccagtctgttctctgaccttgctcctgtgaagtacccagtgttttcagcacaggaaagtctggccttaagcttggaagacccgccaggaaaatgaaggtgaactaaccctctaatttgccggcaaatattcttaactgtcatg

SEQ ID NO: 153163 - DNA, 465 bp, Homo sapiens
aaccgctcacagacacgccttcccctctccctgctatttacatgccaaagaccaccacaggttaagaggacagccctattagaagcccctgctctttctatattgtgttcttgaaaagttttacttccttaggaactggagctttttactgctgaactgaacccagggactgcaatcccagcgaagtctgaacaaatctgtgtctaaaatacgggctgttatgatacccaacggtgtcctaggagaaatccaagccaatctccaggtccagccctcaacggccgcctgatgggaagggacataacaattaatggcaaatttcttacaaggattacccacacgtcttctttcctctaaccaccccctcttcggcctgcaactgctgtgatttggcctctgcccagcttctctcacaaggctgctcacccctgtgtggtgaacccaagggctacctcttgaccctca

SEQ ID NO: 153164 - DNA, 360 bp, Homo sapiens
ccaattgtggccctcacatcctatcttatcctcacactttaataccgtgcaaaaatggtatctgtccctactaggccaccaatgctattctctctccctttgagatttaatgacttcctaatagtgtaattcaatgctcttccctgtggccataacactgtcttgtagacactgctgaactccattcttttcctttagctctttccaaatctgtgtccacaatatttctcctcctacctctcttgtccttctgtgtcctccaactgttctttgctctgcctccacgataaatgtgactgctcccagcccagtacacattctcagctcactagacactgttgccctgagtgaacacacctt

SEQ ID NO: 153165 - DNA, 506 bp, Homo sapiens
agagaaattttcctgtttttttccctctaaaatattaaacataaaatttatttttacaactaactaggactgatcttaattttagatttataccagatattggttataagatgatttcataacaccatattagatctgaataagtgaatgctatttgctcctagctaattgcagcatgtttcttgatatgaagaccttaaaatatatcacttcaaaggaaatgaatatctgttaaaatgagtagaaaaggctatgctttcaatctcctacacaaattttacatctggaatgatctgaaggttcttcaaagacattcaaaattaggcttttttatgtcctgttttaagtgaaaatatttattcttctaagggtccattttatttgtattcattcttttgtaaacctctttacatttctctttacattttattctttgcccaaatcaaaagtgattcctaaattttaattatatttgtaggacaattaaaagcttttgataacttaaa

SEQ ID NO: 153166 - DNA, 160 bp, Homo sapiens
gaggaatgatgaagcatcctccaaagtccccgatttactgttcatgcttggtagattatagtactaattactttttctgggttgtttctttcttaggacagtaaaacactatatgagaggagctaccttcctaaaatgactgaaaaaaaatttacctttg

SEQ ID NO: 153167 - DNA, 265 bp, Homo sapiens
aagagactttttaacacagtagatagctgaaatactcaaagggatctcacacaaagagggatgaaattcatttggaatggttccagagagctaaacaagatccaatgtatagatgaagttagccaatgggaggtggatccagcctagaatgagactgctttaatgattagagctgtccaaatacagaatggactgccttttacaatctccactgctttacaaggagctgtagagcattgggaagttggctggggcctcttttaca

SEQ ID NO: 153168 - DNA, 346 bp, Homo sapiens
tgcaaactagagaaagtaagctacttgctcaaagtcacagggctggcagcagcagcaccaccacttcatcttgatgacagtgacagagatccttccaggagccctcgctgctggacaagggtggcctgtgacacaagtccggtgactgcagcaatgcctagcacagaggaggagcttaacaagtatctgttagccagtgtctggtttaaagaacatgcgcaggctgggcgcagtggctcacgcctgtaatcccagcacttggggaggccaaggcaggtggatcacatgaggtcaggagttcgagaccagcctggccaacatggtgaaaccctgtctctactaaaaa

SEQ ID NO: 153169 - DNA, 399 bp, Homo sapiens
tgtttgcaatgacttctgacttctctcttgtttacttctcctttcacttttaacccccctttaccctacttgctgatacttagttctcatctgctatcttgtagcacacagagtttgctactatagtttgggccaaagttggatcccctgatgactctgtacattctcctggctgtacttttcttcacataatgtctatgaaacattacttttatgtgttctgttctccgagaatcctgctgactagagaaacattatacatactcataactgagtattaatagttgttaagggttgaatggtttcactctcccagattgtgtgtgtgtgtgtgtgtgtgtgtgtgtgtataatttcattatataacaactaaaaaatgtgtgaagagatatttagata

SEQ ID NO: 153170 - DNA, 344 bp, Homo sapiens
tgggggttatgttgttggatgcacgtatctttattattgttatatcttcctgatggattgacagtttaatcatcatgaaatgtcctttgtctctaccaacaatttttttttttttgagatggagtctcgctctgttgcccaggctggagtgcagtggcaccatctctgctcaccacaagctccgcctcctgggttcacaccattctcctgcctcagcctcccgagtagctgggattacaggcacctgtcaccacgcctggctaattttttgtatttttagtagagacggggtttcaccatgttagccaggatggtctcgatctcctgacctcgtgatccaccca

SEQ ID NO: 153171 - DNA, 362 bp, Homo sapiens
tccctggtgtatcactgtttctggtggcatacaggttgtggttgtattcccggcccttccacttgttactgattgacaagggcaagttagttaatctctctaggcctgtttcctcttctctttaatggggttaattacctagttcatagggcggttgtatgaattcttttgttcagtaaatatatgccatgtatgagatatgatgctggggatatagtggagacaccagttgctatacaggatccagatgtgaaacaggtcagcagagctgaatagatgagtgtttgaaaagtgatgggaaggaaacaaataggatgtagtggtagcgaatccatattgaattgggcctctattctgtgcag

SEQ ID NO: 153172 - DNA, 256 bp, Homo sapiens
tttccccatctgcaaaatgagaccgtgcccagtgagtctaaatcatgtgtgtgtacgtacatgtgtgtatgagtgtatcagtctcaggttatggcctctgcaacttacaaccattaattagagctttctccttaatctgattgttcttgaatgttatgaacctataatactttgtccaggccaatttctgaattttcctatgaaatttaaaatgatttaacttggaactcctagcagcctcttgcaggaaaacatc

SEQ ID NO: 153173 - DNA, 525 bp, Homo sapiens
agcttgcacagtagaggcaagtgttataggaggccagaaaagggagatgaacatgggaagcatagtcagagaaggcttcatggaggaagcagggcccagaattgggtttaatttgagtttcttcatccaaagcctggtgctccctttcttgattgcaacccttatgcagtactgccagggcctcaggttaagagtcactgaaggtgactagtcttcaggaaaatttcataataatgaataaagaaaaagatgggaagcagactctggtcccattctattgcagtgtaaaggagccagccaaggcttaatgtctaaataagcagagcctctggcatgggcagcaattttgccaagcagcaaataatttgtaggaccaatgaaaagtaccccaatcatagttctgtaacctgaaattattggaaaagcaagatttagcaaagaatctttactttatagttgactttaatttaatatatagaaggatagcaatgagagccaggcatgatggctcacacctgtaatccc

SEQ ID NO: 153174 - DNA, 328 bp, Homo sapiens
tgccatatccacctaacagagtattttatgtagccactaaaataataagaatatttatcattgtagttacagagtgatcggagtatgtagaagcagagaatcaaaatctatgcttaaagacagaggaaatacatggtaactctagttgtgtctctctggatgatgatattatcggtgattttcttttttagtttttttatcctactgttttctatttccatattttgtgtaatgaacatatttggctcctatcatgtgtgaaaagattttttttaataaaaatgcctgggacccaggctagttaggaaagatgggatacatacagtaa

SEQ ID NO: 153175 - DNA, 168 bp, Homo sapiens
tatgcataggaatgttgtgttgcatgtgtgcatgttaatctacctgtatatgcatgtatatgcatgtgcatgtgtgtgtacgtgtgagtgtgaacatctgtgtgcagtgtgtgtatgagtgtgcatgcatgtgaatgtatgtggatgtatgactacattgagtgcatg

SEQ ID NO: 153176 - DNA, 475 bp, Homo sapiens
gctgactgttcctttgctgtttgtctactttttcccattttgtgctgagactcatctttccagcacaaacaccaggatgaggaattggaattttagtgctggaagtctccggaactatgatctagtgctcattccctctgatcccattgccctgacattatctgatgcttccacagctccttgtacagggaggtgtggagtcgggagagcatcagcctgtggtacagcgctgcccacagggaaggaagaagacatggcggggacatggcctgactcccgatgtgctccttcctgtagggtcttccacatggctgggctccctcccgtcccagcacacatcctgggtccatgtgaccttgaacttcacaaggtcaaatctgtgcagatccaaatggtgtgtggatctaattttcttcctcaagaagccttgcacaatctggccctgcatgcttcctctgagcccacacttcctgtg

SEQ ID NO: 153177 - DNA, 416 bp, Homo sapiens
gaggcgagttgcggggaagctggtggtagtgaggtgtggtgggagcagagtctgtcccgccgtggcctaccccactccaccctgccctcgccgtgcggctatgtctagcagcagcctctgtaggtgtctggcaggacgggaacaccaggcctcatctggcctcccaaaagcttgggctcctggaggtgctactgtggggatctgtcttaggctgagtgtcagccggcggcaggtgaccgcctggcccttgcagtccctccaggaccaccacgaagcacgacgcacatcctggagctcgccataccggctcccaggcctcaccctaggctctagggtgttgggcgccgcctcttcagggacctctggcccaggctccagttccctgcggatctgatgtggaggaaacagctgtttcc

SEQ ID NO: 153178 - DNA, 163 bp, Homo sapiens
ttagatttgagcaaggggtttttgtctttttgtttttttccttttaaatacaaagtcttgttatgttgcctagactggtctccaactcctgggccccaagccatcccagagtgttgggattacaggtgtgagccaccatgcccagccatccttttcttacttt

SEQ ID NO: 153179 - DNA, 475 bp, Homo sapiens
gtataggttgcaaatatattctcccattctgtaggttgttgtgctctcttgattgtttcctttgctgtgcagaagctttttagtttaatttaatgccatgtgtctatagttgcttttgttctctgtgctttcaaggtttaagccttgtctagaccaatgtcacagagcttttctcctatgtttttttcctactattttcatagtttccgatcttacatttaaatctctaattcactttgaatttagatatttcttaaaagaagacatacatacggctagcagatatatgaaaaaatgttcaacatcactaataataagggaaatgcaaatcaatcaaaactacagtgagaaatcacctcactccagttagaatggctactgtcaaaaaatcaagacagctgggcacagtggatcacacttgtaattccagtgactcaggagactgaggtgggaggatcgcttgaggcgaggagtt

SEQ ID NO: 153180 - DNA, 250 bp, Homo sapiens
tagaaacgtttttttcctctctacatgcacaacccgcttacagcatttttcacccaggactatagttatcttttgatgcattaatttccttacccatgtcaagctcctaaattgcaggaactgtaggaactgtatcttgtactcatctctggtatctaatatgattcccagcacacagcagggactcccaaaatgcctgtggaatgaaggaatgaatgaatgaacatttcaacatacagctagatatttc

SEQ ID NO: 153181 - DNA, 382 bp, Homo sapiens
agattttctggcagagtaaagttttaagaaaaacagttattgactttcaaagacttttcctggctgtcttctattgtatgagtatcttcatatagaatctcaaagataagaagaaaagaagcaattattgaagatatagtagatttttttaactagctaacaagctgtgcaagtagtggaatatcttgaaactaacaatgagaagaggaagtcattatctcagatagctaatcaaagtgaccacacttctaaactgaccacgcttaattagttatggaaagcatatttttcaacccgctatgttaacttttacagaaaaaatatcattcagttaggaccctgtggcacataagaatattttttacaacagttaaacaaagca

SEQ ID NO: 153182 - DNA, 430 bp, Homo sapiens
taaggaaaccttgtgtcaaggatcatggaaagtatttgctttaaaggtctcttatcgcatattgagtgatattaatatacattgttattatttatttaagggatgtgatttattatactacttttttccatcttcattctgcacctccttttgtgtaaacaaatgttctggtaaactctaaatcagaaacttatgtaatagttttgaataattccttcttcatagtatacctttctattggagaatagacacgtttcttcttttttttttttttttccgagacacagtccccgctgtcagccaggctggagtgcagtagtgtgatctccgctcattgcaacctctgcctcctgagttcaagtgattcttccacctcagcctcccgagtagctgggattacaggcatgtgccaccacacctggctaatttt

SEQ ID NO: 153183 - DNA, 237 bp, Homo sapiens
ggccccacctccaacatgagggattacaattcaacatgagatttggtggggacacatattcaaacgatatcaagtacatttttaaaaattaccattttcaggtggcagagagaaacatttgcaaaagagaatagacaaatagctaggaggtgagatcaggtagagatagcttgctggcttagcctggaaaaatctgtattaataacgccatcaacaacagtgtctcttctgcttccc

SEQ ID NO: 153184 - DNA, 761 bp, Homo sapiens
gctggaaatgctggacgcagggatgtgcggcagaaatgcatttcaggctccctttcttgtgattgcttcctctcaaaagttccagcctggtcagggtgagggaggtaagcacagcctctgactctttagacacagttggcttggcctcccttaagaaggtagaaactacattttaaagctattgaagggatttcaagccttggagagcagatgaaaccaagtatgtggatgctcctctgtccacagatcaagatcaagctgaccctacctattcagataaaacaagcaaaaacttgcaggcaaattcccaaggtgcaagggtcacagtagaagaatgtgggtccttcatcctttcctgtaccttgggacatggttcaggcatgattgaggcaccctgggcactgaatccctaccttgggttaggccctgtgcaaatactggaaacacaaaaatgaattgaaaatgactcatacctagccgggtgcagtggcttacgcctgtaatcccagcactttgggaggccgaggcaggctgatcacttgaggttgggagttggagaccagcctgaccaacatagtgaaaccctgtctctactaaaaatacaaaattagccaggcgtggtggcgcatgcctgtaatcccagctacttgagaggctgaagcaggagaatcgcttgtacccgggaggcagaggttgtggtgagcagagatcgcaccattgcactccagcctgagcaacaagagtgaaactctgtctcggaa

SEQ ID NO: 153185 - DNA, 400 bp, Homo sapiens
cctccctctttctctccctctctccctctctgtctcttctttctttgtttttttgagacaggatctcagtctgtcacccaggttggagtgtagtggcatgatctcggctcgctgcaacctctgcctcccaggttcagatgatcctcccacctcagcctcctgagtagctgggaccacaagtgtgtgccaccacactcggctaattttttgtatttttgttcgagatggagtttcaccatgtggcccaggctggtcttaaactcctgagctcaggcaagtcacctgcctcggcctctcaaagtgctgggattacaggcctgagccacggtgcccagcctttcccacgatttatatgtgtggtttaaacctaggctccttcccgtacggtccccttatctca

SEQ ID NO: 153186 - DNA, 578 bp, Homo sapiens
aaactcctactgatgggcccagttgggcctcatttctaggtggatgattgggcaagacccctactgacaactgattccaagggtccccatccagagagctccctgggccacagacaacccgttaatttcacacacaagggttagctctctttcatgttgagattcttttccaggtaaatttgcagcatatttagtcacggggaaacccggtctcttccggcaattagcccccagttcagcttcggtgactgtcagtgccccattcaccctcagcctgagtaatcacgtgtcgtcatgcacaagggttatctaacccttttccaacaatggcacatgtggtgacctccctttatcacttagaataataatttataccagttggcacaagggatgcactagtccctgctcttttgatcttcagactgaaaataatttttcttctaaaccatcactgattgatttttttctttcattgttttatatcattgagataagacaatggtttgagttcaagtcctaactctactatttactaagtacgtgaccttggccaagttatttaacttctcagcaattca

SEQ ID NO: 153187 - DNA, 283 bp, Homo sapiens
ggtggctggagacgactggataacaccagtccccttggcatgacatcaggcagcatgcgtggcatttgtgtatgtgttgggcagcacactttctatgctgggaggcccacagctgggatgagcccatgtgacctgacagctgccctgtgggcaggcagagtgggggggctattgccttcaatcataaacgaggcttctgaggctcagggagaggaacagacttgcccagggtctcatttccagttagtgatggagttgggttccaatcccagtgctcttggct

SEQ ID NO: 153188 - DNA, 501 bp, Homo sapiens
tgttaatcgatgccacctgcatcgcccgtgtgccaaatggagttcaagactctgcactgttccccattcatccccacgagaggttcagcagccactgccgctaaaacaaaagacggatgacaggaaaacccgctggcctttggcccattccctagcaaaggggaagtgtaaaagtgcaaaggggaaagtgggccagctgcactaatccctctttgtccagcagtaattaatagtataatccacatttcagatgcattaaagcgaaaatgctgcattatcagagagcccggcacacagcctcagggcagagcctccctgctgacctgcagaaccaggttacctcatctcagcctcctcctctcaggggagctgactctagacacctcataaaaggaccgagctggcagccagaagtctccactctgcctgatgtgctgtgtctgtcttcagaaaccacccactccagagccagtcctttggagtgggtggcatcgataaaca

SEQ ID NO: 153189 - DNA, 491 bp, Homo sapiens
aaacatccacataaagggattgcaaatggcatatttctttggaaagataaaaattaaacaaatatttttacatgaatcagggcataatcttcagtgtgagcctccatctatcactttgttcaagatgatttttcaactatcttcttaaaatcacttgcatgctaaaattgattcattgtgttcataatagactttgtgttaattcaaggagtagttcttctaatatatgtctaatttttgttgtatcaaaacatattcagaatctccaaggcaaagtaaattgacatcttttccttttatttatttattttgtgacatcatgcaagaaaaaggcccagaattgtgactattttttagtgttttcccctcaagagaatataatctgttcaactgtatattgttatgcttgttagtgtttctgttgaaaataagattaacattttcatagataacaatgtatggggtgattttctttttcagttgtttatata

SEQ ID NO: 153190 - DNA, 393 bp, Homo sapiens
gagtggcagttttctactgatagtttagccacactttacaaagaggctccctgcttttttctcttccttagttcagtctgggaaggcgatggtccgacagggctggtggggtcttcggagcccaccaagtactgtgctgtatggacaggcctgcttgggaagggggccgcggctggcagactggggcgtgcggtgggcgttgggggagaggccaccagttagcccgctcccccgccccttgcttgtgcgtggccttttcgaactcacctcacgtctcacaccgaagtcatctgccctggtattggtggtaaatattggatgtatgggcttgctgtctgcaaagcgcccgtgctctgtgcgtctctttgcacatctgcacggccctgcggccgc

SEQ ID NO: 153191 - DNA, 407 bp, Homo sapiens
tggtgtcagaacagtttacaaggatgcagaggtggaaagtgcaggtgcaagtctcagatccacagatgtgcaaggctgctggaaaacaggatgggggcttctgtggaagcaccaagtggtccctgtcactggcaccttccaggcagacatcactggggatactgtagacgtcatctctctaaaatcagttctgatttgaaaactccattctatgtgaagaatgtcaataagtatttcttcactatccattagttttctgctcaacttttgttctttataatgttcaacaaattttgagcacctaagagcatagctgctagaatgaaactccctagactgtattgttttgtttgagacagggtctggctctgttgcccaggatggagtgcagcggcgcaatcatggct

SEQ ID NO: 153192 - DNA, 288 bp, Homo sapiens
ggggcctgaaattctgcataatctgctgctggcttgtggactccagtttgatttgcaagactctagactccagagatagagcacttatgcaagtgcttgggagttctttgatttgaaggggtgtgagcatagtcgagtagaatttccttaaatgctttctaaaggccacattcagacttgtggtaaaaggattactagcagtttttcattgtgtcttgttcacatgtgtgctgcatgagtttttacacttttttttcaatctgctttaggatttttagaattaaaata

SEQ ID NO: 153193 - DNA, 350 bp, Homo sapiens
tccagtgtgcggttgccaagcatgtgaatgaggctttcctgagccacagcttccatggcgcatgccggaggaaccctcgcatggaacctaagggcgccagaggcggagttggaggcgtggtattgggggatcctggggatgcgtgttgggggctgggtgggtgctaggagagaggaaagaactggacccacctggaagaccagccaggtgtgggtcagaagctataaacatgagagggctcgaggaattctcatagtgctttctggagccggggaaaagagggctggccaggaggcccccacgtttctctccaccatcctgcagtcttcattttccctccaaatgggagg

SEQ ID NO: 153194 - DNA, 156 bp, Homo sapiens
ccgaggttgtgccactgcactccagtctgggtgacaaaatgagcccctgtatcaaaataaggaaaagaaaaaaaaaattgtcccatccagtaaaacatgtcactagctgccatttccccaggtggatggctaacggaaatacgggcctgctaaaaa

SEQ ID NO: 153195 - DNA, 355 bp, Homo sapiens
aaaaagaggttttcttgtgcattgggcacggttaaagtaggagtaggaaaagatgcttggctaaggataaggagaaggtgggtttccaaaccattggacactgccacattctttagcctttttttttttttttgagatggagtctcactctattactcaggctggagtgcagtggtacgatcctacctaactgcaacccctgcctcctgggttcaagcgattctcctgtctcagcctccagagtagctgggattgtaggtgtgcaccaccatgcccagttaatttttgtattttagtagagacagggttttgccgtgttggccaggctggtctcaagaactcctgacctcaggtg

SEQ ID NO: 153196 - DNA, 173 bp, Homo sapiens
ttttactttgtggtgctctcatctgatctacccaggtcagccatgaatttaagccactggtggactgtacatcatattaatgctatcagtttctgagctcagcacttccttaatggtgttgttcttcagctctgtagaaaaaagctggaaggccagtaaaatgagtagagaca

SEQ ID NO: 153197 - DNA, 957 bp, Homo sapiens
  misc_feature (163)..(163): n is a, c, g, or t
  misc_feature (167)..(167): n is a, c, g, or t
  misc_feature (170)..(170): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (184)..(184): n is a, c, g, or t
  misc_feature (186)..(187): n is a, c, g, or t
  misc_feature (192)..(192): n is a, c, g, or t
  misc_feature (197)..(197): n is a, c, g, or t
  misc_feature (203)..(204): n is a, c, g, or t
  misc_feature (207)..(207): n is a, c, g, or t
  misc_feature (218)..(218): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (239)..(239): n is a, c, g, or t
  misc_feature (247)..(247): n is a, c, g, or t
  misc_feature (264)..(264): n is a, c, g, or t
  misc_feature (274)..(274): n is a, c, g, or t
  misc_feature (281)..(281): n is a, c, g, or t
ctgaccttaggtgatccgcctgtcttggcctcccaaggtgtgggattacaggcgtgagccaccaatcccggccaccagctaaatactttcgagtggttctataattctgtaatgaacagttacccaagactccgtctcaaaaaaaaaaaaaaaaaaaaaagantttnttnctttnantntgggntnngaaanacagnttgggnnccnttttttttctnttntcnttttnccccgaattnccgagaantgggggcccaaaggttnggggcctttnaaagggngcttatattaattcgggcgccggggggggggggggcaggacgggcgggataatccccaggccttgggaggagggtcgtaagagccgggggggtcaccacagagggtccgaggagagttcaaacgacaccaagccgtggaacccaagggggtgggagtgaaaacctcccggctgcttcatactaaacaaagtggccaaacaacatttacgagcgcgggggggggtggggggcgtgtgccagcctgtgggtggtcccccaggggtgtactccaaggagacgccgagcaggcagaaggaaaaaaaccccgttggaaatcccatgggaacacagggagggttggcgagtggagacgcgaaaaatcccccccgggggacctcccaaggcgttgggcgcgaaacaacaggggcgaggcgcgggggctcttcaaaaaaacaaagcggggtggtaattcaccgggggggcggcgagcgggcggcggcaacagaggaatcatttcggcggacaaacattacaacttaaaatataaggaggtaaccaattactgagcgaggggaacaacaacttggaactcctgtgtattttaatattataaccctttggagaagagtttcttttgtgtacgagacacaccctttacgggggtatatactataaggggtttccttttaatcgggct

SEQ ID NO: 153198 - DNA, 120 bp, Homo sapiens
ccctgtttacatttttgtgctctcttatttttgtcaaaaaataaggacagatcttaaaagagtatgagaaataaatgttgagtgttttggctgcttctctaatcatgtgcttgccatgtt

SEQ ID NO: 153199 - DNA, 142 bp, Homo sapiens
tagacacacgcatacatacacaaacacacgcacgtgcgcacacacgtcagctcacactagcaaaggggtgtgagctcaagcattatcggacacagactcctacacaccgccactggctcgaaagcgcccacaacctcttcca

SEQ ID NO: 153200 - DNA, 205 bp, Homo sapiens
agccccctcccaggataaggccttagacttagggactgggcaagtctagggtcccttaccaacctcacagactcattgtgctactagcaaagcttctcatccctcagagactcaattttaccatctgggcagggtgggcttgttcctgtaccatacttggtgcaaagactctgctagcaaatgactttcttgggtatcttggcat

SEQ ID NO: 153201 - DNA, 264 bp, Homo sapiens
gtaaaatattcagttcttatctaggcatactgacaaactggcatgagaccatagaaagacaactaaaatagtaactattctggggactggagggaagcagatataacattaagttcctatatatttgaaaggctgtctcataaaaaaaaaaaaagattgagttttgttaaatcaagtatgtaaaaattagaaaaagcagatttcagttagacataaggaaaaaattgtattagatagaactgacaaaatgatagactagacatt

SEQ ID NO: 153202 - DNA, 144 bp, Homo sapiens
tgctgggactgcaggcatgagccaccatgcccagcctaatcataggtcttctaagtccaagttcagggctgctctttcttgcaaaccataatgcctccttctgtaaagctgcattgaagacttaacatggagggttaaacagaa

SEQ ID NO: 153203 - DNA, 400 bp, Homo sapiens
cctcaaatacttctcttaggtcttctgctcacatctttcaggcagagaacatctatttgatgccaaatgtgtggctagaactgggccaggtgctttacatgtcatagatcaataccaaacaactagtgaaatcagcacaaattcaaccaatgaagctcttaaaacaataaggtgaaaaaccacattgttgaggagagccatacaatacagtcaggttctagttcaaattacgtttctttccttgagatcttctggtccatgatatgttttgatctgtctaaaatattatgtaggcattctcaagtgattaagaaactccggattgtttcaaataatcaggtcttccccaggcaaacactggagatcacttgttttttgtttgtttgtttgtttctgagat

SEQ ID NO: 153204 - DNA, 423 bp, Homo sapiens
tgggggaggcggtagatagaaaggcagttttgcagtacatcttagaatgatcaggccatggttaattcctatccacgccactccacagagagagctgggccagctcttggtaagaatacattagaaccggctggcagcaaaggtgacccctagctcaccctccaatcccaaatcctcccaggccactgagccatcaggcttaggataggataccctttaaggagcagccccagagcctggctctggacttccccacagggacacaaacagggcaggccagggacaccctggagagcccacgggtccttcagcctggagggtaatggaatccccagccacagacttactgcttagctctcccaccagacttcgcataatcctcatcctcatggcaccccccaatccccaccagctggcttcgga

SEQ ID NO: 153205 - DNA, 852 bp, Homo sapiens
aaaattcttatggccacttagctagaaaagatctcatccaaatacaataaagaatatgaaactttctggcaatgtattacatagaacagtaacactctttgtaataaagtgctcatttgagacaaattaagtcattctcttagcccccttttcctacttgactgaaataaaatacttgctcagttgacaaaaaccatcaaataattcacattttagttgtaatttagtttatactagcttgtttagaaataaagtcagcaaacattatctgcatcataaagtgtgaatcgcagttagattattacccttcaatgcattgcttggtaagagggctactacatatctcattcctgaagaatttgttcccacaatcaacccaataactaacatctgtgtatcacatgttatgtaagtactcaaggtcctctattccatgtgatcctcacagcaatctcataggctacagaggttaagtgacctgctccaggaaggaggtggtcaatggcaaacctaggactggatcccaggtctttcacttattctattcatttaacaaacatttattgagcaccaacttcgcttatcactgaggacgcaataaagaacaaggcagtgaaggtcttgtttcccatggacttgacagtcaagtgggaaagacaggaaaactaataaaaccatgattaatatagatggaagtaactgagcagctactctagtccccaggattcctcctcttaatgtgtcatctttttccccatcagttgggtcccacccccacagaagcaggccacactgaccactcatgccaacataatcacaataaggcactttttggactttgggggaccgagc

SEQ ID NO: 153206 - DNA, 443 bp, Homo sapiens
agaaagaagggaaaataatgaccaaaatttttccaagtttgatgaaaactataaacccacaaatccaagaagctcaattaatcttaagccaagaaatatgaaaaataactaaccaaggcatatgataatcagactcctcaacaccagtgatgaagaggtcttaaaagcacccagaaaagaaaatgacattttccataaaaagtaagatacagataataacagacttcttatcagaaacaatacaaacaagaatacagtagagtaaaatcttcaaagaacaaaggaaaaaaaaagccatcaacctagaattctaaacagaacaaaagtatccttttttttttgagatggagtctcgctctgttgcctaggctggagtgcagtggcacgatctcggatcttggctcactgcaacctctgcctcctgggttcaagcaattctcctg

SEQ ID NO: 153207 - DNA, 335 bp, Homo sapiens
aagaaaataagccagaagaaaagtattaattcatggtgcagaacttgagaatatgcattgaacagctgcaccgtaacacttagcctttttgttcacatgaagttgctctctggaatcctcagatagctgtagttgcctgagggctcttcaaatgtcaccagggcaacaataaagtaacacacatgaagcaggccctctgtggcattctttatgaaaaccattgaattaaattattgcataacaaatcatctgcatatgaaaggcagtgaactgttagagaacccagctgaaacaatgctgaatttgatgcctacctccactgataactcactggc

SEQ ID NO: 153208 - DNA, 783 bp, Homo sapiens
attgccttggtgagaatttctaatactgtgttgaataggagtggtgacagagggcatctttgtcttgtgtcagttttcaagggaacgcttccaggttttcaggtactcaggcaacaaatagcgttacaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcacgaggcagatcaccaagacagaaagtcaacaaagaaacaatggacttaaactataccctggaacatatggacttaacagatgcttacagaacattctacccaacaagcatagaatatacattgtatacatcagaacacgggacattctccaaaatagaccatatgatagggcacaaaacaagtctcagtaaatttaagaa

SEQ ID NO: 153209 - DNA, 211 bp, Homo sapiens
ataccttctcctcctatgtgctagcaccctaaacttaacccagcttcagtgctccatcctttggccgagtgatgatgatttctcacctcaccctgctgatgcctctctgcctgccatgggccagaggtgggattgtagttgccagggctccctactgtggcccacctgggtacgagggcttgtttgttcctctccattcctctgacactca

SEQ ID NO: 153210 - DNA, 445 bp, Homo sapiens
aggtatgtgactagtgccgaggatctttttttcatcatgtctattttgaatcacaaaaaatctttaataaaggacttatttgtagaaatcaatccaggaaactttgaagctgttataagatttgagcctcataaataggaatttcagagatctgtcctccagccagttctatgatgcatgaggattagtccttggaaatactgagaatcaaaatggtattagaaagccttttcataatgggaaagacagaaatgagataataaaaaaggaaatgtgaatggtaactaatacagatatgcttaaagtaaacagaaagtaaaaggcattatttattgatgcattacataatgtctgacaaagtctagcatatgagcatattgttcgtagattgttgatagagaatgtgttgagatcagttaaattcattgagatagactaagtagtc

SEQ ID NO: 153211 - DNA, 570 bp, Homo sapiens
ttctgtctcaaccccccactcttttcattattctaactgggaacaaaatatatggactcagcattgttttagagcctgcagctgcattccatccacccctcccccccttctttttgcagagctctccccagctctttgggacttagtaaaaacaaagagtcattactggggagagagtgggttggcacagcccacagggaagacgcagggccaccgatgtgagggtcttctgtacactgctcctctgtttttctcgagagccatgataatttaatgttgccttgctgattgctttaaatcctctctgaagaagtatgcttacagatttttttcctatgtgaaatatgtttagggctttaaattaatagatttaaatttaaattttccacaaaggatacttttccttaatgagaaattttatttgtctttttacatcaaatatgactgaaattgtaccttaactgtcatgatactgtcatatataggcatatttgacgtataactaagcattgttaaaatatcgttttaaaactgaacatataatgttaaaatcattttctgtttccctga

SEQ ID NO: 153212 - DNA, 274 bp, Homo sapiens
gctcctggccagattttaaaaattgggacatttcatatgaaaacactaatttgtggttttgtttgaaaattggagctcagtagtagctgtccttttgagtcagagcttgtacttgcctgtacgtaactcctatgagaccaatttcactttatctaattggtcatatacatttttaatttttatttttttgggtcagaatcttgttctgccacccaggctggagtacagtggtgtgatcatggctcattgcagccttgacctcctggacgtaagc

SEQ ID NO: 153213 - DNA, 365 bp, Homo sapiens
tgtacagagcagttagcatatacatatagcatatagcctctggaggtcagaggtggcaggaaaggggcaaactacctgagcagaggtgaccattcagtgagaaggggcaggatccctgtcaagggaaagcacagggcctgggccaacttgtctgtggcactgctcagatgctacagctgacatccttaacagtgagcctgcgtcctacaggagaggtcacgcgaatcactaaattcaatggtgccggctggaagtaagttccttcccgagtgctcctcctctccccgacctctgcagcttggtaaaggcaacttacggactgctgccaacatgtccctccagccttgtatcataaccttcccctg

SEQ ID NO: 153214 - DNA, 651 bp, Homo sapiens
  misc_feature (381)..(381): n is a, c, g, or t
  misc_feature (384)..(384): n is a, c, g, or t
  misc_feature (390)..(390): n is a, c, g, or t
  misc_feature (394)..(394): n is a, c, g, or t
  misc_feature (396)..(396): n is a, c, g, or t
  misc_feature (399)..(400): n is a, c, g, or t
  misc_feature (403)..(403): n is a, c, g, or t
  misc_feature (416)..(416): n is a, c, g, or t
  misc_feature (418)..(418): n is a, c, g, or t
  misc_feature (423)..(423): n is a, c, g, or t
  misc_feature (425)..(425): n is a, c, g, or t
  misc_feature (428)..(428): n is a, c, g, or t
  misc_feature (435)..(435): n is a, c, g, or t
cggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgggcacanaanacaaanaaananaannaanaaaaaaaagaaananagaananganagaaaanaaaaaaaaaaaaacacaaaaaggaaacgaaaaacaaacaacacagaaaaaatcaaacaagaaaaagcaaaaaaaaaaaaaaaaaagaaaaaaaaaaccaacaaaggacaaaaacaacaaacagacacaaaagagaaaaaacagatacaaaaaaaaacaaatagaaaaagaaacaacagaacaaaaataataaaaaaaagaaatataaataagaaca

SEQ ID NO: 153215 - DNA, 633 bp, Homo sapiens
ttatgaaggggagatatgtgctgttataaataggggattttataggggtagaataggggactttgatttgccaggaaaggctttcctgaggaaatctccgaatttaaatctcattgtgggctgagtgtgttggctcacacctataatcctagcactttggaaggctgaggcaggaggattgcctgaagccaggagtctgaaaccagcctgggcaacaaaatgagaccctgtctctacaaaaagtaaaaaaaaattatctggtgtagtggtgtgtgcctgtagtcccaactactcaggaggctgaggatggaggatcgctggagcccaggagttggaggctgcagtgagctacgatcatgccactgcactccagcctgtgtgagagggcaagaccctgtctcaaaacaaaaacaaaacaaaccccaaacccaaaactcaaacctctctgcatcaccctaatctcactctactccttaagggcagggactttgtctattttatttgttgtgtatccccagttcctagaacagcacctggcatgtggtaggcactgaagtgaaggaagatgtgattgatctgaattctaaagggagaggaggagttaactgtgagacgaaggagagaagggacttc

SEQ ID NO: 153216 - DNA, 232 bp, Homo sapiens
ctaaagatcacaaatacgctatacaaataacaggtgctacagctctttcccagtccctaccagcaccacaagccaattatgttgcttattgaacagagttgtcttttctgcaaaactagatgcaaccacaccatcctaaaaacaggataatggctgttgccagtcagtcagagttggcattcgcaataaaaatctgtttttcagtcttttcaaggctggtgtagtagaaagc

SEQ ID NO: 153217 - DNA, 495 bp, Homo sapiens
tacaagtgtcctttctctgaaagatttgtgtgaatatcaggtcacatccctttgcatgggcatgctgactgtcctgcacttgggtattaatatacaagtcttctggctgcccggcttccttactgatcttatctcactatgttcaacttcaaactcttcttcgatgtcaagcacttgccagtgatgccactcctcacccctttgaattccaacaatacaaatgaaaccaagtcaggtcgttgctaaatttcgcttggtattactgaaggagggcagacagaaggtatgggatggtagtgtccctgagtctgcctgaggcttccctcactgccccgtttattcagctcaagattccagtgctgtcggaggtaacgtgagaccccggtaatggtgttctttgaaattctcaagtaaggtaaaatctcgtttttggctataatttaaaatcagatgtcagtaagctgataactgaactggccagggcttctctgcact

SEQ ID NO: 153218 - DNA, 106 bp, Homo sapiens
taagtcatggggaatgaatactttgggcagtgtcttcctgatgtcttcttagctaagaggagaaaaaaaaggctgaaaaaatagggaggaaattccttcatcagaa

SEQ ID NO: 153219 - DNA, 673 bp, Homo sapiens
ggtttatcatatatattaatctcagaaccagtttttggctttttctattgcaattgattttttaaatttttctgcatttcacatattttggtatgttgtgctttcattttcattctattcagagtattttaaaatttccctctgattgcttctttgatccatgacttatcaactagcattaattcttttttatttttgggggtaactggtatccagattgtgttctatcttggttaatattctatgtgcactattgtgtatggggacatgatgttctatgtatatctaattaggtcactgtggtttattgccttgttcaaatcctctggatctttgctgatttggtggaggcctattccatcagttcttgagagggcattagatatccaaatataattgtgaaaattatctgtgtttccctttataccagtttttacttcattcatttagaagctctgataattagcttctaattatttaagattgttatatcttcctgatataacacatttaagattgttatatcttcctgatagagtggcctatcatgaaatgtcccttttgtctctgggaatactcttaccttgaaatctctcttacctatcatttatatataactgcatcaaatttatttactgtttgcacgatgtatctttttcttggcttttaaaat

SEQ ID NO: 153220 - DNA, 466 bp, Homo sapiens
ttaggtcacaaataaacccttcagaagaaataaagtaataataaaataaagagatggtggaatagatgaaaagatagatcatctgactctgttccctgccacgtttggaatcctgttgagaagagagagaagaagcaactacatacgggggacatatccatcacttgagattctagctgacgacgtccgaatatatctcaactcacaaagtaaacgccagatcatatgccatgatgacttaatcatgttactataaagaaaatatttaaacaggagagattttaaaaattgcaattcatcttgtgacaaattacttaaaataatatatttgcctggaaagaacacatctaatttatatattagcagacactgttgtgcaccgtggtgagaagggatatgtaagtgggatgatgacttttcctttctgtaaagaggtttctatttttactttaaagaaaacatgttc

SEQ ID NO: 153221 - DNA, 114 bp, Homo sapiens
gctgtttccctgtttctggaaaaatactcagtgaatgaggtccgagcacatttgggaggtttattctaatccttcggctccagccacccaccgccgcgccttccagagggagcc

SEQ ID NO: 153222 - DNA, 451 bp, Homo sapiens
tggcattttgaatagctggcctctgttagaaagccttccatggattttatgaatcctagatcatcacatggccttccctttctctttgagcatgggggctgcctcagtgtcgcttggctcctaagagagtgccttgtgctgatgggacacaggaccagtttgatgactacgtgcacagatgaagccaaacctcttgcccatcatctattccacccttcacatccctcatgccctggttccacttgaacccagctgcctcacacatcctttttgcttacaaatttcctagcttgtgaccattctccaccacctccccccaagttttaccattctctatttgtgccctacaacggctccaccctttgaaataacgcctggtctaaatgttactttttctagtgggccttccttgattatccatcccactgtgattccttttcctgccccatag

SEQ ID NO: 153223 - DNA, 374 bp, Homo sapiens
ccatgtcccctgtagcataccattattgtcatcctttaatgataataataataaaagtggtttaaaacactttggagttcacaaaacctctttacaacacaataaaacccaaaattattccaactattgcccctccttgcaaaattctccaagttaaaaaaaaaaaaaaaaaagtatgtccccttccagttaagtcttctctctatgcttcctttctccagtgaaggctgtccacatttgacatctccaccacctcatcttctatcaatttcccaaaacactgcatctaacttgagttcactccactgaaactgtcctccctaagtcacagatggtttcttaaaaactgagccctgtttggccaggcgcggtgg

SEQ ID NO: 153224 - DNA, 317 bp, Homo sapiens
gtggtggaagagatgccgccctacagcccaaggccttatgcaaagcaggtgaacagaagccacccccaccccaacctggtctttcctgaccctgtgagccccaaagtctgtagtgagcccctttccagcagaagccacagggacatgtaggctgccagggtccagggtgtcacgaggaccccgtgcctggcaaatcactgtgacaagcttggctgaaacagtaccccctgggaggaaggccttgtttttccttgtttccctgggatccttggaactgctctggagctgctggtgaggaggagggcggtgccgtgacc

SEQ ID NO: 153225 - DNA, 475 bp, Homo sapiens
caggacttggagactggtgagacaggttatggaagagagagaagaaaggcctggctacggagggctgtcttttaaatgcagatgaaaccctgatgggtaggggctctcagaaagaataaactttcttttctttttatttgagatggagtttccctcctgttgcccaagctgaagtacagtggcatgatttcagctcaactgcagccacccctcctgagttcaagcgattctcctgcttcaccctcccaagcagctggtattacaggcgcatgccaccaagctcggttacttttttgtatttttagtggaagacagtttcaccacgttagccaggctggtcttgaactcctgacctcaggtgatccgcctgcctcggcctcccaaagtgctgggattacaggcatgagccaccgtgccaggcctttaaaaacattttttctgagaccgagtcttgccctgtcagcaccttccacgg

SEQ ID NO: 153226 - DNA, 666 bp, Homo sapiens
ggcatggggaggtcagagtctgctgtgagcccgagtctgtggacccagagctgcagccacccagatacaactcatctcagagctccaaaggccgatgagccctgtcaaccccctaggcctggtgacaatggcactgcaggtcacagcccctgctggaaaggctgtgggttccacggctggctccagttacaaaggccctaggacctggcctagtagagcgtgggcatccagatgtcagagtgagggccacccagcattcctggagacagatgggtctgtcccaggctgccagataccatgggcagtggttggcaggtggctgaggtccatgtgtggcaccggtgggaagtaagagctacatccaaggtgagtcagcagatccaaaccctcagcctccctgggaactctccccacccttcccagtggagctccaaagtccatgtaagcaggcagcattctaggcctggctgagttcccaacccttctgacgtcaggtctggctgaggctctagctggtcctgttggtctagaagactcctgatgcacccacattccagggctggatgggttctaggttgtctcatcggtccaagtttagaaggttttccatctgccttatttcaggacaggctgattctagatctttccatggttcagtataggctc

SEQ ID NO: 153227 - DNA, 242 bp, Homo sapiens
gtataaagtcagagtgcctgcgtttgaatcctggctcctctacttgtgaccttgagcatgtttgaaatgtttctgtgcctcagtttggccaactgttaaatggggataaaaataacatctaactttgaatgttgtagtgagaaataaataagttagaaaaattaagacagtgactaacatgtactcaataaatgaatataaaatgaggaagttatgtaacctctctaaacgttactagtaaa

SEQ ID NO: 153228 - DNA, 360 bp, Homo sapiens
ttgctctgggaggctgcagtgcacattctctctgaggcatcattgtgctctctgttaacaggtttggggcccaaaattgaagattgcatcaggccccacaatgtgcaaacactgtactaggcactgtggacaacccaagaaaggaatgaagcacggttcctgcttgcagggcgcttacacattcaatcaaggaaatagcccaactaaccagagtccaacagacccaaggtttccaggatgcagcttcctttcagtacccagccaacaagtcccaggctgtcctgcaactaaggacgtctgtttttgtcagaaccctcaatcccactcccactccaagagtttccaaaagtctccaagaaa

SEQ ID NO: 153229 - DNA, 202 bp, Homo sapiens
tgaggacatgtgacccacagctgatgaaactggggacactgattgagaggactcctgaaagacacgtcttcaaatatctgaggagatgttatgtggggataggcccaaatggacaaaatgaagactgatgggtaggggagaaagaaaagtaaactatggagagttaatccagtcctacataaagaaaagtaacctagacaca

SEQ ID NO: 153230 - DNA, 890 bp, Homo sapiens
gggccacatttagaggagccagtgaaagaatcaatctgctgagtcagaagaaaattcaacaagctcttatccaaataggcactcgtacgtgttgccatattaaagatgcaagtggtcccattagtaataaactcttcagacacaaaaggcatttgtgtcacaaattctgtacaagttataaatagagggaaaagcatctgggaatgtgaagtcaagagtcctgtgttttgactctagctcaagtgcagaccaaaaacataggcgttcacctctcagttcagtttaacaatatttctcaaggatctatctgtgaggcacttggatgcatggtctataaataagaccaagtccctttcttgaaagtgcttaaaatctaatgaaggggagggagataaatacacaaatcaatggattcaagacagggtattgaagatgttatgagagtaatacaagtaaaacattgaccaagttaaaaaggacaaaacaaaacagcaagtaaggtgttaactcctccatattccattagaatactcttagcatgcccagttcctgacacaaaagtaggcatttgataaatggctctttgagtaaattaaatgagcattatctcttcccagacctaaacagcccaccaatgacctagtttacaatttatgcactgttaatttgcctaattagacccagtatctacttctgtgccacaaaatcatatgattagagcattaacagtcatgaaacgctttatagacctggacttctccaatcgaggacattacaatctactaaataaagaataacttgaagagggatttaaatagaggagggtattgagaaagccataaatttagtaaaagagaagttaaaatcggcacgtggggttcatagcatta

SEQ ID NO: 153231 - DNA, 660 bp, Homo sapiens
gggccacatttagaggagccagtgaaagaatcaatctgctgagtcagaagaaaattcaacaagctcttatccaaataggcactcgtacgtgttgccatattaaagatgcaagtggtcccattagtaataaactcttcagacacaaaaggcatttgtgtcacaaattctgtacaagttataaatagagggaaaagcatctgggaatgtgaagtcaagagtcctgtgttttgactctagctcaagtgcagaccaaaaacataggcgttcacctctcagttcagtttaacaatatttctcaaggatctatctgtgaggcacttggatgcatggtctataaataagaccaagtccctttcttgaaagtgcttaaaatctaatgaaggggagggagataaatacacaaatcaatggattcaagacagggtattgaagatgttatgagagtaatacaagtaaaacattgaccaagttaaaaaggacaaaacaaaacctaacttgaacaatctccggaaagaagaaatcccagtacaagagaaaacccctaaaataaggatggctttagatgacaagctctaccagagagacttagaagttgcactagcttgatcagtgaaggaactgccaacagtcaccactaaatgtgccgcagggtaccgagct

SEQ ID NO: 153232 - DNA, 449 bp, Homo sapiens
cactcttagactcagggctgatatccatcatcgctattagagtaggggctgatatccatcatcgttgttagatttggggtcaatacccatcatcactattagacttggggttgatacccgtcatctctcttagactcagggccaacatcatcattgctgttagactcagggccaatactcgtcatcactgttagactcagggccgatatctgtcatcactgttaaactcggggctgatatctgtcatcgctgttagatttggggctgatatccatcatcgctattaagagtagggactgatatccatcatcgttgttagatttggggtcaataaccatcatcactattagacttggggttgatacctgtcatctctcttagactcaggaccaatatcatcatcgctgttagactcggggccaatactcgtcatcactgttagactcagg

SEQ ID NO: 153233 - DNA, 278 bp, Homo sapiens
atataaaaagcgtgagattatgtgtaatataccaagccaagatcaagtcttgctcattttaatactcctcacatagagttttgtgcagagtagagggcttagtaaatatgtgctcagacaaggagaatgaaactaaattacagaacaacattacacattaaacaataaggtgctgattttggacatattcaataacaaattattagttatgtgaaaaagaaaccagacccagaaatttttagtgggattttgaccgtgttataatgaagagtcggggt

SEQ ID NO: 153234 - DNA, 253 bp, Homo sapiens
ctgtttaaggaaaatagtaaagctaagtttctagtaagaaactcaccatcctttaaaatgcccaattctctgcatggtccaatagcatatctatttgaagatcaagaattaggaagtaatatagtgcagtgctatatggtcttagaaacacagagaagctattttgagcagtgtaagttctgaagcagactaatacattagcattaaaatacccaaagaggccggacacagtggctcacgcctgtaatcccag

SEQ ID NO: 153235 - DNA, 371 bp, Homo sapiens
aggatcccccaggtggggcatactggcaggatccagaaaagaatgatatgttgctgttttgagtaaaagtgatataactcttttggaaatttgtaactgtcctaagaagaaatacacaaagtgtctttcataaagtttcagctttactgcagtgtgcctttattcccagccactgggaagctgaggcaggatgcttgagccaaggctgtagtgtgttgtgattgtgcctgtgaacagctattacactccagccagggcagaatagcaagaccttgtctcttaaaaaagttgcagcattatttacaaagcagaaagtgatggtcacaatgaaatacgctccctttgagaacatttatgaaactaatagcata

SEQ ID NO: 153236 - DNA, 522 bp, Homo sapiens
tctataaatctgactactttaatgttttattttttcaagtccaaagtgagcaagaagatctgggaaagtttggaacttcctagagacttgtgtaatttcaatgtgaatatttcaacactgacactactgaagagtatacttaaaaatggttaaaatgtctgtacccagtggttatgactgtaatcccagctactcacaggaggctgaggggggaggatcaattgagcccaggagttcaagtccagcctaggcaacatagtgagaccctgtccctacttttaaaaggaagttctacacttaatatgtacatcttgcacatttcagtgtgtttttggcacccagttggccactgctcttagcaatataatagtagggggagagagtttatttaggtgtgttttaagcattcatgatctttgactcttttggtagaggcagatcctgtagaccattcagtgttaagtagtctgttttatcttttcctatttggcagagccattaatattttcgatgaatttgtct

SEQ ID NO: 153237 - DNA, 188 bp, Homo sapiens
catagctacattgcggtatagaatatacaatgtataaatgttttggaaaaatgcagaatgcttcctaaaatgtgcttatcagtgagctcatacagccaccccccatactctttaaaaaatgcattctcttctgccatggggggcactctgttggatagaaaagtttgagaaatacacatttatattac

SEQ ID NO: 153238 - DNA, 114 bp, Homo sapiens
gaaactcaacagctatcaggtgggtgaatatccagtaataaaatggattgttctccgctgattgtatgtttccaagttgctcaggaagaagaatacctgcaagtatgttgctct

SEQ ID NO: 153239 - DNA, 539 bp, Homo sapiens
taacggcctcagttgagttgcaagataaagaaaactatgcagattgacaacagcccaccaattagcagtcataaaagggctgaagagaaagataaaacagaatctaagcctaaacctttgtatttagtaaaggataacttcacaggttgggcaacagcgtaaccccatctctacaaaaacaatttttaatttagccaggcgtggtgacatgcacctttagtcccaggtacttgggaggctgacatgggagggaggtttgcttgagcctgggagatcaaggctgcagtcagctgctactaccgcacagcagaactctctctcaaaaacaaaaacaaaacaaaggccgggtgcggtggctcaagcctgcaagcctgtaatcccagcactttgggaggccgaggtgggcggatcacaggaggtcaggagttcgagaccagcctggacaacatggcgaaaccccgggtctactaaaaatacaaaaattagctgggtgtggtagcgtgcactagttatcccagctactagggaggctgaggcag

SEQ ID NO: 153240 - DNA, 298 bp, Homo sapiens
taatctgatctccaaagggtgtgttcagctttgagttcatgtaagttcaactctgagatatggtctgtgagctggctcagccccgccactgaagagctcttccaccatcaccatcagggactgactgaacaacacagaggtaaggctgggagatgtttgtgtgctttggggaaggcaaagagtctaatgagaagtttgctctttttttttttttgagatggagtctcgctgtgtcgcccaggctggagtgccgtggcgcaatctcggctcactgcaatctctgcctcccggattcagg

SEQ ID NO: 153241 - DNA, 452 bp, Homo sapiens
aatcgagtcggtacccggagacacttacgaagcacacaacgaagaaaactgaatcactggcgaacagctgccagttcctccccccagcccagcgaacatgaggatgaacgatgctgacagctccctcggcctgcagcctgggtttgtttcttcaaaaaaatctcgttcttttttggtggtggtgttttaatctttatggaaaagggtaagcttgtttagaagcgatccatctctgacttaccaaataatgcagcttagtaataagttgggcaccaccactgccctgggatgctgtctcaaatgccacatcacagaagggagactcgggagaaggggaggcttgtggcatttcactgtagttgagaaataagctcccgtggctaacgatgtggcatcatttatttaagttttgaatttcaatagcttttggggtacaagtggtttttggtttc

SEQ ID NO: 153242 - DNA, 556 bp, Homo sapiens
gtctgtgcctcgatacaccagcccatcatcatcatgatcatcaacaccattatcatcatcattgtgctctgtagcagccacagacctggcagttctcaatggccatttacagaatgcccacatgtgctgggctctgtgagagactatacagacactggacaatcaagtgaagagtgattctgcttgcaaatggacagtgaagagagtgcttcccatcccttcgtatttgcctttgatgactaagaatgaggcacattgttgcctgtggagttaggaaaacaactttccaatgacccactttcccatatctcttagctattgcagctcatacaatctcagggctggaaaagatcctagaaatgatcagactcactttgcaaaaggacatgacagtccagagaagctgtgactcacctgaagtcagggaactcatcaatgagaacaggaacaggagcctgggttacctactttcaagctcagcagactttccagcataccaccatgcctctcttcttgaataatttcctgaagttctaagaaaaatgagtagaatata

SEQ ID NO: 153243 - DNA, 462 bp, Homo sapiens
tcccaaggtctgacacatttctaaaagtgggaatattatttaggtgcaaaaggaaatattctcctaggtatcaaatagttaaaggtaatgtggttcaaaacagacttggttaaagtcttctaaatgtagtgactgaactgatttacaatcaaaaccgggaaatgaagtggtaattcagaggttgctgattacacctccacatttcacctaattaattttataggaggcaaagttcttgaaaataacaagatgatcaaatgtacagatataaaacctgtaacctcaacattttctatgctcttaacgtaaattattgctaattaacaagaattatattctaatgtatgaaatacgtttaacatcggtctccttgcaaaacatttggctagtggtgttcagagaaataccaaaacgtgtttttatcattgctggtatattattaaaaatcagacaaagtgggac

SEQ ID NO: 153244 - DNA, 405 bp, Homo sapiens
ttcgttcaagcctggagcccctgccccatcccagggcagccagcctccaccctgggctgacacatcctttagagagtaaaaggctgcttgccagtgtcagcctgtcactccttctgtcccacctctgcctccttcctgcaggtaatgctccatccatacctccttctccttcacccctgctgcttgggataattgcagaaccatggagcacagaatacagaatactgggggtgtacaggagagtttagccaaagcaagtcagaaaaacctaggtcttttttcgtttctgccactgaccggctgtgtgacctcagcaagtcacttcacttcgcccagctgctgtttcctcagggtacaatgaggacaccaataatacttaccctgcagggggcttaccgggatttc

SEQ ID NO: 153245 - DNA, 222 bp, Homo sapiens
acggaacatcccatcacctgtcacacggaacatcccgtcacccgtcacacggaacatcccgtaacccatcacatggaacatcccgtcacctgtcacacggaacatcccatcacccgtcacatggaacatctcaccaatcacacagaacatctcacccatcacatggaacatcccgtcacccgtcacacggaacattccgtctcccgctgacacggaatatct

SEQ ID NO: 153246 - DNA, 473 bp, Homo sapiens
caggggtgggtacagaaaattcagagtctatggaaatatctagccattccccctcctcctttggaaattccttcctatttaggaaagataatagtcagaggccgtcacatataataactcaaaacttggatgctaaaccgtgtgcacctatggaactgggaaggatacagacatttgttcgttcaacaaatatttatgtttatattaaatatgttctattttcttttttctccttggagacagggtctccattgtcgcccagactggagtacagtgacgcagtcatggctcactgcagcctcaacctcccgggttcaagaaaccctcccacctcagcctcccaagtagctgggagtgtagtcgtgcaccaccacacctggctaatttttgggtttttttttgtttgtttgttcgtttttgagacggagtctcgcactttcatccaggctagactgcagtggcgcgatctcggt

SEQ ID NO: 153247 - DNA, 206 bp, Homo sapiens
ctttttccccctcttattaaaattacctaaaagaaacctcaatctctctgaattcattaactctcaaagcagacagtgagagaatgtagcatacagttgtcctgaatattcgttatatccatatttgagaacctctaaggaagtttagactttagagactcacagggggcacatgcctggccttctcccacccccagatgcccagg

SEQ ID NO: 153248 - DNA, 253 bp, Homo sapiens
ctggcataatgtctttttggaggcctctttggaggaagctgccatcaagaagtttacacccaggttaggaagataagttgtgtattgataaaaacagttcacatatattgcttatttaatatactccaggctctgtgctaagacagaatgtgatatgtgttatattaatggtgtaaatatgaaagttaaaagaggagagtgatcatttctaatctggagggtcaaagaaagctcatagttaaggttacatttg

SEQ ID NO: 153249 - DNA, 656 bp, Homo sapiens
gtcaggcacttcatacctacacttcaacggttgagtgcttaaaacaatacctaacagcaaaaacacacacacaaataattaaagatggtaaagaaagagagaaacatgagccattgataacagggactaattttatacaaaattgccagactattttggggcctcatcatgatcttttctgatatgtcatttcacttaaaaaaggccatgacaagaaaagacaaacatgagaaaactgtgtcctatagataaaaaagggaatcacaatcatagcacttaagggacacaattcatgcaaggttggtttttacagacacaataaaagagtagcaaatttgcagaggttgaaagtaggggatttacctgagatagaagcaaaatctaatccaattcaccttttgaaaagaactaaagaataaatacaaagaaagaaatagtacttagtgctttatgtgaagaaaatctcatagcctctattacaacgtctgccctgtaaccacagaaatctataaccagtctatttaaaccatcaggaataggaatactacatttagtcttcccagaaacaagtactgctaatagcatctgcatatgtgcgtcttaaactttgcttcattttgaactctactcctaccctgaaatcagaaagtctttgt

SEQ ID NO: 153250 - DNA, 517 bp, Homo sapiens
atacaattaaatcatgattttatttccacttatgaagagaggttctctcaaagcattcaaagcctatgtccaaggcacaatttgcttatagaaagaatccgaaggggctgggcccacattttataatttttagagagtttttacagcattatctatttagtcctcattaaaacaccagacacttgccatggactgtggcgggccttgtgggcctgaagaaaattatccatccttgcaaatgtcttctgcagagatgcctcacacagagactgtctctcctcttccttcctccatggatctgcttattcaggacagcctctgattattccaccagtcccaaaggcaaacaacccacttctgcagagaatagtgtcgccaaaaaggaaaacaaggtcccggtcaagaaacagaagaccagaactgtgttctcttccacccagctgtgtgtactcaatgatagatttgccttatttattaatgttcctaatcacccacagtgtatattacatacatgtag

SEQ ID NO: 153251 - DNA, 392 bp, Homo sapiens
ttttaagtgaaaaaggaaactatagaaaatgcatggcatgttaacttttataaaaactaactgttgcagtgtcttactacttcagatctatggggcttgctttgccactgatcgcgccttgaccagttgtaacagccacttgtgatcctctgataaccacacccaccccgctgcaaacctttctgaaagcatttctggttgaggcacactggtgcccccatcagtccttctgcccaagtctcccagttcttttgttaatgacatttgatgacttccagagtaccaagtcattctcttacattaaagcatacattaagaatattgaaatgaactgttaattccttatggaaaacttaattttaggtatccatttccagcttctctcttcctct

SEQ ID NO: 153252 - DNA, 337 bp, Homo sapiens
ctgagtgtgtgtgcggccgctcctccaggcctggccgtgcccgatcaggacctgctccactgtttaacactaaaccaaggtcatgagcattcgtgctaagataaacagactccagctcctggtccaccctgcatgtgtagagagggctgcgtgtgtgagctgggctgcgtgtgtgagctgggttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcct

SEQ ID NO: 153253 - DNA, 461 bp, Homo sapiens
gtgattctcctgcctcagcctcctgagtagctgggaccacaggcatgcaccaacacgcccagctaaattttgtatttttagtagagatgaggctttaccacattggccaggctggtctagaactcctggcctcaagtgatccacccccatcagcctcccaaagtgctgagattacaggcatgagccactatgcttgtccgtcttttctattccttttgctagcatcctattccctcttcaggtgataagtcagtggtctactggctggattcccaggttctggcctctctgtctgcttccatatggtctctcagtgcttgattaatcttcctgacctctctctctgtgtccatgtggtctctcagggctggattaatcatcctgactgcaactcggatccaccctcccttcttctgagacgccctcatggttttcttggttcttacagcaccaaattcaga

SEQ ID NO: 153254 - DNA, 274 bp, Homo sapiens
gtgaggaagcaaaaaaggttagtgacccgacagaaactgcaggaaatggtaggattaggataagccattaccagagtaggtatgtcttaactcgggtggggtacaaggttggatatcagcatcccatttacttcaaaagatggccccaaaagaaggaaatgttggggagcttggctattttaagttattccaatagaagatctttcactaccccaatgacttacaatatatatgcatttgaataggctatacagacaccttgcttgttcttaag

SEQ ID NO: 153255 - DNA, 528 bp, Homo sapiens
gtgagccgagattgcaccactgcactccagcctgcgtgacaaactgagactccatctcccaaataaataaataaataaataaaagataatattacctaccccatgagtttattatgagaattaaataagagaacatattaaaaggtttcattcagtgccaggcatataatatgtactcagggaatactagttttttttaaataaaattttaaaatgggattagaaggtcaaagcatataggcataaaggtataaaaaatattgaagatgagtgagttactaaaatttaacattacgtttagctctgagcttcctaattagcacaacatgctaagtaggttatatttgtatctaaagtaaagattggcaaactttttatatcaagggttaggtgacaaatgttttcagctttgcaggccacacagctctgtactgcttgtcagttctgcctttgtatctggaaagtagccatagataatatgtaaatgagtgggtgtggctgtgtgccaataaaactttatttacaaga

SEQ ID NO: 153256 - DNA, 503 bp, Homo sapiens
tccagctaccactgcaaggacggtggggatgagacccccagctgaccatgacacctggggaccccacgagctttctggaactgcttccaccaacactcacgagttttacaagtatgagaatgacaaatactaaaattgaatcaagaaaaaggattcagaaatgtgttatttttaaaacatacgtctgataggagtgtgtgttgctgtccttctggatggtgaactctgctctgcccagataccaaagcctcacccacttcctagagggtcaaagacttctctaaattcaaagttttgaatttaagcctaatcaaatgaaacaatcgaagcagggggagagctggaatggacagaaccgctaatttccagagtttgagccttgttaactatgtactttcaaaccagtcctcactgtctcccaagcgaccgtaaacaaaacctatttcagaaggggtttttttttttgccatatcattaagtagtcagtttatggaaatgaactg

SEQ ID NO: 153257 - DNA, 1093 bp, Homo sapiens
tcatttttttttaagtgttatctttcggatcctcataagcactatgtgaggcagctgtcaccctgattttacagaaaggtaactgcagcccagcacagtgatgtgacttagcccaaggtcactccacacattacctcatcacctacttcatttgcagagaaaataaaagctgtcacaggagagctcctgcggccactaattcccaagcatctgcactgttcttgtctcctctcctgtgacagtgggaagtttgcctctgtccacccaaagcccctagcgctcatccccgcccaccttggcagagctttgcgttctaatgtgtatgtaactcttcaatatccagaacgctccaccctgccagacccttcccagcgacgtctcagcacactggtttctcttctgccctgtcaaagcctctcttctgccctgtcaaagcctctcttctccctgttgcccctgccttcttttctcttctttgcagccaaacttcgactaattctctaaacttaactttccccattttcttatctctcactcgctcttcagcctcttccctgctaactccctcttctctccaactcagcagttggggtgacaggtggcctgcagctttcaggcctcatcttagccgactgctcggcagcatctagcgctcctggcgctcttcccgtttgaaacactattccagggctttcctgacacttctctctcgtagttttcctcaaacccttctggctgttccttctctgtctccttcctagtactgcctcttctggaccaccagtaaaggtttgtggagtctctaacctgtatcctcctgccctcactccatattctctccgcacccaccttggatttctgaacatgaacatccagctctcttgttcttgacgttctccacttggcataccttaaagacctcagactcgatgtgcccagcccctcctccctgcgcccaccaaagctggccctccgtcagtgttccttatctcacacacagcacccccatgtcatcccggacagctccctttgaaagggtgctcgtccctctcctccacactgtcatcagcccctctctgcctacatctgtaag

SEQ ID NO: 153258 - DNA, 189 bp, Homo sapiens
tttctggttgttcccgatgtactttgtctgtcctcgtggagtttcaccctacagcaacatattcaaggtgactccatgcagatttccagaactctttctctgcctagctccctcatctccagtactgcaacccacaaatgtcccacacctgcactacaaattgtcatccctgtggccccaaatcattaa

SEQ ID NO: 153259 - DNA, 596 bp, Homo sapiens
tttacttctttatacttctatgcctgagaaaggcagttaaagaaaggagcagtgaagctgcctgactggagacagctaaccacacagcaatttaaaaatctgaatgggaatactaagtcatcttctcctgtcttttaattttagacactcctctactatagtaaaggtagaatccctcaagtaaatctctcaaaagataagaaattctgtgactgccattctgttcaagtgtctatctcacctcacctttgcttttacgttgtctcttctaaaaatccaacattctttatggtactactcttccctaccggaatatgtgtgatatgctcatgcttctaacagaataaaaggaactttggtttttgttgttttttaagcaacctataactaattgaaaagtttccctaatatccagctctatgctaggccatgcagagagtaagaaaaagaaataaagtgtcctcatgcacgcagtggagcatctctaggggcagaaagacctggtttaatttttatctctccactaatcagcgctgtgaccttgaatgaattatgtaaacagagcctccgttttttagagatctaattctcaattt

SEQ ID NO: 153260 - DNA, 858 bp, Homo sapiens
gagaaaccagcttcttgcagttcaggagattttcagtgaaggaggtgatatggtttggctctgtgtccccacccaaatctcatcttgaattttacctcccataatccccacatgtcatgggaggaacccagtaggaagtaattgaatcgtggaggctggtttttctcatgctgttttcatgatagtaaataagtctcataagatctgagggtttataaaaggcagttcccctacacacgccctctttgcctgccaccatgtgagacatgactttgctcctcatttaccttccaccataattgtgaagcctccctatccatgtggaactgtgagtcaattaaacctcttccctttataaatcacccggtgttgggtatgtctttattagcaacataagagcagactaatacaggaggagaaatcaaccagcccttattcaacagtgaatgctggcagggaagactagagtctgacagagtcccagatgaaaagcaaattgctcagcccaacagtactctcctcttccccaacctccaaattatagtgagaaggagatagtagaggacaggctggaaaaagaacataatcacatcatctctcacattctcgtgatgcttggattcaaggtatatgtcagattgaattctgaggtgaagctacagcccagcctccttccagtttaaatattgacatggttaaaaagtctgcaaaggaggttgggagtgtggttaatcacaggtgaattcaatttaattaaagctatgattcagtaccagctcaacccccttctaggagatagctaaaccattagttccttcagcagaagttacactctctggataataaacaaaacaaaaa

SEQ ID NO: 153261 - DNA, 357 bp, Homo sapiens
cctggagccaggtgtctgttgacagtggggaggaggtggggaagacccagccggccgagagcctcagccaccttcctgcaggaggtcctcacaccccagacggtcagaatgctccccagactgaggaatcagctgcacatccccctgatgtctctaaagctgaaatctgcttcctgggtttagccaccattttcattgagcagttctgaggattccttgtgggtacttgtgatcttggtggagatgcttcatggtgttgaccctattgttttgaatacctgacagctggatggtccaggccctatttctatgatctgttttttggaactgttgtatttgtgtgacacagtgatggag

SEQ ID NO: 153262 - DNA, 433 bp, Homo sapiens
ggctgaagcaggaggatcacttgaggctacaaggcagaggctgcagtgggccatgactgcaccactgtgctccagcctaggtgacagagtgagaccctgtctcaaaagagtaatattgtacacacagtacatttcaaaaactgcatcaatcaaaacatttaatcacaaaccagttggctgggcatgatggctcacgcctgtaatcccagcactttgggaggccgaggcaggaggatcacgaggtcaggagttcgagaccagcctgacaaacatggtgaaaccctgcctctactaaaaatacaaaaatcatccagggttggtggtacacgcttataatcccagctactcaggaggccaaggcaggagaatcgcttgaacctgggaggcagaggttgcagtgagccaagatcacgccaccacactccagcctggg

SEQ ID NO: 153263 - DNA, 345 bp, Homo sapiens
aatcagctaaaaggataactggaagaagagtatgataactgttgctatacttcgctgtcattttgttacaagcagaagtgtcatgtggctaatggagtaacataacagattcctgccaactgtggccatgactcactctcttttgaattctgtgtgcaggaggtagtaagactgaacaagctcactcacactacaatcccagggaagtcaaggagcaagaaagccacagcatatgagagcagcagagtaaaatcagtaaacaacggcaactaggttacaccactgtcatgttacctaccctgagacatgcagaagtcaagattaaaagctgattactagttaaaa

SEQ ID NO: 153264 - DNA, 234 bp, Homo sapiens
atggactggatttagtgactcacttctaatggatagaataaagcaaaagtgacattgtgtgacttcagagactaagacatacaaggcactgtggcttcctgttctctcttatgcttgcgctctctctcgcacgctcattctctctctctctctcccccttcctccatccatcctcctgccctcagaacacttgctctgagggaaaccggctggatggacaaagggggatggaca

SEQ ID NO: 153265 - DNA, 962 bp, Homo sapiens
caatactcctgcctcagccccctgaatagctgggattacaggtgcctgtcaacacggctagctaattttttgtatttttagtagagacagggtttcaccatgttggccaggctggtctcaaactcctgacctcatctgatttccccaccttggcctcccagtgtgttgggattacaggaatgagccaccaagcctggcctgttcaatttatttggaattttaaaaattatacactttttattgttgcttttgaaaattttataatttttttgatggggccatgttgccctaatattttgtatacattgtaatctttgagatttggacatgaacaaaaagctacctgttatgatttttataatatagctctgtcctcgcatagtctgaaaatcaatcgtcttggatagcgattcttggaatttctcaaacatatttttaggatgtgtcttgtctaaaattttgtgttgtttagttaaatcggcttattcttatttcttcttaataaatcagtaatcacttgctacacccattccgtgtttgggatactgcagtttctttgcttctgaaacatttacctttagactcaaagtgtcattccaacgtatattaccatttcatgtcgtgggagacattaaccagtattttaaaaagcccctagaggccgggcacggtggttcatgcctgtaatcccagcactttggtaggccgaggcgggcggatcacgaggtcaggagattgagactatcctggctaacacggtgaaactccatctctactaaaaatacaaaaaattagccgggcatggtggcgggcacctgtagtcccatctagttgggaggctgtggcaggagaatggcgtgaacccgggaggcggagcttgcagtgagccgagattgcgccactgcactccagcctgggagacagagcgagactctacctcaaaataaataaataaataaaat

SEQ ID NO: 153266 - DNA, 763 bp, Homo sapiens
gtagaaaccccctgggtcatgtcagatttagaaaatataagcaatggctcatacacgaattttaagttgtaacctacatgtgataagttgctttatcttccaaatgtaataaaaaccagaagttactttgaaataaattgaaggattagcagtggtgactgaggaataaaaattataatttaaaattgtccttaaagctggaattcttaacttattgaccttatatcctacatattataggactttgtaaatttaggctgatatggaaatgtatatttatatcaaatttaaatttttagaatgatggtgctactatattctaattgttaatttgataattgtaattgtaatttgttaatttgttctaataatattttcatgacattattcatttgctgcttggcttgatggcataacaagtatgggttatttaccctgaaaaggaaacagtatcacccttccagaatctctatttacagctacagaagatgcaacacacctgtttctggaccacttccagatcagatgtgatgcatgctttagatcatttactttgatctaggaattactgtctggcatttcgtggtgtagggtaggtgtctccagcactgtataggtgtctggaattgagataagaatcaatttcaatacaaaatacattttttgcttaaagcacgcaaggattctatgaattcaggtaaattcacagggtggaaaacaggaactaatgttatatattcctgtagttatcttcataatgaag

SEQ ID NO: 153267 - DNA, 420 bp, Homo sapiens
tgcctgggggcgtctggggggtttcctgagtgaggtggggtctcaccagctccaggagacaccactgccatgcacaaggtaggtgtgggggtggaggatcacctccgtgaggacccagaccccacccactgtggctgtggtggagactgcaggtctgtctcaaggccccaggcctgacacctgcaagaacagaacctgggggtgacggagaggggattccaccaggccagcccggggcttgaaccccagccagggcagctgctgtctgctgccccaccaggtaacgcaccgacccagctgctgttcagctccccctctgggccagcaccatgctcatggcataggccggctgggccctctgagacccccactcccacacagactggtctgcatggaggctggtgcagcctgtgccgtaca

SEQ ID NO: 153268 - DNA, 376 bp, Homo sapiens
gtgaggcaggagactggggtaagaaaccaacagcccagagctctgggtcctaatcagctctgcagcccaggacaagccccccattccctctgggcctcagtggtcttatctgtactatccaagtttcacggagcactcagtatataccaagcacagtgctaagcactttgtgcacattaaaggatccagccccaaatcactcagctaaacaggggtgaagccaggatttgaactcagagccctggctcttaaatgcccagggctggcctttcagagcttgttagctctctcaggaaccccaccctacatggagatctgtgaagccaaaccacaaacctgtctatgcagtggcctttttctacataccactgtcttt

SEQ ID NO: 153269 - DNA, 281 bp, Homo sapiens
ccttcttctgtcccctctccttcccctgtaatccattctccacatagcacccagagtcatctctttataaagtaaatcaattatgtcacatctctgcttcaaactctcttttggcttctctcattgtaaagagtaaaatccaaatgtttcccttggcctatgagggtcttcctgacctggctcctgcccctaaagctcactcctccaactctccttctccctcacctaactccagccacactggcattccaactgtgcctccaacacatcacacctgttcc

SEQ ID NO: 153270 - DNA, 187 bp, Homo sapiens
acctgggaccatcataaccactctggtattttttaaccaacctgaaaaaactccccccagaatttttcaattggtcataaatttaaagcatctaaccgaccccagtgcctcactccttttacagacgaagcaggctctcatgcatgggtgtggtgccatatggtgcccaagctctgaaccacgccct

SEQ ID NO: 153271 - DNA, 216 bp, Homo sapiens
agtcatttgatgcaagcatcacaaatgtaattaagcagctatagttcctagaaagctttaaggctttatgcttcttgcaaccctacctgactttctaacaggattgcttggctagcacctgcttgatatgagtgaacctgggagagagaactccacatttttgtgcagcagtgacaccagatagaagagacaggcaactcgggctcaccagcacct

SEQ ID NO: 153272 - DNA, 427 bp, Homo sapiens
ggttctcctgcatcctgggaactgggaaggtaccttatcctgttttcttcaatgggagaattgagtttcagagaagctaaaagacttgctctcattccataaattgttggaggcagaggatgatcttgcatgcgggtttcccaacaccctgtccaggactcttttctcctataccaggttgattttttttctaagacatgtaaagctggtgaatggacatgcagaaaagtaaactgggatgagtgctcatttaatacccagaggcctttttgcagccccccagttctagtccctgggggaaagatcaactgtcagggataaagctgggttcattgaattacttaggaatacaattacctgtcagttctctaggcttctgtgcaaagccattttctaggcaattagggtactctagatcaaaatgaga

SEQ ID NO: 153273 - DNA, 685 bp, Homo sapiens
aaaaatggagagttagaaaaataaaatttcccagctcatcggcagcccatcctgttggtaaaggactgctccctctggtccattactgcccattacttcctccagctccacgtcaatgactcatgccaaaacctccatcacttccctttggagattattacacagcccagcagacatcctattaagaaacttcttattagcagaggaaaaggaaagttttcacgttgagatcgagaaggaagatgattcatggtcacgaagggaaaggtcccctgaagtcttgagagatggctcaccactgctccactttcctttggggacacacacactcaccattagctgtgggaagtcgatggggtgtgtggagaggaccatactcaattaaaagaatgacagtggaatcagtaattttgaatcaagctcagcgatggattacaaaagcaagagtgtagactcctaactaatgtagggtggaagttgaaacgtgaaagttgcctgtcctgagcacgtttagagttcacaattcaatattcaagaagaacgtaaggctagcagttgctatagttgggacaggaaatgactcaagtccaaaaggaaggtttctgtagatacaaggtcaagatgagaataggttctgccacgggaaatgggaagaacacaaggatagagtctgcatcatccccaa

SEQ ID NO: 153274 - DNA, 529 bp, Homo sapiens
atacagatagtttgactaatgtagatttccttcatagatgtaaatttgttttacaaaaggacagcttttcagagctactcctatgtctgcagtttttcagaataaccagctcaaaatacgccaaagaagtatattttgggttggcatattctggtctcctacattcatattttggggtggtgtgcatgagccaccatgcctggctggaaatctgtattttaaacaggtactccagggggttctgatgtaagtggctctgggatcatgttctgggaaaacttagttttctcatctgtaaaatgagaatagcaataaaactcaaaagtgttgatagaagcattaaatgtaattaatttcataatacacatgttagaaagaacataggattgagggtctgcactggagggctttagtcctaaatctgtctctaacttgctctgtggccttctggaaggcactcaacctttctgtgattcaatttccttgtgtgcaaatggaagggaatggcgctgctttctctctatcacgg

SEQ ID NO: 153275 - DNA, 796 bp, Homo sapiens
  misc_feature (37)..(37): n is a, c, g, or t
  misc_feature (44)..(44): n is a, c, g, or t
gccgctccaccgaccaacaccaacccactcaagtccnccccacncccccccttcagagatgatcagctcactagccacatcaaaggtgccaattctctaaagggtagactctgtgcagctttgaagcctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153276 - DNA, 796 bp, Homo sapiens
  misc_feature (48)..(48): n is a, c, g, or t
  misc_feature (56)..(56): n is a, c, g, or t
ttgttatctttctcttcaccagtatttccacgtagtcacgaagttagnagagaacnagatgatcagctcactagccacatcaaaggtgccaattctctaaagggtagactctgtgcagctttgaagcctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153277 - DNA, 809 bp, Homo sapiens
  misc_feature (55)..(55): n is a, c, g, or t
  misc_feature (69)..(69): n is a, c, g, or t
ctccccccccaaaaaagagaggtgttggtatacctcccatttacaacgccaaccncttagaggagcagnagatgatcagctcactagccacatcaaaggtgccaattctctaaagggtagactctgtgcagctttgaagcctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153278 - DNA, 798 bp, Homo sapiens
ttatccagccagcagccaagcgtatttcccgccatacaaaacaccttataggagaagcagatgatcagctcactagccacatcaaaggtgccaattctctaaagggtagactctgtgcagctttgaagcctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153279 - DNA, 798 bp, Homo sapiens
  misc_feature (58)..(58): n is a, c, g, or t
ctcttatcctccctttcatatcgtactaccacccccacagcaatctcacagtaacagnagatgatcagctcactagccacatcaaaggtgccaattctctaaagggtagactctgtgcagctttgaagcctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153280 - DNA, 805 bp, Homo sapiens
  misc_feature (1)..(1): n is a, c, g, or t
  misc_feature (60)..(60): n is a, c, g, or t
  misc_feature (65)..(65): n is a, c, g, or t
ngaagaggggagagaagaagaaggtggagtgtgttaggggggtaaagaagtaaagaaggncctgnagatgatcagctcactagccacatcaaaggtgccaattctctaaagggtagactctgtgcagctttgaagcctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153281 - DNA, 761 bp, Homo sapiens
  misc_feature (1)..(1): n is a, c, g, or t
nactgagtgacactgcacaataagggtaaagcgtatctagacaaagatggcggcaaatggctaaaggagagacagtgaagaactagtaggacctggaagacaatacctaccaacatgtcaaagccacagtggagcatttctgctatgatgaagattaaatagaagaataacagttccaggataacattgattcctgacaacagcgtgagatttcaacagaacttgtttggaacaaatactcacttaaaacttcagcagaagaaaaattacttagtccttaggccaacaaatttaactgcagtgtcatatgtttcacaggccttcctacatttagaaatcgtcacacagctgtgataagagtagattattttactacaaaataattggaacagatgaaaacataaaatgtgagaaactgaatgtattattcaggaagaatattgagtgccttcatttaactaaagttgaatgtaaaagtcaatttgcacttctttataatcctctggtttggaattataaattgttaaaaccttgatgttgtcatttaattatatttcaggtgtcctgaacaggtcactagactctacattgggcagcctttaaatatgattctttgtaattctaaatagtctttttttctctttttactgcaacttaacatttctgtttggaacacagaaaatgaaaatattcagaataagttgtacatttgatgacaaataaatcactattaaaataatttacactttttttttttacaa

SEQ ID NO: 153282 - DNA, 239 bp, Homo sapiens
tctcatggggggtactacggggatgatcgtcgtggtggcaaaggaggtccgggttaacccgggaccgcctttgaatattatcactcaaacttgtaatagatgatataaatttatctacacaggttgagtgtttcttttctttttttttttttaatggagtctcactctatggtccaggctagagtgcagtggtgcgatctctgctcactgcaacctctgctgcccaggttcaagtgatt

SEQ ID NO: 153283 - DNA, 533 bp, Homo sapiens
cctagctactcaggaggctaaggtgggaggatcgctggagctcaggagtttgagcttgcagtgaactgtgattgtgccgctgagctacagcctgggcaacaaagcgagacccagtctctaaacaaacaacaacaacaacaacgaaaagaatgcacagcaattctaatgtaaatgcaccaaacaaaaaagctgtaaaatacatgaagcaataactgttagctatgaaaggagaaacagacaaatccacaattatagttagagacttcagcacctctctcaacaactgaaaactagaccgcaaatcatcaaggatatagagaactcaaaagcacctttaactagcaagctctattagacatttacagagcaccaacaacagtgggatatacattctttttcaagtacacatgggacatataccaagatagactatatcctcagccataaaacaaaccgtgagaaactcagaattaaaatctgtatgattttaatcaatacagatcgaactagaaatcaatgaaagaaaggtaaca

SEQ ID NO: 153284 - DNA, 351 bp, Homo sapiens
ccttgaaataagagaggatgtcctaaattaaaacacgtaaatgcctctccaagagttcaaataaaatttcattttaaaagcaaaaggcataaacttgtcacctcagtttattactgagtgcttttgaacttctcagaaaagaactctataaactcatgagagaaatatgatttatgatcccctccttctcttcttttccattctgtgggaggaggtacagtcaggatcagctagggaggcagcgttgggatgagggcaagaccccacaggggagcagcaggccagggcgccaggccaggcccagcctcagaccaggcatgggcgcatctctccagctttctgagcctctct

SEQ ID NO: 153285 - DNA, 181 bp, Homo sapiens
atgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaag

SEQ ID NO: 153286 - DNA, 520 bp, Homo sapiens
  misc_feature (377)..(377): n is a, c, g, or t
gcccagctcagaaatcagcgctgatcaaataaagcacacattccctttggcactaaatttgactcggcagcgtctgtacagggatcctggcaaaaccagaacattcagcctttagaatcactggggattggctcaccgctgtgtggaagcacaactgttatttctgaatgccatccacgtggctcagccactgagatgaagcaccattcagaagaagcaaatgtgtgctctatgtttcacccagtctgatttcgccaagatcacacagataggttctacaaagaaagcactattgccattatcatcgaaatacaaatctacttttggaagacaagtgccttataaatacaccaattgaaaaacaagcaaagtgaatntaagctacggtctcactctgttgcccaggctggagtgcagtggtacaatcatggctcattgcagccttgacctcctgggctcaagtgatcctcctgcctcagcctcctgagtagctgggactacaggcatgtgccaccacact

SEQ ID NO: 153287 - DNA, 786 bp, Homo sapiens
ttatttataagtaagggtgaaggaaatgcacctttatgaagtccctgaagcacccagggactgtaccagatgccttacaggtgtacatatgtactaggtataaaggttagtttcctaatctaggtatgtgtaaatcctcatcttactttatttccttgagtcaaagtcaattccaagtcaccattccattgagataatgaaaagcccaatggtggatgcctcctcctagtcaacatctccccccaaattataggaaggcacacagagcaagatatcatctcatgttcacatggcccacgaagtctggccatgccaagcttgggcagaggaatcttctgcaagatggcagcttccactgttacggaccagcctccatggtgcaccagaaaggcactcccctcaggtgtcctcccaccttgctggatgttgccaaaaataaaagaacaagattcctctatttctggcacccacagcttcctgtctcctttcaaatcctgcgtaattacccttctctcaaaggcagtagcttctctctagtacctacagcataatcgcctcaagaaaccaaggcttccagaactcaaacccaggaaggaatctaggaggattccagaaatcaagcccaggaatgaatcaaacccagctgcactcaactctggacttccacggtgcctcgcgagactggctttgctaaggcaagggcttctgggtggagttaataagaaagcagcatgaaaaggtgctttgagacacgacacatcgtttcctgctaacgatcaaagaata

SEQ ID NO: 153288 - DNA, 458 bp, Homo sapiens
gaggtttccacatccagggtggtgtgaggcctgcggaggcgagaaaaccaggctcccctcctcccccgccaggagggtatgtccccatcatcctcgttgttggcctccagctcaacgtagaactcggagaagttggcgatggaggcgaacatgaccgccacacactcacaggactgatagtagagctcatcattgcgccgctcgcgggccaggaagtgagcggacacgtccttgggcaggatgttgtgcagcagccgccggttgtaggcctgcagctcctccatctcctctttctcctctgtggcctgagagaaagagactgcaagtcacccagatgccaatgtgagcccagatgtcggcccctccacctcctcctctccgtggcctggagaaaaagcaccagcatgaattcccttagcaccagcgcgaattcccttagcaccagcacgaattctctt

SEQ ID NO: 153289 - DNA, 341 bp, Homo sapiens
caacatggcaaaaccttgtctctaataaaaatacaaaaattagcttagtgtggtggcacacgcctgtaattccagccacttcggaggctgaggcaggagaatcacttcgaaccgggaggcggaggttgcagtgagccgagatcgtgccactgtgctccaggctggtggacagagcgagactccatctcaaaaaaaaaaagaaaagaaaagaaaagaaacaaaaattgcttaactagacatgtcatgcaattttggagaagagatgagtggtaaatgtgactccagctttactaaacagtgaaataaattaaggcaccaaagcatgctgagccttgtctaaa

SEQ ID NO: 153290 - DNA, 512 bp, Homo sapiens
aatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcc

SEQ ID NO: 153291 - DNA, 266 bp, Homo sapiens
aaaaaaattctaaatgtaacattatctgcctagcatcatatagtaatattcacataggaaaactgtaaaacaaacatattttggttctttatcctaaagctcaaaacgtatccacaaaggggctaatggcaaatattcctaaccttgatggtgaaaaaaactgctaagatatcaaattttactaggaataggcaatggagccacaactttttgtgttttctacatggtcaaatactcaatattctaaattttgatatgaaaatatt

SEQ ID NO: 153292 - DNA, 354 bp, Homo sapiens
gcgcctgtaatcccagctactcgggaggctgaggtagggagaattgcttgaactcgggaggcggaggttgcagtgagcagagatcgtggcacttcactccagcctgggtgacagagtgagactctgtctcaaaaaaaaggagagttcttccgcctgggaggatcgaaggttgtgagccaggaaaaaggagctggagagtgggcacatcttggaagctgaggcactgccaaagccaaggagtaactgctaactctgggagccagtggctctgaaaagtgctcccctagctggccctggtgcctgacacccaggagggtgggttagagccagtgccctctccccacccaggcacac

SEQ ID NO: 153293 - DNA, 221 bp, Homo sapiens
ggggtaccagcttacctcggatatgagggagaattggaacagatgtcccccatccacacctacaccctgcaatcattctgtcagagtgcaggtctgatgccatcgtgctcccattcaagcctctgttgcccctcacgtgccagccctccataacatctcctcctgcccattcagcctcatccttcaatgcctcctcatcaatgaagggcaaggatccttct

SEQ ID NO: 153294 - DNA, 656 bp, Homo sapiens
acagtggaataaaactagaaatcaactcctaaaggaaccctaaaaactatacaaatgcatggaaattaaacagtctgctcctaagtgatttttgggttaagaacaaaatcaagatggaagtgttaaaattatttgaaatgaatgataatagtgacataagttatcaaaacctgagatacagcaaagcagtgctgagaagaaagtttatagcactaaattgctacatcaaaaagtctgaaagatcacaaattgacaacgtaatgtcacacctcaaggaactagagaaacaagaacaaacccaaagttagtggaataaaagaaataacagaagatcggagcagaattaaatgaaattaaaacaaacaaaaacagtaggccagatactgtggctcatgcctataagcccagcactttaggcggccaaggcaggcagattgcttggtaatttgagaccagcctaagcaacatggtgaaaccctatttctacaaaaaatacacaaattaaccaggtatggtggtgcccacctgtggtcccagctgctccagaggctgaggtgggaggattacttgagcctggaggaggcagaggttgcagttagacgagactgtcccactgcactccagtctgcgaaacagaacgagattgtctcaaaaaa

SEQ ID NO: 153295 - DNA, 289 bp, Homo sapiens
caggggccgatgggctctgccctcttctgctctcaatttttgtccatcaggtgggcttggcaagtccccttgacctttctcaggaaaactttggtccgtctggccctccccgacctccccccagtgtctgctccctgcaaggtttctcatgccttcctacacacgctcacctggaatgcagccctgcccttttgtatcatgaatgtccagagtaggcactggctcgaggagaattggtgaacacgctaagtaacttccccaaaactgacaacaggcactgtaattccag

SEQ ID NO: 153296 - DNA, 133 bp, Homo sapiens
actcatatggccataattttacatctttgctctgttatgtgatcaaatgtacctaaaaactttggataggaaagttagtttccctatgttttagatgtgcttctttacaaagagaaaaagaccaagagacata

SEQ ID NO: 153297 - DNA, 533 bp, Homo sapiens
gagatgatcactcaactgtaaggacttctacatatatataaaacatcttaatatttttcatcatctttgatttcttagatgttctagaaactgatttttagtgaggaaaaactacatttatctgagttgaccagttccttcagtttcacttccatttctttttcttctgataaatttacccagcattcaatttgctacttcttgtttttaaaatctcattttgtgtgatcagaagtgtctgttcatgtctctagccatctttgtgcatagcaaggaatgctgttcacttaatattaggaggtttatttcttggggtcgtgagatttggggtgatttctctccctttttgtacttttctgtattcagtaattttttgagacaatgtcaccaatgtccttcatattaatatttggactcagaacccattttggtggtggttaaacaatcgtcacccacattggagtgcggtggtatgatctcagctcaccaaacctccgcctcccaggcttaagcgattctcctgcctcagcctc

SEQ ID NO: 153298 - DNA, 380 bp, Homo sapiens
tctttttcatttggctcacaaattccattccatacccatttttttcccctatggacagcaaagttttaaaataaatagcagcaactctgttttcctagtttaactaacatggaaacacttaatcctcttagttttcttgattttgcaaacaaggatttgtgaggataaaactttaagtagtccagtcacatggactaggtattcacttaatgaccccgaatgaaacctgttagaaaagcaaagtagtgaattaataatgtcccctagtcattttctctgccttaattttcagccacaggttgtgcaactttagtggaacctgtagatatggtcactgcgcctccattagttggaacagattctttgtatcactagctgag

SEQ ID NO: 153299 - DNA, 255 bp, Homo sapiens
agagaatcacttgaacttgggaggtggaggttgcagcgagccgagatcgcactccagcctaggtgacagagcaggactcctgactcaaaaaaaagaaaaacatatagagtaaagagatctcagtctaggaacagacttaagaggtggcaaaagagagcagcatagaatcaactatactaaaactgaaattattgtttagcaggtgttttctatcacttcattgacccactaaagtgctgtctctaacagatctgc

SEQ ID NO: 153300 - DNA, 484 bp, Homo sapiens
gcaaaaggggaagaaaagtccagtcaagacatttgccaccactcgccatttcctgtgctggccagggcagtgcctggaacactgaagttcagccactagctttggaccaagttcgcaggtagctaacatcttgcatctttcaacagctttagagccacattgccagctccaggcatcagctggctggcctgcagggagcattactgataatgccaccaaccatggtgtgccatccaactccaggggcaagcaagagaccctggagcttgtccttgacttaccttgggcatcttctggggctggacaggggaggcgggcaagtcttgtccaggctggcagaggtttcagaacagcacaggcctgcactgcaggctggttgcagctcacaggcacctggaggatggcaagagccaccatcctactaaatgcagtggcatattgcttgctttcaaatttgtgggtttttgttgttgttgttgttttg

SEQ ID NO: 153301 - DNA, 370 bp, Homo sapiens
gcagtgacacgtgttacatatgtcgtttgtatttcagagggaggggggactgtgataggttgcttgtgattcagaatcttcctgctaagaagactagtgagcaaatgtttatgacatccttgagtagaaagctaagttttttcaaggctgttatgcacacaaaaggcacataaaaatgattgctaaaatgaaggatggttagcatttttggtcttgagtaggcatcaccattgtgctgaaaggaagtccgatagacatttggttatcgttcggccctaagtaggagtcagacccttcctgatccgtgtgcctcctcctctcacctaacagcctgaatccaggccagcttgcaacgttgattttaatacca

SEQ ID NO: 153302 - DNA, 603 bp, Homo sapiens
caacgatggtcctcagctacttgggaggctgaggctgagactgcttgagtccaggaggtagaggctgcagtgagccatgaatgctccactgcactctagcctagacaacaaagcaagacctcgtctcaaaaaaaagtacatttaacctatcgtgtttttttttctctgccactgaaagaaactaaaagactttctggtacaagaaaaagctaatgaatgtctttttcccactcccccttctcttcctttgctatttcacactggagattttcttttgttttgatcctgattgccctttcaacttgaaatagacttacacgtaacaacagtaacagagctccctttccttccctgaccctttgacttacatctataaaaggagtcaagtgaatgtacctacacacctgtctgtcactacagtaacacctaataactgtacgtgtcctgtcacttagtaacatgaaactttaaatgagtaaatagctactccttacttaggcaacaccaaaaggttgactgtcaaaacatgtgaaatgtgaaaatccatggcggtacaaattagtaaatcaacatctaaaacctcagcaaacatatgaaaagcta

SEQ ID NO: 153303 - DNA, 121 bp, Homo sapiens
aagagtaaagtgcaaacacggagaaggaaaagaggatagagggtaggcagtgaggcaaatggttctattcaggggaggctttggttagtgttcagtaaatccaaattttataggtaaaaag

SEQ ID NO: 153304 - DNA, 156 bp, Homo sapiens
agtttggaggggagatgggagaggttggcttcctgaaatctgaagggcacagcagtttgggggtggtaagtttattctgaccacagagcctcatagacactcactctccctgctgcccaccttatggttcaccccgtggttctcatcagttccttg

SEQ ID NO: 153305 - DNA, 619 bp, Homo sapiens
cagctgagctggcactcacaccactaggtggagtccttcccacttttccctccccttcccagtggcagaggaacctcatcccagaggaacaagcccagggggagtactggcagactgctgctgatgttcccttcaggcccaagggctcttaagtcagtttgtggtgaatgttgcctggcctgggactcacctttcaaccacccttcagggcagtagcttctcctatagtccagggcaggttcagaaatgccatccaagagtcaagtcctggaatcagggaccccatgagcccacttggtgttctaccccaccgtggctgacctgatagctaacctggtgccaggaatcaagcagaagtagtctcgccccactccatagctaccacagctgagaatgtgcagagtctcgtaaagggtaatttgcatcatcttgctctgtcctattccccttagctaacttgaaaaatgttttttagggatggagtctgtgttatccaggctggtctcgaactgttggcctcaagtgattgttcctttttggcctccaaaagtggtgggattacagacctgaaccactgcacctgtccttctttctttcttttctgcacctgttcccattg

SEQ ID NO: 153306 - DNA, 668 bp, Homo sapiens
ctaagggcctcagctggcctggagaggggccgggaattcaagaattagaagggagggaactgcgggaagactgacaggaggggagctggtgagttcctgggaaggtgcaggtggagcgtggacagcaagtgcagcagagggagaaggcattcctgacccatgctgggacacggggatcctgcagaggactcatggttgtggagtctgctctcccttggactggggacccttcctcctcgcttgatcgcctacccccagcaggtcctctgctctgtatggcacagatctatccctgcaaatgaccctttgggcagcagtttttaggagctctgccaggaggcccttcccatggacttcctcaagcatgcagcatggccccattgattcatttactcattcattcattcaacaagtacctattaggcacctaacatgaggcagtgttctaggtgttagggatactgtagtgagtaaaacagatttttaaaaagtgctttcatggccaggtgcagtggctcacgcctgtaatcccagcactttcggaggccgaagcgggcacatcataaggtcaggaaatcgagaccatcctggctaacatggtgaaaccccatctccactaaaaataaaaaaaattagccgggcgtggtggcgggcgcctgtagtcccag

SEQ ID NO: 153307 - DNA, 564 bp, Homo sapiens
gtcagaagccagctgtctgggaaggggagatggtgtccagcaggggccctggtagagaccagacagctctctgcagagcagacaaaagaattccagagggaggaagaataagaactatctttccagctccccgttggagtgttaggcgggtggtgaaggcagcccagataatctcaagatgaaatagccctggggtaattgagatttggagactggagctccgagcaatattccttcaaaatcactggtttgcataatggagttgctgggcagccctgaaattctcggcaggctctggcttctgctcccctactgctcacacgttcaccactggctgttgcaccaggtcctaagcccttttatgtgcatctttacggcatgacccacaactgcagtcacattttcagagaaactgcaagtttgctctgctaatttaagaaacctccaaattcaaacttaccaagtagataaattaggaggtggttatttgcatcccagaaagtcttctattttacaataggattcagccacaagaatcctttaactatcagcttcttctagatc

SEQ ID NO: 153308 - DNA, 1597 bp, Homo sapiens
gttgccatgttataaaatattcttatattttcttataatgcctccatagttttattatatattcactcaatacatcatttttctatgtggtatgaggtaagaatctaacttttactgattttatctttatgcattttttttaatttaaaatgtggggtagggatctaacttttttcaaacacatataaattgtgcactactatttatttaaatagtctgttcttttcccttttattattatgctatcttatctcacttgaattcaacctaagcctgttttagactccaactaatactacagatcttcctaccactcttccccttgcataattaacttcaagcacattagcctccgggttcctcaagcacaccaaatttagtcccagctcaggaactctgtactttctatttccatgctttaatgttctttctcttgatatccttgttttcttatttccttcatttgcatttctgctttgattttctgtttctggtccatggacatttttattttctttttatagaacaaacacagcttttttacattttgtatttttcctgccattgctatgtgcttggagctcagggagggcctcaaaggatgaaattggagtatggtgtgatcagaagtttgaacttctttgtattgtatgatcatccctttaccttaatactcacatgaaatgctatctatggcttcttacattccacttcttcttaatcaatttctttcttcatgaacttaaacgttcccatcatttttgatagggtctgtgagtttatttgtccaaaaagcccaaaagcagaatttaagattgatagcatagctttgtgctcaacagttgtaatatttttttccatggtcgtctagcttcttctgttttctttgagaaatctatgtaattgttgtttctttataattaatctatcttttctctccagttgcctttaagactttttatatttgatattatgcaatttcactatgatttgtctaaatgtgcatttattttgctagagattaataactcaagtctaaggtatcatgtcttttttcaagtttagaaaatatttggctattatctctttattatcatgctgctacagcattatttgaattctttccctcagaaatttatattagaagtttgctagacttcattctagtctcatgactcttaattagtcttgcaaaattttcatttcattatcacttattgcattttaggtaatttcttaatctctgtcttccagtttactggttctttcttcagctgtatctattttattgtttaacctatttattttctatttcaatgattacattttttgagattttattagcaaaatggttaaaagcatggtttcagaggattgtctggatttacattttgcctccattatttactagctctccagttttggttaaattaattaaccttttgtgcttcttggtgtgtaaaattgaagtaacaattgtatataaatatagtgttttttggtaattaattaaaattatttgcataaaatgcttaagacagggcctgaaatgacattgagtcctcaaaaaataaattattattatcattccttcaca

SEQ ID NO: 153309 - DNA, 238 bp, Homo sapiens
cccagtatccctggacaaggcagggccacaggctgagtcccagccaatgggacttgcaggaaatgactggcaccctttctaggcctagaccctaaaacatgggtgcgacttgggcccttatctgtcagccagactcaggggtttaaaagggggcgggttccaaggcctgagaggatggcacagcctgtcggcagaagtattctgagaccctgaataacccttcttgccaccccaccaa

SEQ ID NO: 153310 - DNA, 186 bp, Homo sapiens
gaagcatgttcatttgttaggtcccatttatttattttcatttgcttcctgtcattttcctgagccaggaatgaaattaaaaattcctttctttagattttagcagacaacagtgatttatttatttatttagaaacagagtttcactcttgttgcccaggctgaagtacaatggcacgatctcgg

SEQ ID NO: 153311 - DNA, 394 bp, Homo sapiens
cataagtaactattttatgaatatgtatttgtgatgaatgatttcctacacaaatgaagaatctattttaatagaaaatggtaactggatatattactagatacaattttttttatttccctattttcagtttcaatagggaaaattaaaattttccctgttacttccttattttatttccctatttcaatgaatgaaatcataggcaactctaagtctcttgaggaaacttgggcgttatacatctctctcttctcccaaactcaaactagcttaagcaaaacatggaatttgttgacatgaataataggaaaatccaatgatgaagctggctgcagatggaactcaagagttttttgggtattggccttattctctcttggagtacaggggc

SEQ ID NO: 153312 - DNA, 846 bp, Homo sapiens
ggaaaggagcccggaagccgggcctctgggctgcagggctgctttctgccagcctgtggtttaggtcttggcacacaaggccccagcccacaccccatccaggctggcaggtgggaaagcaaggtgcagctggccccctcctgagagagacagtgtccagactcaaagggagggcaggggggccacagccaggagggtaagtcacagggcctgtcaataaggctctggctcaaacaaaagtcgccgtgggcgccgggagatggagacaacaaggggggccactcccctgctgagcaagccacgggaatctgtccccaccctcagctccactttcgggaacatcagggctcatatcctaggaagactctaagaacaacagcagttttcctcagggcgaaggaagctggattcccagcgtgggtgctgcatgaaggaaccagcagaaataaacagaggaaagaaaatgacagaacaaaaacctggaggcccagaggctggaactccatcaccgcaggggagggagagaatcatcttcacatctacaggggccaagttccaggtccactctgtggagcctggtgccacgtcaggatgcagacattggggcatgggtccctgaaaggatgagtgagggccggcttgaggggaacaccatgaagtaccagggggtactggcaccatcagactgaagaaagccagagaaaggggctggaggggtcccaaggtgcttcccttccctagcaattggctgccatctccaagacagtgcagagacatgttcagagctggaggccacagagaggcaaggatgctgaacaaaactgagcactgcgtttctacctggcc

SEQ ID NO: 153313 - DNA, 809 bp, Homo sapiens
  misc_feature (213)..(213): n is a, c, g, or t
tatgggggggaacccacccctttgttccgccccgagttttctgtggccccggattgccccacgtgccaaaaccctgggggccccgccccccaaacaaagtgtgttaaaaaaatttttttaggggccctgacggcccccaaaaaagttttttgtttattttgttttattattttttttggcgatgctaactattttattgcagggaggtggggntgtcgggagatggagacaacaaggggggccactcccctgctgagcaagccacgggaatctgtccccaccctcagctccactttcgggaacatcagggctcatatcctaggaagactctaagaacaacagcagttttcctcagggcgaaggaagctggattcccagcgtgggtgctgcatgaaggaaccagcagaaataaacagaggaaagaaaatgacagaacaaaaacctggaggcccagaggctggaactccatcaccgcaggggagggagagaatcatcttcacatctacaggggccaagttccaggtccactctgtggagcctggtgccacgtcaggatgcagacattggggcatgggtccctgaaaggatgagtgagggccggcttgaggggaacaccatgaagtaccagggggtactggcaccatcagactgaagaaagccagagaaaggggctggaggggtcccaaggtgcttcccttccctagcaattggctgccatctccaagacagtgcagagacatgttcagagctggaggccacagagaggcaaggatgctgaacaaaactgagcactgcgtttctacctggcc

SEQ ID NO: 153314 - DNA, 350 bp, Homo sapiens
cttgagcctgggaggtagaagttgcagtgagcccagatcacgccactgaactccagcctgggtgacagagggagaccctgtctcaaaacaaaaaaaagaaaacaaaagcaaaacaaatcaggacaaaggggaaatgaaagtagtgaaattgggtataaccaggagtaagctgtaacataaaagcattctgtaagatcctgttaacagaaataagcccaaatttggctctgagcttgctagcagtcaaagagagaagggaaacatgatcagttataagactgggtccatataataaaaactaattgctcaaaagaatcagctaatggtataccctgcttgtgtgcacctgg

SEQ ID NO: 153315 - DNA, 239 bp, Homo sapiens
ttccccactggtgagccacaaaccagggtcttgaccatgaaaatgggggcaggagaaaatcagcaaataattacttgaaatacttaacctagccccagaggagtatctgctgggagaaaatttaatctgcaaactagtaagtgctatgtaacaaggcaatttccatgttttagtcaggatatgggaggctgtactttgattcattcattcagtaaggacttagtgacatctgccctgtg

SEQ ID NO: 153316 - DNA, 583 bp, Homo sapiens
agtcgacggagactctccagaattagccattctttgaaatggttaattctggagaggaccagtttgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtc

SEQ ID NO: 153317 - DNA, 195 bp, Homo sapiens
agcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaa

SEQ ID NO: 153318 - DNA, 324 bp, Homo sapiens
ttggcaggtagaggcaggaggatcacttgagcccaggagtctgataccagcctgggcaacatagtgagaccacatctctacaaaagatcaggtcaggcatcgtggctcaaccctgtaatcccagcactttgggaggctgagactggaggatcgcttgagctgaggagttcaaagctagcctgtacaacatagaccctatctctaccaaaaatagtttttaaaaattagcccgacatgcctgtgatcccagcactatgggaggccgaggtgggcagattacctgaggtcaggagttcaagaccagtctggccaacatggtgaaac

SEQ ID NO: 153319 - DNA, 323 bp, Homo sapiens
ggggcgccccacgcactctgggcttcacctggctcctctgctttgcttgggctgctgacttctggaggagccctttcttccttctctctcctgatgcagaacatacccagtctccctggggcaatcggccttcttcagccactccttggtctctgctcctctttccctccctcactctgtgtcctgccagccccagcctctggcgacttttagagctggtgcgcagtcctgcctgagcatcggtgaacatgaagccatgggctgtggcttaatgattcttttggtgaattttgattctttatcaaaatttccttccttccttc

SEQ ID NO: 153320 - DNA, 348 bp, Homo sapiens
gaggatggaacaaagctgggagcccagccagccggccagggcgcgagagggtgacagacacgaggctcggagcaggtgttggctgtgggattagatggggtgatgggaggaagattccatgcagaaaactgagcctgggcagaggaagctggaagtgggagatgtagcaactgaaagacacgctgccttcccccacactcagcagccctgccaatcgtgctgccatcaacacatctgacagctgggggtggaagagagcagagtccactgtgaagggctgcggggcagagccaccacctgaggaccgctccccaaggaggtgaagcctctatcctctttgttaagtca

SEQ ID NO: 153321 - DNA, 334 bp, Homo sapiens
cttttttctctaccgtaaggggtgtagtaatttaagggggaaaaaaattaagagaccaactgaggcagaattgagaagcccaatgtaaaattcagcataaactaccaagcaattctgcagattatgtctatagtacaccacaccgaaacctcaccctcatcctgcccccttatacaaaaggctgcagcacccaggtgttaacgggcatgggatccaaccaaactggtctctccacctccagctctgccaatgctaatccactccacagttggctgccaaaggaacctccctacagcacagcctgggatcaacaggccccaagtgaaataatctt

SEQ ID NO: 153322 - DNA, 408 bp, Homo sapiens
tatgtgtgtgtgccctaggattgttggaatggtaaatgagcatcatatctaggaatacagataaccacgaaggggaaatatctctaccataagaattacaaaacactgctcaaaggaaatcagagacaagaaaaacaaatggaaaaccattccatgctcatggataagaagaattgatattgttaaaatggccatactgcccaaagcaatttacagacttaatgatattcaatcaaactatcaatgacattcttcatagaactagaaaaaaacactatgttaaaatttacaaggaaccaagaaagactctaacggacaggcagaacaaatgtggaggcattacattacacaacttcaaactatattgaaaagctacagtaacaaaaacagcatgacacttgtacaaaa

SEQ ID NO: 153323 - DNA, 279 bp, Homo sapiens
gcgacccgcatgcacacccagcaccctgctgacactccaggctcacccactgccacgcctgctccgtgctgcctggcaaccatcctcccgcctagcaggacagccctcccagtataattgtcccctgatgagcaccagagtccccgcacctgcactgtcaacccctggccagcgttactctcccctgcccaaatgtactgtctccatggggatcattatcccccagccagcactactgtcacccccaccagcatcactctcgccctgccaacatgactc

SEQ ID NO: 153324 - DNA, 464 bp, Homo sapiens
tgaaaccattcaaaagaaagtatttgttttggaaaaacaaatacactgttgttgggcctcaaattggtaatttatcaattttgaatgctggctgttaatacaatataaagaaggtccaatttaaaaacatgttaaattaaaattttggaaagagagtaatactttggttccagccctactgccaaatgataccaatatgcacaaaaatgtacaaagtcttacagcaaacacataaagaaagaaacgtgaagaagcagcttaaggatggccatacttcactcctacatactttgatttacaactgtacaggtccatagcaacagatccccgtcttggcggggcagtactccaccacctccgattaggcaagtgaacaccattgacaagaggcaggagtggagggtggagttcaagttgtgttaacagtgagaagtggtctgaagggatgtgagggtgtggacacc

SEQ ID NO: 153325 - DNA, 331 bp, Homo sapiens
tagaatctctcatgtgggcacagtcaatggctgtccactgaccaggctgttagctggaaccctggcaggagctggaacccctgctattatttttcttataacaggacacagtctctcccctcttacctcaacttcctattctgggggtggggggaatcagtgatactggagatgactagttgctgtgttatggatttgatttgcatttggctataaaacaatcttgttgggaaaagtgtgggggagagaacctcttcccacacacacattgagacagatcctaactggtcaatgatcttgtttgtaagaaagagattcggttggttgagtg

SEQ ID NO: 153326 - DNA, 427 bp, Homo sapiens
cccctacatgtatactcaagagaaatgaaaacgtgtccacacaaagacttatatgcaaatatttattgaaaccttattagcaatagccaaaaagtggaaacaacccagatggccatcagataataaatggatgagcaacatgtggtatagccatacaataaaaatattattggtggtaaaacggaaccaagtactgatacatgctagaacacggatggcccttgagaacattatgctacgggaaagaagccagacacaaaaagtcacgcattgtgtgatttcgtttctgtgaaatggccaaaataggcaaatgcatcgagacagaaagtgggttagcggttgccaggggctagagaggatgggacatttgaaaggcgactaatgagtagtgtttccttgggggtaatgaaaatgctctaaaattgat

SEQ ID NO: 153327 - DNA, 285 bp, Homo sapiens
cccccaccccctccacctttgatcacacacattcttggcctgcagcctttactttttgctacagtggctcataacctttgcttgtcattgtaatcccctccagagttttaaaaaatacagaggtctagaaatggaaattttaaaaaagtgcccaatgtgattctaacatgaagccaaggtttaaaaccactgctttactgcaaggttgggtcagtgaatctcaaacctagttttgcatcataatcccctgcgtagcttttctgaactacctatgagtgaaaatca

SEQ ID NO: 153328 - DNA, 626 bp, Homo sapiens
tttgccttctgccatgattgtaagcttcttgaggcctccccagccatacggaactgtgagtcaagcctctttcctttatacattacccgctcttgggtaatctttatagcagtgtgaaaatggacttaatactccaggtttgtaggattctgtccctggctctgtatctctcagtcctgcttaaatgtgtattgctccattcttgaacagatcttcccctagtggtaactagatggctgacagaagctcactaaccccagcaacttacagggaaagagatgactcagcaacttcctcggtcgtacttgcgaaagttctgagactgaaatctcattagcaggcaaaggtcaggtgatgataatgaaccaatcactgcagccagggaaatggattatgctgattggcccaacccagatcatctgccctcccctggaatggcggtgggattagccccatctgaaacaaaaggatgcgggctggaggaaagcagttctccaaaaagaaactgagatgctgttaccagggtagaatgaggagaaaaggggagtagatgctgggtaggtgaaagcaacaagtgctggttgcacccactctgtgcttgtgattggttatatattgtgtgagat

SEQ ID NO: 153329 - DNA, 531 bp, Homo sapiens
caggtaaaaaaagaaatcccacttgtaaaggcctagtttgcaattcatttgtcctgggatcttgcaaaaacaacccaatatctgtatgtctctatacattggtgtgtatgataatatctttatttttctttgtagagattttacacaggatataataagtgacacaactgttttggcagatggggtcagaatatgaaggcaattccttccatgtaagaattttggtgcttgtttaaatttaatagactcgcttctcctaaccacactctggaagtctcctgtcattcatgcacataagaactcagaagagaacctctactgtctccccaaaatcttttttttttcttttaataaacttgctgacattggccaggtttcaagagcatggtaagttcatgatccatcagcctggtttctgaatggaaatccaatgagttatttgtattgtttgttcctaccttttccaggcaccttctaaaaatgaacaagagcagctctgatttggaaaaagtgagccagggctctgcagaa

SEQ ID NO: 153330 - DNA, 343 bp, Homo sapiens
tccagcacctttactagagaagcagaaaaaggatttgtggggggcatggctgccaaggatattcatttaaaaagaacctactgtttccccaaacccctgtgctcccaaatatgaaaatatgagttctcctgccttttagttgagactccaagaaaggaatctcaaattcaattagtttacagcctataaaatgcaaaggtagtactgcaaatcagtaatgcccagatgcaaattcagaggtgcacctcaaagtgatgtttgctttattttgtttgggttatctaggctatcactgagctccattattgaaggctggccaagtcacaaaaataagaaccttttt

SEQ ID NO: 153331 - DNA, 130 bp, Homo sapiens
cgggaatctattgcagagaggagggtaccagagtaccaaagtagtagaaaattgtagaaatatttcatttgcactgactaactcatcatgttatgccaacatgtgtaggtgatatttgtgagcaagtcca

SEQ ID NO: 153332 - DNA, 245 bp, Homo sapiens
aataatttggctctaattgatgattttgtttaaaacaaaacattcctaccttcctaagtatgtcaagaattgtaaagatttaaacacatgtatgctttttataggttggtgaaaatttttggtttcaacatgtcttaaaacatattaaagcccatgcacatagacctgacatgttataattatctttaggcatatagaaaatgatttgagtgattcagctctgatttgcgttaacaataatgaac

SEQ ID NO: 153333 - DNA, 467 bp, Homo sapiens
cagctgagtcattgcccttctctccccaggcagaatgcccaccctaggggctgctagagtaaacacactttgcttagcaagcaactcctatcaagggaagcctggatatgtctctgaacacgaagcagtactgttctagttcccatatcatttcaacatttccatcccaattattctcaattgcataatatttcaacttttacattgtttctctcatccctagctaattcaatcatggctaacactgggtgccagaaaatgatgtgcaaaaattctacatagaacactatgaaacgttattgagcaatcttaataaaggaaggatgtatcttgttcattatggaaaggctcaatattgaaaagatgtcagttctctcaaaatttattggtaaagtcaatacaatcccactccaaatcccaccagattatgtgcatgtgtgtagatatgttgacatgctgagggaata

SEQ ID NO: 153334 - DNA, 291 bp, Homo sapiens
tagtgaatgagagagctccctttaagcctttattggacctgggtactcttacttgccttcctgcaactttctatgggactgctaatgtcaaagaagatagagatcaagttcagtctggggtgaattaaaagagtgatccaagaagcaatatggacataaattgagaaattagagtgagttacccaggcagaaatgcaaagagaagcgctagggatacaacaccagaaaaacaagacaacctgatccctttctgtgctacatgcccctgctgtaagaagatactgatgctgt

SEQ ID NO: 153335 - DNA, 397 bp, Homo sapiens
agaatgagggaaatgttgcatccattttacaagtcttactatacttgtgaaaacccacactgcaaacaagctatatgaatgtgaaaatatgagaatatgctgggattacaggcatgagccatcacgcctggccatccttcgctttagatctaaagacaaaaaaggttgaaagttaaataatggaaaaagatcattccatgtaaatagtaacctaaagagaatttgcctggatatattaatatcagacaaagtaaacttgaagtaaaaaactgatagaagagagagtgaatgagagtatatactgatagaaggtaaaattcatcaagaagataaaaaaattatatgtatcaaacatcagagcttaaaatacatgaagtaaatattggcaaaattaaag

SEQ ID NO: 153336 - DNA, 446 bp, Homo sapiens
cctcatgtgacaatagtgaaagatgaaagaaaatccaagaaaccatttttttttcattcattttaaagtaatttacagaatagttcttttgtaagacaacattggacagtttctaaaggagagacaggtgaaacaatggctgaattttgaaacaagctcagggagagacaggagctgtggccaggagaagtctggctgtgtatcctacatcctcagtaggaactgatcaggatccagaatcccatcctccattttatataagtgcacaaactttgcattttattgaaaagcacaatcttgtcatgtcccacagttggtcagattggtgcaaatccccatctagtttgcctgttttgtctttatataaatggagtcgtgccatatggatactttgcctctggatttcctgctttcactacacattatgtttgtgaaacccatccatg

SEQ ID NO: 153337 - DNA, 277 bp, Homo sapiens
ctctcctccttggaactggagaactgtctctccatccctttatctgaatgtttagccattgtgcaaggctgagttcaagtcttactttcagtgaagtcttccttgattgcctaagtctggggtttctttcaaacttctccagggcttctggtgtgtgtcatcttcaaggcatttggcataatcttgtacaattagttatttttaaaaaatatgacctaggctgggtgaggtagctcacacctgaaatcccagcactttgggaggctgaggcaggcgg

SEQ ID NO: 153338 - DNA, 386 bp, Homo sapiens
gtcgtgagcacacacttgtgcctaggcctgtgggagggcggcgctgtgggtcctgcctgccgtcagttttctctctcctgggggtcagggagacttggagctctgtcccttcttggcttagtcatgaacctctctaagcctcagtgtcctgtgtgaacaaacagctcagtgagatggtgggagggcggagtgtcctgtcagcaggcatgaggaattaaaaattaagaacacccagggcattatggtaagaaaataatgagttgaagcataaaggtaatggttagtgccaacttcctcccagcgtgccaggccctgttcaaagtacatgaaggagttccttatttcgtcttcccaatagcccagggcggggctctcagaccatgaaa

SEQ ID NO: 153339 - DNA, 174 bp, Homo sapiens
cggaggctgaggcaggagaatggtgtgaacctgggaggcagagcttgcagtgagcggagatagcaccactgcactccagcctaggtgacagagcgagactccgtctcaaaaaaaaaagaaaaaaaagacaccataaaacaatgcagtaagtaagcccagggagggacaccacac

SEQ ID NO: 153340 - DNA, 432 bp, Homo sapiens
cgtcttagccttctggagcgagcatgctcattatcatctgagaggtctcgaagctacacatcaccatcatggtggcagaggagttggaggaatcatcggtttacagagcagacatacaagtattcgtcagactcaaaattgttccagtaggcgccgcaggcaccgatgtatgaagcgcacgcactttcccttggagaggtcgaagtaccaacgaggcatcacggcccggcagggccccgtcatcgcctcctgggagcagacagctttgacatcatgagtaatttcctactgaagcagatctggaagacttcacagaagcagctgtggatgaggatgatgaggatgaggaagaaggggaggagtggcaattgaatcgtagaaatacttcaaactcaggcacctcgcatttaaaacaccacagcacttccacgc

SEQ ID NO: 153341 - DNA, 522 bp, Homo sapiens
catctatggctgtgcagaagcatgtgcattggttaggtcccatgttatttatgttcattggcgttccggtcattttcctgagaccaggaatgaaattaaaaattcctttctttagatgttagcagagaacagtgatttatttatttatttagaaacagagtttcactctgtgtggcccaggctgaagtacaagggcacgatctcggctcagtgcaacctccgccttcaaatctaattaaccttctcaaaagccttcctatttaaccattttcttccatcttcatggccacaaccttagtccatgctgccatgatttcttcccgggacaactgcaacacttcctcactgtttccctgtttccactctggccctcctataatggattctctacatggcagtgatgataatatatatacatatttttttggagacggagtcttgctctgtcgcccaggctggagtgcagtggcgcgatctcggctcactgaaagctccacctcccaggttcacgccattctcctg

SEQ ID NO: 153342 - DNA, 275 bp, Homo sapiens
tcagttgtcgcatccaaaaggcctagctaacttttgtattttttgtagagaaagggtttcattatgttgcccatgctggtccccaaactcctgggctcgggcacctccgaggtctcccaaagtgctaggattacaggcatgagccactgcacagggccttatacaatgcttctaatttcagcacatttagcaaacttatcttctgcgggagaggtaccaaatcacattccagtttatttctcaactctaataatgtccctttcttcatttacttg

SEQ ID NO: 153343 - DNA, 357 bp, Homo sapiens
gggaaaaatgtatataggatatgattccatttaaggagactagaaaatgcatgctaatctacagggacagaaagctcctgtaggaacgtgggcttattgcagagggtaggcagaaactgggtgatgggtattttcactgtcttgattgtggtgatagttttgcaggtgtgtacatatatcagagaatgtcaaatggcacatgttaaatatgtacagttcattgtattttatttaaaaccaataaagctgtttttagaaggaagtaaggtggatttggagtcctgcggatagagcattgtagggcaaggagcattttagaaccctgtaagtcacatcagtggggtggcctctggcttt

SEQ ID NO: 153344 - DNA, 378 bp, Homo sapiens
agggtctcagttacaagctgtgggagccacaggctgtggctcagatcttactgcaacctacaacttgctggcctcctcacctttcaatctttggtgctcaagagcagacctaccttgggagatcccctctcgaaggtaaataatagacagacagtcctgccctgtcctgctcagacattgtcatcaccccaggttgctttctcccaccttgaaaactctccatccaggaccacacccataccctatctgccttctccacttccatttctaggcagctgagcatagctggagaaagaccccaaacatggtgatgtatctacatacatacctctagcctctgctgcccactccctgccacttggtacctctttcatttct

SEQ ID NO: 153345 - DNA, 158 bp, Homo sapiens
tggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatca

SEQ ID NO: 153346 - DNA, 459 bp, Homo sapiens
gaaagtttggtattatttaatgtagtaagactatcgttttgttctactttatatatattttttattctcaatattttaactcaatattggagttaataattgaggctatcttgaaaagaacttattgagcagaaattggcaatatttattaaaattaggactgagtatatcctctgctccttccgctgctggagattttatagttgctacgtgggcagaaacgcatatgcatttcccaggatgtttatgtcagcattgcagagactaaggaaaaactggaaatgccctaaatgttcatccatgaagacaggaagctatcatgaagaagagtgtgctagatctccatgtgcctatgcagaagaactttcaagcaggaaaaacaagatgcagaacatgattatcgtataatccatttgttaaaaaagtagaggaggagaaatgaatatttatgtgagatcc

SEQ ID NO: 153347 - DNA, 124 bp, Homo sapiens
atgagatttgagtagggacacagacaaaccatgtcactatccatatatacatttttttatccgctcaataactcatggtcaagtttgaaacatttcagggttgcagacatcagtacccttcccc

SEQ ID NO: 153348 - DNA, 671 bp, Homo sapiens
tacctcaccctaacccgcgcaccctaacccgtaaccctcaccctacccgcgctcagactaaaggcaaatctctgtctctaatacccagcacgcaacttgtcatcagatctcatcagcaacaccttcaaaaccgttcgtgcctcctctcaaaccaccacatagttcaattctcagttaacctaaaggtctctctgtttccacccttgtcacctacaaggcactccaccgctcaaacccagaagtaactccctgttttacgaggcaatcttatgacggtctacggcacctggctcttcatcacccttctgggctcatctacccctattcaccccctcactcctgccgtagccacgtttacctctgtactctccccaaatgctcccactgcaaggcttttgctgttttctgctgcctgaaatcctaagacacgtttcccctactgtctgtgtggcctccttgttcgaggtctttattcagacgtcatcttctcaaacaaccacctccgcttttttttttttttttttttctcctgaggcggaatctcactctgtcgcccaggctggagtgcagtggcgcaatctccactcaccgcaacctccgcctcccgggttcaagcgattctcctgcctcagcctcccgagtagctgggacgacaggtgtgtgtcaccacg

SEQ ID NO: 153349 - DNA, 426 bp, Homo sapiens
cgaggaggacgtgtaagattaatctgtggtgaatgtgccctgacactggggagatcaattaggcagaaaaaaaaaggacttttaaagaagacaaatattactggaacaggccgctggagcagtctgggaaatgagcagaatgacttttatagagcgttccagggcttcaagtaaattcgaattcaaatttattcttcctgtattatttgctgcatcctaaaatgggctaggaaaaaaaaaacagtgaatttagtgagcatttattgtgtccttgctgtatgtgaggccttgtgctagggacttaaaacaattggaaagatatccaggtgcccctaggaatggagaggccagaggcacagtggctcccatcaccaggaagacttggtaggaagatgacagttactgagctccagttttgtgctaaaa

SEQ ID NO: 153350 - DNA, 202 bp, Homo sapiens
gtacagaccatgtagggctcaaagtcatcctccagaaatgtttctgacctaagcaagcctccagccttcatttgatcaccttcccaacccttcctcacactatctatagactgtagttaaactcgattgcagtctagtaggatatttggttcttaaaagaacaagcagccaggcacagtggctcacacatgtaatcccagca

SEQ ID NO: 153351 - DNA, 484 bp, Homo sapiens
gttacgttatgtaccataggttgataattataatgattcctggggacaatcctaaatgccactttcaggaaagttttcgttgctggtattgtttggcagtcccttcttagagtcattctttcaaggtgggaatttaggattttgaaccttaattcagtcaagagtttgatgcagacttggaagaatgctccagttacaagatttgttctgtaactcccaggtgtggtcctgtattagagacgtttttgaaaaggacagctgattacgcaaatcagttttctgctcctttgattccagcatttgtaaatgaaataagataagtaaaatttatatccccattgcataaacatactgcattttcttagggttagagccttgtgtttagtaacctttttccatctttgtaattttcattatctgagatttttcatccaagaggaagtgtaagaaatgtatttttttccagcaatatttgaaccccccg

SEQ ID NO: 153352 - DNA, 548 bp, Homo sapiens
gctcggtaccatcgcgaacgtgttatccagaattgactgaggggcccaccaggcacacacacaatggagcagagcagaccacactgcatccatgggcagaagttccagaacaacaggcaagaagaaagaacacaaaagacccatgtggcattagacagccaacaaaacaatgccttaaaatgaggagaaaaattatttccaacctagaattctctacccaaccaaccagtagtcaagtgtgagggtttaataaaggcactcccagacatacagtcctcgaaaaattcaccttcctgctacccttcctcagggagtgactgaaagttcctctacctaaagaaatcaacaaaaaataagaaaatgtgggatccagaaaacagagagttcaactgaaaagggaggcaaagggagatgccaggatgatggaaagagagataaatcccaggataatacctgagcagcagcctagacatcagccaacttggagccggtcagagggctcctggagcagcttccagccatggcagcatcgctggtggcagagtagc

SEQ ID NO: 153353 - DNA, 483 bp, Homo sapiens
  misc_feature (377)..(377): n is a, c, g, or t
  misc_feature (423)..(423): n is a, c, g, or t
  misc_feature (436)..(436): n is a, c, g, or t
gttcctgatagaaaggatgcattcagcccccttccctctcccatctagtgcaggtcaccacgtgatgccttctcccgtgggatgactctcaccagatgcagcctctccatcttgaacttcccagtctccagaactgtaagccaaatacatctcttttctttataaattactcaggttggggattctgtcatagcaacagaaaacaaactaagacaattgcctactgattttgtgggcatatgcttataagactgggttttgctcatgaagccatcataaaatgagacccctttttctatataaggtaataaaataaagcaacttcatacctaaaaagacagtgatcatctgcaaggaacccacgcacttcgctccgnccggcaacaagcaaagcacatcgcaagattaaaacaaagaatccgncgggaacagaagngctccatctctgctctcaggcaggtgtccttctgcaaggaacccacg

SEQ ID NO: 153354 - DNA, 838 bp, Homo sapiens
ggatgaacaaatgagaaacagattctaacctcatggagattgtagacgggtgggtggcgggagaaagcattaacccagtgatcactcataggagtggaaattaaaactgacaaatgcaaggaaggaaaggagcatggcactaatggggagatgttgggagctccccttgacctagaggatcaggaaaagctcctccaaaaaggagtcgggcaagcagagatatagaggataaatacgtaggagttaaccagactgaagcaagcagggagggcgggaggaaattccagtaagaggaaaccgcaagtgcaaaggccacgtggtggcaggaaacacaggaggagagagccaacgtggctggattgtggggaaataggttggcaggagccagactaggcagggctttgtggaccatgacaggaattttgcttttcattccaaaagctctggagagtcactagggagcactaaggaggagagtgacatgatcagatttacattttgagagggtcacttgggctgcagaacagagaagaattgagtggaggggcaagagtggaagtgggaggccagtcaggagggagacaggggtagctgagaccaggtgatggtaaacacgggaagaaatgggttacagaggaagtcaggaagtaaaatggacagagcttgatgttaagttagatatggaacatgacagagagggaaaggacaaattgacttccagcttctggcttgtccaatttattatatgatggtgccattcaaggagctaagaataccagaaataaagcagatctggagcagatggtagctctgttttggacacactgagtttgaagtg

SEQ ID NO: 153355 - DNA, 386 bp, Homo sapiens
atttccagcaggttattccgagtgtcttcctagcgaaggaatcccatttccggcaggttattccgagtgctcttcctagggaaggaaccccatttccagcaggttattccgagtgctcttcctagggaaggaaccccatttccagcaggttattccgagtgctcttcctaggtaaggaatcccatttccagcaggttattccgagtgctcttcctaggtaaggaatcccatttccagcaggttattctgagtgctcttcctaggtaaggaatcccgtttccagcaggttattctgagtgctcttcctagccaaggaatcccatttccagcaggttattctgagtgctcttcctagggaaggaaccccatttccagcaggtgtattc

SEQ ID NO: 153356 - DNA, 385 bp, Homo sapiens
aatacccattcgcgaatcacccaaatagcaaacactgggtgactgccgtgtctacagcactatgccaagcaaggaaggcattagaaagagccagttaaaggcagccacctgatccccatgcaactcttaaccttggaacaaaaatccttccttagtctcaagttcatccatcctaaaaggaaaaaggaggatccaatgagcactcggtttccttcggtttctatttttccagattcttgttagaccacagggtatcccgaaggagttttccatggcatgtcagcaaaatccaaataccactcttcagaaggtaatatacttaaaacagaaataaaacagtaaaattgcacccatatattcacaaaatttacactggaaattatgt

SEQ ID NO: 153357 - DNA, 512 bp, Homo sapiens
ggacattgtctcaggttcattacccactcttcttgacctcaatggtatgtcaaaccttgttttcctctgacctcttcccatttattcttagcagacctcacctctatttcacagagatgataaccaccaccagacttggcacttgctcataaggcatcccaccagaaaatataactgtgcccagatattccaacatgcgagctgtcaagcccattatgcttaaactgagtctactgttcacttggttatttgaaataaactccctggtggtaagcattactgacgtaaacagtatgctggtgaatatctttctagtgcaaaaaaataaaataaaatagtatagccagcttcttgaaagatctctctaccctgagaatacttctaaagatggggaagaggtttttttttttttaaagaaagctatcttacttcacaagcatttaacaagcacaaatccaaacatacgttgtcatacatcaatagaataattataaatcccaacccagatagtt

SEQ ID NO: 153358 - DNA, 1121 bp, Homo sapiens
atgatttatttctgagaatggtaaagtcttttagatgtggcatctctaacaattttattatttttcgctcactcttgaataatagtttaaatgactgcaaaatattatgttgactattaattcctccccgtgctttcaggaaattaatctactgtcttctggcatatattgttgctgatgagaagtctgctgtcagtcttactggtttctctttgtagataaagtgtcttttttttctgatcacttgtaagtgcatttttggctttatccttggtattttttagtttcaccataatgtgtctcagtgttggcttacttttatttatcctatttgtttctcaggtgcactttcaatcgaaaccatgtttttcttcaattcaggaatatcctcagctattatattttcaaagattgctcttcgttattcccttcttcttctggaaaccctatttagatatctgttacggtttcttatttatctattttgtcccccaaatgtgctttcacgtttgtaaaaagattctcttcaatctctatgttgcatcctgatgaattcttcaatactacattcaaatccattaatttcatctttgactgtgaccagcctaaagttttatcttatctgttgggtttttaaattttcaattatcacatttttttatttccaatattctaatttaatcttttctcatattcacttattgtttcatttctcctttgttgttgctgtttcaaagttttatgttttattatggattctttttaaatttagctctttgaatattttaagcattattataaatactttgtaagattgttttataaaattaatttttaagtgaattttttcctaattgttcactgtactctttttttagcatttgattcctatgagttttgtgattttcatttacaattatttgtcttttttgttttgttttattttttatattttctgtctcatgatcatccctggaaactagagagactataataggttgcaaggcttacaaacccaacttccaatttcctaacaccctttggactttatatgtaatttggaatacatcatttaaatctaaagaacagtgtattagtcagctcaggctgccataacaacc

SEQ ID NO: 153359 - DNA, 360 bp, Homo sapiens
gtgtcaggactgggagcctggacccctcttccttctgctcctgctttgcagagaagtgagtggggaattcccgcctctgggaattcagagacgaagtgacagagacagcattggaagataagaatgcagccaaagaggtcttcagggtagcgtgtggcctgggcgctgagactattgggcctagcaacttctcaagcagtctattaaccacagccggtagccagcttttccccgcccttctcccaggcacacacagccacctccatcaccaaaggtcaggcgaaccacctcccatggctacccccagcctgacttgctttatagaaatcatggcatctcatcctcacaacagcccacact

SEQ ID NO: 153360 - DNA, 344 bp, Homo sapiens
cctgccttcactcggctaatttttatatgttttgtagagacagggtttcgccatattgcctaggctgttctcaaattcttgagctcaggtgatccgcaacccttggcctcccaaagtgctgaggtcacagatatgagcctccgtgcccagcctaaagcataaattttaagttattgcagaataaaatgcattattagtatgtcaatttaatgctctttatctttatttctcatgttttaaacttagctgctttctcttttctctaagaagcagaaacttgtgaaacaattgcctttaacttctatatgcttagaaacagattcacctgcactaggaccagaaaa

SEQ ID NO: 153361 - DNA, 325 bp, Homo sapiens
aaaacgccaaagacatagagaaaaatcttaaaattaaaaatacagattactttccaagaaacaccctaataagctagaaaagtagttgaattctctgcaacaatgaaccccagaatataaatataatatctttggtttttttttttttagacagagtcttgctctgtcacccgtgctggagtgcaatggcgcaatctcggcttactgcaaccactgcttcctgggttcaagtgattctcctgcctcagcctcccaagtagcttggattacaggcaggcgctaccatgccaagcgaattttcatatttttagtagaaatggggttg

SEQ ID NO: 153362 - DNA, 1322 bp, Homo sapiens
  misc_feature (2)..(3): n is a, c, g, or t
  misc_feature (777)..(777): n is a, c, g, or t
  misc_feature (811)..(811): n is a, c, g, or t
  misc_feature (860)..(860): n is a, c, g, or t
  misc_feature (894)..(894): n is a, c, g, or t
  misc_feature (1056)..(1056): n is a, c, g, or t
  misc_feature (1104)..(1104): n is a, c, g, or t
  misc_feature (1144)..(1144): n is a, c, g, or t
  misc_feature (1162)..(1162): n is a, c, g, or t
  misc_feature (1178)..(1178): n is a, c, g, or t
  misc_feature (1202)..(1202): n is a, c, g, or t
  misc_feature (1229)..(1229): n is a, c, g, or t
  misc_feature (1243)..(1243): n is a, c, g, or t
gnncagaaccaaagtccaaaatgattaagtttctggcacagaatcatgccagcagttacgtggtggggctcagttcagagcacagatctttccattctcttatttctgcaccactgcactgcaagaatcttatacactcctgtttataagagcagcctattaaaaaatattctgggacacatctaaaaagccataatataagaaaaaaataaaagctctgttttggatttatcctggaagctgggagagaacatattttttggacatgtttggaaatgtacgatagtttttgattcttatccttgtgctccaggctttctttgggacacttaagagattatctttgggatttaggaaagcaccatgtcattttatttttcaaatcctcagagtgctagaagttttgggtcttatttcctagtctgacctttcattgtagctattattttttgatatataatattcataattcattttgttgaagaggagattttatttaatgtcaataaatatgtatgagtgttgggaggaacatacctgagctgtgagggctggcgagaattatagaggacagtacagttaaatagaatgtggggataatgtcattgactgtaaacctcatgattgagaaaaagatggggatcatcttctgctgaaattcatcgtggaaagattctcaaaagcatattagaaacagatgacaacattaaaaggacacagtttattttatttggaaaatagtattcccttgtgggagatttgggataacagacttcnaaattttggctctgttcaaattccctgactcatngggtggcttgaaaaaatgatttaaatccactatcctgcaagatagaatnatgataattataacactgtacttggcacttgggngtaattatattaatggctagtgagtatgtatgattactatgtgtcaaatcatatgccaagcactttacaagctgtaactctgcatcctctgggaagcatgtaccattcttgctcttatttcacatgtaagaaaattgtagggccgggcgcagtggctcacgncagtaattaattccagcactttgggaggccaaggcaggcggcggatcncatgaggtcaggagttcaagaccatcctcgccaacatggngaaaccccatctctactnaaaatataaaaattanctgggcgtggggtgtgcacctgtnatcccagcttctagggaggctgagacnggagaattgtttgnacccggaaggaggaggttgcagtgagccaagattgtgccactgcactccaacctaagcgacagagtgagactccatctc

SEQ ID NO: 153363 - DNA, 398 bp, Homo sapiens
ctgaagtcacacggacgtcctgctgatgtgcctgcgagggcaacagcatttccatcagtgtctgaggttgtgaccacctggagaaggcaccctggtggctgtccatggggaatgtgggtttaatgttgctagagctttggatttttcaagcaaaagcaggaatctctatttttacatgaaactcaacacgttgatgacccttacatatctttgcttaaattgccatgtgagccacacaagttatgagttggtggaattcagcgagcagacctcaaggtgtggcctctggtacaaaccaactgtagggaggattccatggattcgacagcggagaatctcaccgggtccaagggaggggactggtggaggctgagtcttcagctgctccgcttgcttgg

SEQ ID NO: 153364 - DNA, 365 bp, Homo sapiens
tatggaggcatcagaaccaatgtaacaaaaaaggaggggagagtccccaaattatcctccccagagtccagatcatatgggagtatttcatgagagtcatttcatgggactagtggggcactgaaatcaagtttcttatccactgcccactcctgatacacatgcaccaggatattcccccctgggattagatctgactgatggcacatgaaaataaaggcaaggagtgaagctcagtatgattcatggacagagaaaacaacaggaacccaaattgtatgtgggccagtgatgggcagggactggagtttctgttctgtcccagatgcgcaaatctcacccaagtcagtcctgtaggaaaagca

SEQ ID NO: 153365 - DNA, 163 bp, Homo sapiens
atattgatgactctcttattaaatctcagtaaataaacaccggtggtatcttccttttcatggttcccggtaactctaaacactcactcttcataagccaagaagttacaaaaatgttggcatttgtataaaagaaaacagaactttgtaatcactaagtgtg

SEQ ID NO: 153366 - DNA, 581 bp, Homo sapiens
ctaaacacttcattcttcattcttaagagattggcaccaaatcactttgtcctgtttgggaaatgcagtgtttctcctttgggtgcatttttgaagaccaaggcaaaaaacattaaagttcatttttattgtctgtgtgggcaaaacatttgattttactgaacatgctccatagttacatggcaggatgttttgactggcataaaaactaaccaaacttctaaatgtgaagtaggtcaccggaagagtacaggactctttgtgagttgtttttctctccagtccagtattttcctaaacatgtttcctaaataacatagggatttcatttggaataagcaagtcatttaaatttattcataggtataggagggtccagaaatgttaaaagcacaagtggtttcaactgtatgcctttgctttatgcgatagtagagtaagttgaaaatgttttctactgaagcaagtgactgtttccctatgattaaataagagcagcttcagatggctggtttgcactgaagggtggagcaggcccatttgctttcacgtgtcagaaaagtctgctctaccccacccct

SEQ ID NO: 153367 - DNA, 689 bp, Homo sapiens
ttgctctgatcttcattagttcatttttcctactaattttgagtttggtttgcttttgtttttcttgttccttgaggtgcatcattagattgtttatttgaaatatttctacttttttcgatgtaggtgtttattgctataaaattccttcttaatactgctttgctgtatcccatagcttttgatacattgtgtttatactttcatgtgattcaagaaattttaaatgtacttcctaattttttattaatccattggttgttcaagagcatgtgttaattttgatgtatttgtacagttttgaaagttatttctgttactgatttctagctttatttccttgccatcagaaagtatacttgatgtgatttcagtacttttaaacttgttgagacttgctttgtagcccaatgtgtggtctctccaggagatttttccatgtgctaatgaaaaaaaatgtgtattctgcagctgttgcatgaactattctgtcaatgtctgttaagtctatttggtctaaagtgaaatttaaatacaatgtatctttgtgacttcctgtctagatgatctgtccagtattgagattgggttattgaagtctgcaactattattgtatgggagtctatctctccctttagatctaataataattgttttctgtagctaggtgctccagttttgggtgcat

SEQ ID NO: 153368 - DNA, 542 bp, Homo sapiens
cacaggccatccatcgtgaaagtcgtcgtcttgcaggatggataaatgcgttttctcttccttgccgcaaggcaaatggaagctagtaatttctagtcccatagcagtgaatacaaaatcaaaagaggctaactcaatgcagtgacagcttcaaaaggaattgtttttgaagattcttttttcccatagtgctggtttatttagcactgaaggtcatctgctaacccagctttcagcagcctccaggaaaacctcagtgtagcttgtgtcatgtattaacagtcccccaatttcacttatattttgctaagcagatacacatttgccatgacagcttaaagtgtcggtgcttttgaatggagactattttatctcgatgtatctgtaactggagggtcctcatgctcaggactggtaactcagattttgttttgaaggaactaatttttaaaaaaatctggtaactcagattttgtttgaaaggaactaatttaaaaaaaactttaatatgaattttctggttaatttggatgaccaccatt

SEQ ID NO: 153369 - DNA, 658 bp, Homo sapiens
cataacagcacattgctattcctcctccaactgcctgcccccaagtattttgcttccacataggagaggttggtttaggtgaaagaacatgggactgggagtctcataacacttggattctctttgggctttgacattaccttgtttgatctcagacaagttattactgctctgattgttctgctctttctttcagtccgtaacaataggatataaaatcaaagcacctgtcctgttaacctcacaggactatcagaggagtcaaatgagaaaagagttaccctgtgaacgatttttgtacttgtagaagacactaattttacattcattttttacatcttgtgcaggcataaaatacctccttaaacttaacgtagcttagtttaacttacttaattttcacttataaagcagttaccacctgtcaaaaaatctgagtgaagaaaagtgttacattatagttgctcagcatttcttactgcatgaaataatctttgttgtttttgccaaactctttaaattccttgaaaatgtgtattcttactaaacaaccttttctcctgagtctttggcatcagttagaagttaaaaagcactgcaagttttttgtaatcctgaagaggaggaaaagatgccaaaccagagtttattcaagata

SEQ ID NO: 153370 - DNA, 442 bp, Homo sapiens
ccaatctggtgataaaagtaaaaggattcagctgtctgcaagtaaaggctaatgcaacctgtatccatcccaactcccccaaataactaatactttcttaaaagtcagactacatttttgtatccatatttcacttctgtgtgtgactaattttaagatgatgccattaaaaccatctgattagtcacattttaattaagcatcaaaattcctacacagtgccagaatttatgcattcagaacacctgacttcatttgacttaaagaattcttagtattaatcataaatgaccaatataaacactattctttaaggaatgaataagagtcaccatttatatcctgaggaaaacatagcattgggattcgtctcagaaccagtttaagatattctttgttttgaaaatcctcttaaaggcactaaaaaaaaatctacccacag

SEQ ID NO: 153371 - DNA, 339 bp, Homo sapiens
gggagaggtaaatgaaggtggcctgttgatgtactgcatttgaatcctgaccctacttcctctgtctctgcccagccaaaccagtctgcctgcagcggggtagagtcacttttttttttcttttttcttctttttttttttgagatggagtctcactctgtcaccgaggatgaagtgcagaggcgtgatcttggctactgcaacctccgcctcctggattcaaacaattctcctgcatcagccttctgagtagctggtactacaggtgcctgccaccacacctggctaattttttgtattgttagtagagacggggtttcgtcacgctggccaggctgg

SEQ ID NO: 153372 - DNA, 571 bp, Homo sapiens
agctttttttcactgtttgtctgtcctgtgcgtgtactttactatttcaattgctgtaattttatgatacatttaatatttttttttgcagagcaaattctccttcattacttttccccacatttccctccatgtgaggatttcttttgccatttgcttctagcagaggagggatattcctgacatccgaggatggtaatgaaggtctctgttctggttcctctcccatctcacacacccaaggtgaaagagctatattttccagcacaggcaggacccatttcttgccttgggtctaaatcagtttaaatcagtaacgaggttgatggaaaggagagcaggtctacccaggacatcagtttgggagacaaggaagagcaccttggaaaattcagctgaaagtcaagtttgttccacctcgaaatgtggctgagaaccagcctgacgaggcttaggcttgtacattggagagaaaaagtagactgtttaaaatataaggcagcggctgggcgtggtggctcatgcctgtaatgccagcactttgggaggccgaggcaggtggaatcacctg

SEQ ID NO: 153373 - DNA, 263 bp, Homo sapiens
tgggagcagaagaactgtataatgagatgtgaattattttaaaggtcctagttgtattgttttgttttttggcgaaagccaattaaataactgatgagaatgtatcattatcaaaatattataaagaatttaatcctgtgtgcttaaggtctaattatataggaaagggggcaatctcagatagtttctatttggctttgcaatggagtcagaagagtcagatttccccctaagacagctccttcatggagctcattgcttct

SEQ ID NO: 153374 - DNA, 412 bp, Homo sapiens
taaggcacaagtgtacaaggtgccaccgtttttcagagtccacccattagccgccagcacagccttctcagcaagctttttgctgtgtgggtatggagcgtaccatgtgttttccagaggctcttcttcgtgactgttctggatgatttccttgtaggaattgggcccggctacctctggggtactggtgtagatgaagactggcactgtagcttggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaattaatcatttcaaagatgcg

SEQ ID NO: 153375 - DNA, 253 bp, Homo sapiens
tgcaatacttccacaactatatacttcttcatcaaacttggcataaaaagtcacaagtttttgacattttaggctagatgattaaaaaataataaaccagcctgggcaacatggtgaaacctcatctgtactacaaatgcaaaaaattagccaggtgtggtggtacagacctcgaagccagcccaccccaatgccaacgactgggccaccaatggtgtgggccggaaagtgagccactcatatggctacgggc

SEQ ID NO: 153376 - DNA, 256 bp, Homo sapiens
tggagggcccctcagatctataaggggccacagaaaggacctgagtcttcataaacctgcatgaatcagttattcatgtacatgctgtctcttaggaattcatgagatgaagacaattacctcatccaacatcactttgccctctcagggcaaaattgtgcagcacagttctctgttgtgctgtctaatgcattgcagatgtttacaagcatccctggcctctactcactagatgtcagtagcaccctcccctagt

SEQ ID NO: 153377 - DNA, 218 bp, Homo sapiens
agtttcctggtattagtgtgacttgcagctcattctgcaccattcactaaatgcctcttatcccttgttgacctacctctgggactaaagtgacatgtgggttttcagtagttttcagtttttgggctatgccctttgtattcagtcaaaccacattttgtcatgagccagtaactcttgggttttggttgtccaactacataatcaccatgactgta

SEQ ID NO: 153378 - DNA, 178 bp, Homo sapiens
ttgataaagtaagttggcattgtaagcaagagtcatatctcaaagggctttgtgagttgggtttcttcatccgagagcacaagggagtcacagaagagtttgagcggagaatgacatgatcagatgggtcatttaggaatatgactacagccacagtatataaaatagaattgagatg

SEQ ID NO: 153379 - DNA, 217 bp, Homo sapiens
gggagaggatgggaccccggaggagacttgtgccatgctccctagggagccgcaggcctaatcagtggacattgtgaggatcaaagggagcccactctaggaagcggggtgtttacgtcgtccactggggggacccagatctgcatcctgattgtgctcctgtcttgtgagtggagtaaaaggaggtgcctgtttcctaggtaatttagacaagagc

SEQ ID NO: 153380 - DNA, 860 bp, Homo sapiens
cacggggagctctgggtcctctctcgttgatgttgtgggcgatgctccctgaaacctgagctccggactcttcattccagactcttctctgcgggtctctatggagaagggaggtggacagctctggtggcaaacagtgcagctggggcaggaggaggccacaggaaacccccacagtggacttgggccctgggaagacaccctggggggtggaattcctcttgctctgttcacctgtcctgggcaagctccagagaagcccttaccccctgaatttctccctggtgcacggcccatcgagctgcaccctgggctgctcccctggggagcccatggccctggtgggcataggtaggcataggtgcgcactaggtgccattcagggccccaggcaccagaggtcccgactgctctggaaatctacccccaggtgagagatgttctcagaattctggcctggatccttctaggccaaaggtcctgctggcttgagggagctcagcacgttagcgcctccgacaaacgttgggtcattgaattaaactgaaggcccgtggaggaggtgccatttgcttctcgtagcctcccgtgagccccaaacccccagagcagaccctcctgggtgccagccactgcccgaggtgtttctgtccttacacagaggatgcaggtgacgccactgccctggccattcacccgatgcccctatgaacctgtccctctgcctcctctcaatttccgtctgtctatcagtctttgtctctctttctctgtctctctctgtctgtctctctctgtctctgccccatctctgtctgtctctgtctctgcctctctctgtttctctccatctctctgtc

SEQ ID NO: 153381 - DNA, 474 bp, Homo sapiens
gcgagtatggttcggaggccctggagaggatgttcctgtccttccccaccaccaagacatacttcccgcacttcgacctgggccacggctctgcccagtttaagggccacggcaagaaggtggccgacgcgctgaccaactctgtggcgcacgtggacgacatgccctacgcgtctgtccgccactgagcgacatgcacgcgcacaagcttcgggtggacccggtcaatttcaagctcctaagccactgcccgaggtgtttctgtccttacacagaggatgcaggtgacgccactgccctggccattcacccgatgcccctatgaacctgtccctctgcctcctctcaatttccgtctgtctatcagtctttgtctctctttctctgtctctctctgtctgtctctctctgtctctgccccatctctgtctgtctctgtctctgcctctctctgtttctctccatctctctgtc

SEQ ID NO: 153382 - DNA, 481 bp, Homo sapiens
caggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttgg

SEQ ID NO: 153383 - DNA, 448 bp, Homo sapiens
ctcccaagtagctgggaccacagccatacaacacatgcctgccttatgtttgtattttttgtagagacgaggttttgccatgtttcccaggctggtctcgaacttctgggctcaagcaatccacccaccttggtctcccaaaatgctggcattataggtgtgagttaccacactgggccaggattagaattcttggtctcttaacctctcgttcagttttttcctcgtcgactcacatgccctccaaatgaataccgaagttagattttgcatattaaattgaaagaaagttaaaagccttactactttctaattcagtgtagggaaaataatgggaaacatgaaaaaaaaaaaataacaaacctctgggatgggtgaaagcaaacatgtgtcttctcagttcctcctaggtggtatcttgaccttttatcccgtcttgtttttttcc

SEQ ID NO: 153384 - DNA, 168 bp, Homo sapiens
ctagttatgttcattgctattgaaatgtcactgctcccatgacatctcagtgaaaaaagctagagaatgtgtgtgggcatgtgtatgtctaggcaaatatatgcatatatatatttacctgcatatacaaacacatttacatttatatttctgtatcagttgtatatg

SEQ ID NO: 153385 - DNA, 499 bp, Homo sapiens
acattgccgttgggaatgtaaatgatgcagccactatgaaaaaccttttggcaattctttgagaagttaaacataaaattatattatgacctagaattctactcccatgtagatagccaagagaaatgaaaacataaagccacatagaaacttgtatatgaatgtttatcgaagcattattcataatagccagacagcagaaacaaaaaaaaaaaaaaaaaaaaaaaaaaaaatttggggggggctggggcgggaaaggtttttaaaaacaatccagttgaatgcggcgagcggggcccctcaacaaatgaggacctacagcggaacacagagggcccacacaacgcgtaccaccagaggaacaaccccgggcaccagcacaacaggcgacgggggacactaccaaccacatacaaaaacagccccggggagacaaacccaagacgggttgagaaacaaaacacgcgatgaaaccacgaagcgcaccaaggggaactaa

SEQ ID NO: 153386 - DNA, 937 bp, Homo sapiens
gggagtggtcagtgtatatttgtcgttctgaatatagcccttttgcctgttgactaaaccagacccaacatttattcagaagatatttatttgggtgtcacccctggtgtcatgatgcagagggatcaaaacaaacaaggaccatgttctgaaggagtttgcagttgaatggggtagatgggcattgttcagaggatatgccctctaggtcataataacaacccgagaagtactgaaggaaagaaacctggttctgccagggcagtgaacagtggggtgagggaagacttccctgaggaagtctcactcattcattgagaattaatgatgagtgagaattaagtagttgggggcaggaggcatttcagcagagggaacaacctgagtgaaggctctatggcagagaggaaaacagttgttggggaaactgaaagaggccagtgtgtggttggaacattgtacttgagcaaagagagtggagatggagtgggagtgggagaggtaggccaagaccccaacatgcaaggcctggaggtcatggctaggagttttattttttaggtcaaaggcagtgagatgacactgaagagttttaaaccgggaagcaggtgataggatgaccaggtgtattattttggaaaaatcatttggaccactgtgttcagaacatcttaggggaagaccagagggattgccaaggaaccaatgaagagactgtcttagtccattttgtgctgctttaacagaatgctactcactgggcgatttataaagaacagaagtttatttggctcacagtccaagagcatggcactagcatctggccagggtcatcctatggcggaaggcgagagaggaaatgggggttgaactcatctttttatcaggagcacactcatgcagtaacgtattagtccattcatgagggcagagccct

SEQ ID NO: 153387 - DNA, 433 bp, Homo sapiens
gggagtggtcagtgtatatttgtcgttctgaatatagcccttttgcctgttgactaaaccagacccaacatttattcagaagatatttatttgggtgtcacccctggtgtcatgatgcagagggatcaaaacaaacaaggaccatgttctgaaggagtttgcagttgaatggggtagatgggcattgttcagaggatatgccctctaggtcataataacaacccgagaagtactgaaggaaagaaacctggttctgccagggcagtgaacagtggggtgagggaagacttccctgaggaagtctcactcattcattgagaattaatgatgagtgagaattaagtagttgggggcagaagtgcgcctgggtgcagaagtgcgcctgggtgcggaagtgcgcctgggtgcagaagtgcgcctgggtgcggaagtg

SEQ ID NO: 153388 - DNA, 386 bp, Homo sapiens
tgataccatctaaggcaaagcagacaagagggaatacaggtcaaatggtagtatcatgtgagctgctgcatcacggttcacctgaggccaatctacttcagttatgtgggccaacacattcctttagctatttaggccccatttcagctagttttctctaatttgctgcacaaagatcccaagtgatatgatctctctgtgagtcctggtggatcttgcattcttaaatacaggcatcaacttacaaggagttttccctcatgccagaatataaaccaccaatgccatcagggactctaaaagaacttggaactccaaatgacaaatttaatcgtcagacagcaacctgatcagagatgagatgactggattcccaggtctggatt

SEQ ID NO: 153389 - DNA, 149 bp, Homo sapiens
atttgaaacatagaaaatgaacagttttatgagcattgtttcttttgtattcccaactctggagagctcccgtcatttacttattcttccattacctaaatcccagtgacaaaagcaggaagataataatgaaaaaacaaaagtacaaa

SEQ ID NO: 153390 - DNA, 327 bp, Homo sapiens
gacagcatcccatttagagcaaggccctgcttccttgaatcctccctcaaatcacctaacacaaaccaaaatcccataagtcctttctttttttttctgagacacggtctcactctgtcacccaggctagactggagtggtgcgatctcggctcactgcaacctctgcctcccgagttcaagtgattctcctgactcagcctcctgactaggtgagattacaggcatgcgccaccactcccggctaatttttgtattttttagtagagacggggtttcaccatgttagccaggatggtctcgatctcctgacctcgtgatccaccca

SEQ ID NO: 153391 - DNA, 627 bp, Homo sapiens
cagccagtgcacggtttctccttgtcagttgtggattgagcgtccactggtcaatatagtggcaatggtggcagtagcaccagtggcagcagaagtctcagctttcttctatgggaacaccttgagccattgctagggcttctgtggcctaggtataaaagacctgtctaaggctgagggggaataggtgggtccaagcagcacacactgagtctagtgcaggtgggcatatgctgatatggccacagttcctctagctctttattcagtacacagaactgaagcaagctgttagaatgccggtgtcagtggagggagggacatgcctagttcattgcatgtttcccagcagtggacaatgattctgagaggtgacagcatgctggcagccctcactggctctggccacctcctcggcctcggcgcctgctctggccacgcttgaggagcccttcagcccgctgctgcactatgggagctcctctctgggctcgccgaggctggagcctgctccctctgcttgtaggaaggagtggagtgagaggcgctggcgggaacccaggctgtgcacggtgctcgcaggccagcgcaagttccgggtgggcatgggctccacagcccccacac

SEQ ID NO: 153392 - DNA, 348 bp, Homo sapiens
taaattcccccctattttccagacacaggaagattttacatttccctttgtgtggaattttagagtgagattggcttccacccctgggtttcttatgcttagcaaagtagacaatcacaatgacatttatagattggtcttctttagagagctaacattgcaattcagccccactggtttctatatttttgagcaaaagaccaattgttaatctttattacttcatttggaaaacttaaccttttataaccaggtaatttttaatttttgttactttgttaaggtaaaatgtgcacacggcataaaattcaaaagaatattcatcgatttttagggggaacagattca

SEQ ID NO: 153393 - DNA, 327 bp, Homo sapiens
aacagctgctgtgcacaagagtgagaatgaacctgtaagtcctcatgtccccatcatggtgaataccattttactgtatgagggtcaatttagaaaagctaaaatgtgttcctgaggtgaacggtttctttttcctttctcaaaatgaaaaggtgtataatccctcgcctatgtcttaccacttagactgcaggtctgcctagccctgctgagatgtaaataccttggcacatctggggagtcacaaaatggcaatagccttatagcccttcatccctcccatcaaataagcacattagagaagtctgtttatagaaggtatttcat

SEQ ID NO: 153394 - DNA, 155 bp, Homo sapiens
ccccaatttatgcatgagtgtgcgcgtggggtgagtgccgccgacgtgactgtagggggccagtgtttcacacagctcttgagctgctggaggtttccgtagccatcattgtcacctgctggagatgtacagcctgaaatccagcttcctctctg

SEQ ID NO: 153395 - DNA, 315 bp, Homo sapiens
tgccagtctatgctgctggcaaccacctgcacccctacctggaagctcactcccgccttcttcaaggggtctagcctgggggcggagacagtaccccatgagagcagtaggcaaaagaggcccagggagggcgactgggtacagacacagaacctaggccccatcctctcgctctgggctcggtgcgccttccgcaagagcttcggagtgcgtctgctgcccaccctactgccggctcctccctcactccttccatcccaaagaagccacaaatgcgatctccaccacattccctcacagtcctccaagcaccag

SEQ ID NO: 153396 - DNA, 286 bp, Homo sapiens
cgtggttccccagaaagtgtaaggaatgtttagggtttggctaagcctggctttgaacctgatgctaataggggagaaggcatctttagacctgacctgaatccaagtcaggggtccagtcagttgcctggcacagctgggttggtctcttttctcagagacatctatcggctgtgttactgaggacagcaagttgagggttgcccccaccccaggagcacagcccatcactggccctattggcccttcataggcgtggtcctctgctaaggatggttaaattctg

SEQ ID NO: 153397 - DNA, 584 bp, Homo sapiens
attccagcactttgggaggctgagatgggaggattgcttgaggtcagcagttcgagactagcctggtcaacatagtaaggaccccatctctattaaaaaaaaaaataaagaaaaaagacagaaagagataatgcatgaaaagccttagcaagggtggccaacctgttcctccttctgtgattatcccagttttaggactgacaattttatgtcccaggaaatccctcagtctcaggcaaactgggattattggtcactccaaccttagcacagagtctggcacaactcagcatcgcaatcaatgttgttgtattcgttccctggtggtgagctcagcaaatgctctggaaggctggcgatcggaggtggataagggaagctgtgagttctgattttgtatctacctcctcaaggacaagcaaactgaggcagggaatttactcactgccccgacaaatactattgagcatctactatgtgccagggactgtcctctatgctggcatagaagggggctaggaacacaaaggtcaataaagtcttggcctgaaggatcctaaatctaatagcagacctaaaactta

SEQ ID NO: 153398 - DNA, 253 bp, Homo sapiens
gggatgaacactaatggaggcaaacactaggggggaaagcaccaaaaggtccaaagacgagtgagacctagtccctgaagagctgagatgcctttcctttgtattatgtgttacgatttacaaagcacttagcttacatgaaataggtgggtatacacttactctgcagaggtgggaaaactgctgctgagaagagttcaatgacttgcccaaagccacccagccaataatggctgcctgagtgcatagctta

SEQ ID NO: 153399 - DNA, 384 bp, Homo sapiens
tttgtaataaatgatagaatatcacacacgtatttctccactttgcttttttcacttaacagtctattctggagatcactatctagtggagtgtagagatactcgtcattgttcttttcagttgtagtactccactgtgtagtattcattatagtttatcatttattcagtgtgtccctcttaattgaccaatgaatgttggttaattgaatgactataattttagtcttagagttgtcccttatttttgtattattgcaagttataggaatttttatgtttataaaatattttgtatatgaataagaaaatggaatgattaacattttggtttctggtgtaattatttggatataatcttttctgttatttaattttgccacc

SEQ ID NO: 153400 - DNA, 146 bp, Homo sapiens
tttgcatatttccagatcctgacatggggtttgtattacggtaggccagtaattctccaacttttcatcttggaagtcttttacactttttaaaaacttttttttttttttgagacagggtctcactctatcacccaggctggagt

SEQ ID NO: 153401 - DNA, 408 bp, Homo sapiens
ggagttcaagaccatcctgggcaacacagtgacatcccatctctacaaaaaataaaattagctgggcatggtggtgcatgcctgtagtcctagctactcaggaggctgaggtaagaggatgcttgagcctaggagttcaagactacagtatgctatgattgtcccattgcactccagcctctgtgacagagtgagaacctgtggcaaaaaaatgtatatttatagtatgcagatgtgaaatagaagctataagcttgtaattctgttatggctgctcaggtttacactcttatagtttcatttctgaataagttaagtacatttctaaaaactgaggagaataaaaacaatgtcttgaggattgtgttatctgatgaaccttttattgatctgacgaagacccatttt

SEQ ID NO: 153402 - DNA, 164 bp, Homo sapiens
agaaagagaaaacatttcaagttgatgcctgcgtttctaggtagaatcacatgatgacttccttcccgttattatagccctggctccctgttagtcagggaagatgaacctagaggaagtagaaggaagaagagtgacatgcaggaagcttccctagaaacatt

SEQ ID NO: 153403 - DNA, 557 bp, Homo sapiens
gttttctttatctagtgtagaaatcatcactgaggactccactgatttaggaagtcagaactgtctccaggcagttgagcttttgctttccgcgagctggattccttagaaaggtttcatatgtatgagatatataataatatcccttattttgaaaccagaaatactgcacctcaaaagttacccattatcagttctctaaggaaacacttcatcaggcaagtaatttccctttctttataggatataacttccctaataaaacacctacaaatcgaactattataggcaactaccagctgggtgcggtggctcatgcctgtaatcccagcactttgggaggccgaggcgggcggatcacgaggtcaggagtttgagacccctgtctctactaaaagaatacaaaaaaaattagctgggtgtggtggtgcctgcctgtaattccagctacttgggaggctgaggcacgagaatcacttgaacccaagttgtggaagttgcaatgagctgagactgtgccactgcatccagcctggtctacagagcaagactgtcac

SEQ ID NO: 153404 - DNA, 612 bp, Homo sapiens
aaaaaggtagaaagggaattgggagggaattaagttcatttcctggaaaagggagtatttacagacattattactgttattattttaaaattcagacaaggtcttgttctgtcacccaggctggagtgcagtggcctgatctcagctcattgcaacctccacctccggggctcaaacagtcctcttgcctcagcctctgaagtagctgggactgcaggcatgcatcacacaggctatttttttatgtttttagtagagaaggggtttcaccagcctgggcaacatggcgagacccctgcctctattttaaaaagtacaaaaattagctgggcattggtggcttgtgcctgtagtcctggctacacaggaggctggagaattacttgagcccgggaggctgaggttgcagtgagctgagattgtgccacctgggtgacagagtaagacctagtctcaaaaaataaaataaaataaaataaaataaaataaaataataatttttattcattaatgtatttatatcagcctgaactcatgtttatagtcagctctcggtatctatggatgggttttgtatccatagattcaaccaaccacgaatcaaaaaaaata

SEQ ID NO: 153405 - DNA, 479 bp, Homo sapiens
tgccaggttgcactgtcacacagcccagctgattcactgtgggagggggctatacaccagcatgggggccaagagacgaggtcacccaggccatctggaaggctaaccgctgcatgatgtcgtggtcctgtgacatgctgctagacgtgtgtgggcagaattctttgcctgactctcactcagccagaggccagaggcctgcccaccgcccttctccttatctcagtcctttgtgctggcctctgctggggatggtttctgtctggacttttaatcttgtgtggaagccccttgtttcccaatggcaagtctctcttgatttgaaaatcactgatcacctttgtgtgttttgcccatcagaaggtgtaggataaatacatgtctttgtgaataatcttacaaacctcaaggtatagaatgacaattcagcaattcaaaaatatagatcatacaaagataacaacctagctgtaactact

SEQ ID NO: 153406 - DNA, 122 bp, Homo sapiens
caagttatgtttgaacttacattatctcttatattgttagtttcccatccatatgttctatattcccaaagtaaatggtcagatcctagacagcataaactacacattaaatctctttgtat

SEQ ID NO: 153407 - DNA, 684 bp, Homo sapiens
ttgagaaagtctgtctccctttgaattctcattatctccgtgcttgtcaaacacttctgaccgcttacgtgtgcaaaaccgggggactaaaattaagaatataggtataaagacagagtcatatagtcaaaataacatggtaaaggctatggtatagtaaaattccattaaaaatcattatgggtgaatacacatagacatataaagaggaataatagacactatagactctaaaagtgggaagggtgggaaaaggcgagggctgaaaaattacctattgggtgcagtgttcactatttgggtgaagggtaccctagaagcccaaacctcaccattatacaatacatgtaacaaatctgcaccccctgaacccataaaaataaaaaattataaaaataaaaaatcattatgagtaatgtaattattactctagtatctaacatttctaaattatttaaagtgctattcacaatcatatatctatatttcattaaaaatgagagtttacaataaaagatacctgaatttaccatgagacagaccagattttaggatttaaaaactttagtatcccagcctggccaacatggcgaagccccatctctactaaaaatacaaaaaaaaattagctgggtgtggtggcgggtgcctgtaatcccagctactcgggaggctgaagcagga

SEQ ID NO: 153408 - DNA, 424 bp, Homo sapiens
aggcgcttccctgcgtggcactggagttttggcttgcaggatatgctgcaagctgctgctaaagctactaacatcgcagcttggccttttaaagaaacatttaaacagaaattgacaaggcttttaaacagacatatacagtggcttaacacaaagaacttgttgaaaaaataacacccaccccaaaggggctagctgtgttaaatatatatgatttttttcacacagcaagatccatcatcttagtttttagcatcttggtggaaaaaggggagcatcatctgccggaaacagtgaaggatacctaattttctccatcgacactgcacctcattcccactcagtcccagcactcagttaaatgggacctctcgcttcattggggtgaggagggatagcttccaaacaacagggagtgaaattc

SEQ ID NO: 153409 - DNA, 241 bp, Homo sapiens
gaacaggctgggctaatgtgagctctcagcctggcagtcaagacatcagcatgggcaaggttctgtttccaaactgctgcttctggtgacattccaagacgcctggagggtgggagtcaggaagtaggacacacccctgcagtctccttttcttggtccactcccattcaaatttgagctaatttctcattctgataaaagccataggtttagctaggatgaagtggtaggaaggtccgtg

SEQ ID NO: 153410 - DNA, 509 bp, Homo sapiens
cagcatttgttctcctggctcccaccctgccaggtctctgtctgacagtggctcacgcttttccacagcccctgtcaggtggcctctcccaaagtgacagtgttcacttggttctgtaagtgttttctccattgcctcttgccagggagggtaatggcttcctagagccagatgccagcacctgaggttgcccaccaccccatgctgtttcccttaaccctgcctacactttcaagaattgaaactctttgcagcctcctttttttttttttaaaaaaaaggtactatcgatttcctaaaggaccgtgagtgatatacactcagagattcttttgtcatgttactttccgtagctcaatatggctgttatccacattatacaaagaacataatacctaccttaaatttttaatattttgtctttattcttcaactctgtgtagcatttccttctggttaagaacatgcagataatccaaataaacagatttgactaaaagaaaaaaaaa

SEQ ID NO: 153411 - DNA, 179 bp, Homo sapiens
gcctccaatatgaggcagaaatgttaatatgatctcttactctcctctccagttctctttgtttctcagaacattctagagagcatctagtaatagtgacagcccatgtctctgtattccttgctttccttcatctgattaaataatactgaggaacagaatcttggtccctcttgagt

SEQ ID NO: 153412 - DNA, 294 bp, Homo sapiens
gtggcgctgcagctcgtccgagcgcgtgaagcgcttgccgcagaagagccagttgcacacgaagggacggtcgccgctgtgccagcgcaggtgcgccttcaggtgcgacgtcttggcgtaggctttcccgcagcccgggatgtggcagttgtgcaaatgcttcttcttgcccccatcgggcccacatggagcccccagtcgctccgcctccagacagttggggcagcgacagacggtctggcctgagctgcggggcaccgaccgccgggagcctttgggacgcgccgccccgtc

SEQ ID NO: 153413 - DNA, 382 bp, Homo sapiens
aaagaaaagaaggaggatgggtaagaaagggcttggagagtctgggagcctatgtgagtctgtgtgcaaagcatattaactctgactctgcccaaagcttacagagaagatattcagatgtcaagttatactgatataccatagctctttgaaaatgaataattggtccttataaaagaggaaattgggatacagagacaggcctacagaggaaaaaaactgaagacacaagaattgaacagccttgtgactggagtgattcatctacaaaccaaagaatacttggtgctaccaaaagctgggagaggggcctgaaaaagacccttactgggatctttcacaggaaatgtgccctgcagataccttgattttggacatctaa

SEQ ID NO: 153414 - DNA, 310 bp, Homo sapiens
  misc_feature (203)..(204): n is a, c, g, or t
  misc_feature (208)..(209): n is a, c, g, or t
  misc_feature (260)..(260): n is a, c, g, or t
  misc_feature (280)..(280): n is a, c, g, or t
ctacattcccggggagcacacacagcctgccagcaccctgacctgggacttccggcctgcaacccaggaggctcccccgcagtcgggagcgtgactaaggcgacagcgatttctaggatagtcagtagaattagaattgtgaagatgataagtgtagagggaaggttaatggttgatatctgctaggcgtttgggcgcggccnnttcnncaattaggtgcatgagtaggtggcctgcagtaatgttagcggttaggcgtnacagagaccccaaagagggnctaatttgggttgaatgagtaggctgatgg

SEQ ID NO: 153415 - DNA, 332 bp, Homo sapiens
tgcaggctcgtttgagtatctggtcattgaaatctcactatttgtatgttggtaataatagtttgcttgtttctgcctatttcattgcatgagagaatgaagtgtgcacgtaaggtcacacgtttgatacagacagatactctctaatttacgacagggctgccttcccagaaacccatcctaagttgaagatacttttaagtcggaaatgcgtttaatacccttcagtctactgaacatggtaacatagcctcacctaccttaagtgcgcttggaatgggtaaatgttagccgacagttgggcaggagcacctggcagtgcaggttgccat

SEQ ID NO: 153416 - DNA, 909 bp, Homo sapiens
tactgcggaccctgctgcaggctgccctttccacagatcccctggatgccggggtggattacagcggatactcgcccatgcactgggcctcctacactggacatgaagattgtctggagttgttacttgaacacagcccgttttcgtacctggaaggaaaccccttcactcctttgcactgtgcagtgattaataaccaagacagcaccacagagatgctactgggagctctgggtgccaagattgtgaacagccgagatgccaaaggacggaccccccttcacgccgctgccttcgcggacaatgtctctgggctccggatgctgctgcagcatcaagctgaggtgaacgccactgaccacactggccgcactgcgctcatgacggcggctgagaacgggcagaccgctgctgtggaatttctgctgtatcgagggaaggcagaccttactgtgttggatgagaacaagaacacggccctccacttggcttgtagcaagggccatgagaaatgtgccctcatgatcctggcagaaacccaagaccttggccttatcaatgctaccaacagtgcgctgcagatgccactccacattgctgcccggaatggtctagcttctgtggtacaggccctgctgagtcatggggccacagtgctggctgtggatgaagaaggtcacaccccagcactggcctgtgcccccaacaaagatgtggcagactgcctggccttgatcctttccaccatgaagcctttcccacccaaggacgccgtcagtcctttcagcttcagcctgctcaagaactgcagcattgcagccgccaagacggtgggtggctgcggcgccctgccccatggggcctcctgcccctacagccaggagcggcccggcgccattgggttagatg

SEQ ID NO: 153417 - DNA, 337 bp, Homo sapiens
gccggacgtgtggttcacagccgtcatttcctctctgtccgctccagagcctcagcactcagatttggaggaaaacctgtagctggcgaggaagccaggagtgtccccacccccactctcttttctctgtttacccccatgttacctgtctcacggacacattgtacacggagacatccttttgacagtttaaaagaagtgcataaaaccgcgtacacatcgacaagctgcagacactcttactcccatcggctctcagacaaaacgcagttggacgttaactgacttatgcccattccttagtctataagcatttccccagcactttcctgcaatc

SEQ ID NO: 153418 - DNA, 404 bp, Homo sapiens
tgatttcatttccataacgtttttgaaatgacaaaattctagaaatgaagagttgattagtggttgtcaggagttatggagggggtgggagcaggaagtcacgggttgtggctataaaatggcaagatgagggaactttatggtaacgaaaatgttctgtatcttgacagtatcaatgtctatatcctgattataacattgtgctattatatgctgttaccattggaaaaaaaatgggtaaacggtacacaggatcttgattatttcttacaactacatatgaatctacaattatctcaaaattaaaagttaatttttaaaaacaaattcagggcatacacatacaaaactaaatttatcttttataagttggcagggttctgctgatatagaccaggtggctc

SEQ ID NO: 153419 - DNA, 281 bp, Homo sapiens
ctccacaaccagcagtcacagctggaaagggtagctgggctgaggaaactgcagcccagggagggtgagtgggactcagggatcctggactccaggtcagtagcacacaccagcacagcgcctaccccagaagccctgggccagacccacccagccttaatgtcagggcacagttagcctggacacaaaaccatgaataactcatgtttgcatcgtgttctgctgttttccaaactctttctcatccctcactctctcctgatcatcatgcagtcttcaat

SEQ ID NO: 153420 - DNA, 146 bp, Homo sapiens
tcatataactgattgtaacgtaattactaaacttccttcgaatgaaattgtgctgctgctcctcatgtgtatacttaagaaggcatgttttgaacttgaagttcatcctgaacttagcatggagtataaagctaggcttgaaactg

SEQ ID NO: 153421 - DNA, 419 bp, Homo sapiens
tcagagttcatgtcatttacaagctgtgtgtccctggagaagtcccttaacctctctgagcctcagtgttctctgggaagtgaggacagtgcgtgaaataatgagtgtgcatgtgcagtgccgtgctgggcacagaggtggtgctgacaagtggctgctgctattgtgtgtcgattgtgacagtaggtggggggcaagtagaaagtagaaaggccctgagcgaggcactggtctatgccaacccagctctgttggatgtgctgtgtggccctaggagagtgtcaccacctttctggaccccaagctctccctgctgtctcaggcacatgatggagatggtggtgcttgggacaactctgagacctgggagaatggagtccctgccccgactctgcctctgcaaggtccctggactgtag

SEQ ID NO: 153422 - DNA, 217 bp, Homo sapiens
cttccaccgtatttccctagagtggtgactgcactactatcaatgcaataacccaaactagaaccctaagaatcaccctaatcttcttccctttcctttcctgcactgcctatacctaaacataaaaaatcctgtgattcttctctcttcaatatgactgaaacttaccccttccccactgccataggcttagttcaggcccatctctcttctggac

SEQ ID NO: 153423 - DNA, 420 bp, Homo sapiens
gttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagt

SEQ ID NO: 153424 - DNA, 330 bp, Homo sapiens
  misc_feature (2)..(2): n is a, c, g, or t
antggaagtacagaggacaggcagaatagtagtacagaaacagcaaaagagggccgctgggcggggagaggcctgtgggccatgtggacagtgtgtagaccacccagaggtgtccctgtgaaaattcccccaaaacaagccaggcacagtagcaagcatctgttgtcccaggcacaccagcttgtcttggggggtttgaagggcaaggtcaccaaagtgcctgacttcctctgtaataacaaagggcatgagatgtatcaatgagtggaagtgacagaggacaggaagaatagtctgttcagaaacagcaaaagagggccggtgtggtgg

SEQ ID NO: 153425 - DNA, 682 bp, Homo sapiens
ccgggagcccttaaccctccgggagcccttaaccctccgggagcccttaaccctccgggagcccttaaccctccggcaccccttaaccctccgggagcacttatcccttggatttgcttggtcccaactgtagacagtcccaggacaccagaagtggacaacagaatcaggcaaacttaaatttctcagcagtgatgccatcaccaaaacagagactccaggccccatgagttaagtactgcatcttcaagcaaatgaacaaggccaatgctgtaggtcagcattggaaccaactcccaagctttcttcctcccacaaggagatattttgcaagtagctattcttaaatatgtttttgtaatcacagcctgggatactaaaattgaaactggtaacagacactgctaaaaaacttgttttgatttcactcgccacatcacttttacctctgattcacaaatcgcagtgaccaccaccattaagaaatgttttaaaaataagttttaggctgggcatggtgccatcagagcttactcaacctcccaggtcaagtgatccttccacctgagcctcccaagtagctgagactacaggctgaatgtgaatgttgaatgaatgaatgaattggtgttaaacagattctcgctctgttgcccaggctggagtttgcttgcgatgaagc

SEQ ID NO: 153426 - DNA, 922 bp, Homo sapiens
  misc_feature (1)..(1): n is a, c, g, or t
ntcaggaactaggcatttggcttgggtccatgggactgggaaatgtggctgagctgcttgtccaaggagaagagcagaaggtttgggcctgccaagaacaaaagcactttaagggaacagaagaattgctgttaccaggcacctgtgatgagtcaatcactgcagataaacaccaaatttatgtgtgttcatcttggcagccaaggcaaaaaggaaaaatgtgtttctcccaaggttgcctgcatacacaaacattttcttggctcaaaactgaatggagactttaacatgtggtttcttatgttaaaaacattgaagaacataatggatggatgatgccttcacacaatcttatgaaaaacatggacattgttcaactataaaaggttcaattttaacattaaaagaaattcagtggaatcctttctatgggttgctgagataatgaaatccaaatatatcattcctaaatacccaatttaaaacagacagagctttagacaatctggaggaagaggtaatcaacctatccaaaagacagcctctctctcaaaaaaaatgtctcaaattagcttttggaaagaactgctctgctgttagtttagaagttctgaattcctagtatttgttttgctaattcaaggtggacccttttagttagttgacttgtgcctctctccaacccccacgaagggaaagatacttccttgtccacacacacacacacacaaaaagttcatgcaaaacttgtggattccaatataatgcatttgacaaaatgtctcttaaaaatcagttccaaatggtagctggataaaatgacattacctgattgtgtttaattttgtagttgtcgatgtcattttattctttgtacccctacttcaatgaattcataaaataaattttaattctttgaaga

SEQ ID NO: 153427 - DNA, 452 bp, Homo sapiens
gaagtatgcccctgtggaaacactaccgggagccaaggagattgccctctcatcgcggggccagtcctagaagccacttcttccccaaggcaatggcaggaggaaagatttgacttagtgtggggatgataaagatcaggaggttgcagcacatcatcataggaagatacagagaggctgtgaggagcaagacaagtctgaaagccaccaagagggagacagtactagggagacttggcagggtttgtagtaaagcgaaactttgccagtcattagaaattagtttagaggcattaaaatgctgcccaaatcttggaagataaacttgtgctctggtgaattattcctctctctctccctaattcctaattgcaagaagttgctctagaatcagctgggactgaggggttgattgtggtggatttgctcccctcctccacctgcaccttggc

SEQ ID NO: 153428 - DNA, 170 bp, Homo sapiens
atggtatcacatctgctgggtttctggtgaggcctcagagctcttactcttggcagaaggtgaagtgggagtaggtatgtcacaaggcaagagtaggagcaagggagagagagggggaggtctcagactctcttgagtgagcattcactcatccctaagggatggtgcta

SEQ ID NO: 153429 - DNA, 503 bp, Homo sapiens
tgctgggatgacaggcaggagccaccgcgccccaccattggagttccatggtattgagaaaggggctgccttctgcactaggggtggcattgaaagttctcccacatcctggacagaggcactccttaaaggaatctttcaatttaaagggaaaaaaaatctctccaaattgcttcacagttttcatgaaccaaacacatgagtctcttgaattcataaatattcagtgatgtccctatttaaatacttatttatttaggaacctgcagttcagttcagttatgacacataataatcctgaaataattcatggttttgactttataaaaagtgttatgtgatgcacaagagggtgaagggggaggaacttgagcaagcagctgagagctggctctaggactagatttcctctgtaggcgttaagcatctcctgcaaccaaatctctctaacctctgcaaagcttaggacagcatttgactcagtccaggctcacctcggccct

SEQ ID NO: 153430 - DNA, 246 bp, Homo sapiens
caacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagagg

SEQ ID NO: 153431 - DNA, 561 bp, Homo sapiens
cccttctatacaatactcattcatagatgtctacattgatatgtgattcacccattcttttagaatatggttataaactttcaagcaataattcaagcaatatttcaagcaaaataatttgaaaatttgctataaactctggacttttgcctggaaattgcatctatacatatctatttatttagaaatcagggacgtcctgattcttctttagagaaccatgttgctagttaagaacctgaactgttctcaaaagcacagttacattattagatcaagcctaaccattaagagggctagatacacagaccacgttgttttgcttcccctgattaaattgctcttattgaattgggcattgttgtgcttcactcagcattaaagggcattttgagaaatagctctttaaaattcaattttttttggtaggaattttggagactttatttccatatttttgaaaacatgagattgcaatccattagtgggttgtgaaacaatttggtggtcccaaccagtatttcttggttttgtattgtttcttttgcttttttcctatgc

SEQ ID NO: 153432 - DNA, 348 bp, Homo sapiens
tagttgggcatggtggtgcacacctatcatcccagctacccgggaggctgaggtgggaggatcacttgagcctgggagattgaggctgcagtgagccataatcacgccactatactctagcctgggcaacagagtaagaccctatctcaaaaagaaacctcaaaaaccagatagacgaatggccactaaccatgtgaagtgatgctgaacatcattactcagtagggaaatacaaatcaaaaccacagtgagttactacttcatacctattatggatagttattattaaaaaaaacacacacacatagggaacaacagtgttggcaaggaagtagagaaactgccatg

SEQ ID NO: 153433 - DNA, 377 bp, Homo sapiens
gtcattctccagctcactcccaatcccaggctcaccctccttgcctttcccaggggccggggagggtgtgtcaaagcagggtgctgctgtagtgctgttggtgatgcagtgagtgtttttcttctctcagcatggatggccagcatcctggcacagaatcttggaactgggattaaagagcaggtttctggcatactgaagctgcacaggactcttggaaagtgtatgttccattcctgctttcagagaaatagccacagtgtagactctgagtcgtcttggtaaaagtcaccacttccagaagcagaggctacaatactgccatctttctcttctcaatacaaaacccaagcctctgattcttacctgaacccacg

SEQ ID NO: 153434 - DNA, 716 bp, Homo sapiens
ggcggaccggactaaaaatacgtacagtaattgtaaagcactagttatcagagagaactttaaatcattagcttcattttccagaggcccgggccagggacgtctgacagatctgttcaacgtcatagaattaactcatgggttgagaggctgggcctagaatctgggcatactgcttccacccagtgtgttccttggctcgttgagtgaccaaagcaccgcagtcacccagtctacctctagattatagactcatcaaacaattgaagctgcagagcaattcatttttaaatgacttctaatatgaagcactacacaattatcagtatgcccttaccacatagaactgggacctatcttgtttttccacagtagaaagcattcagaatcaagacagtgcaagccaccttctccagttccttagcaattgttctttaactgatttttttgctgcaactttacaactaaagaattactgttttataaatgaataaaacaaggtgcaagagaatggttctgatatgcacaactggttgatttgatgattctgaatgatgtgtttattaattgattcaaataattgtttttgacttttgaggattaaatttctggctagtttgatgatactaattacttattttaaaactcttaaactcctacatatatataactcaccgccagtcgcttttgttaggtatttctaagtccaaactgta

SEQ ID NO: 153435 - DNA, 222 bp, Homo sapiens
cttgtatttatagacttctgatcccaggctttatgggcggagacatgcttttatgaggataaaaacccacattatccagcgaggaacacatgagggatgtaaaagaaaagaggtcttactgtttcctttacattctgtcttctacagtcctagtgccactgctttagtggaggtcatcattatatcttgcctggaccagagaaaaagcctgcctaactggtc

SEQ ID NO: 153436 - DNA, 404 bp, Homo sapiens
caactctgtgaatggactaaaaacattgtatttatatacactttaaattactgaagtgtacagaatgtaaattatatctcaataaagctgatatgtgcatacacacacacacacacacacccaacagcagaagaaaatacctaaaaggtaatgaacaaaagcattcagattaaagcatgagaatctgaaggtttggtcatctacatcttgttccatagataagcatagactgtctactaaacacagttgtcaacttgatccaaaaatcttcgctggattctgtttctttcaagactgtttctagaggggtccacaaataattatctttgaagtttctgattaggacatctttcctgggattctaagattatttatgcctctttaattaaaagactttaaggatc

SEQ ID NO: 153437 - DNA, 474 bp, Homo sapiens
cacggtatctctaacattaggagaggatgagagcccagagggtaacagtaacagcgttcaggttatcgaagataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttagagatacgtatctctatcattaagtctctcctagaaaactgtacagcagctaaatcacagattccatatagttagcctcaaagtgcttaggaagaactcaaagaaagaatacaaactgtttaactttatatctagtatgtaaagtttgtaatgaaggt

SEQ ID NO: 153438 - DNA, 214 bp, Homo sapiens
tttgagatgtggagttggagtttttatccttatatgtttaaatgttatgtttggccataaaacaagcctccataaatgtaaaagaatggaaatcatacaaaatatattcggtgaccacaatagaaagaagttagaaatcaataacagaaagaaatttgggaaattcacaaatatgtagaaattaaacaacacactattaaagaacgaatgtgtt

SEQ ID NO: 153439 - DNA, 279 bp, Homo sapiens
gattctggctcagtgttttgtgaagttttagtcaatatattggccagggcctgcagtcatctgaaggcttgacctgagctggagaacttgcctctgagatggctcacttcatctggctgttggcaggaggcctcagtttcttacttactatataggcttcttctccataggagtgcttaagtatcctcctgacaaggcagccagcttctttcagagaggatgatccaagatatatagagagaagctaccatgtatggaagttacattccgttattctgc

SEQ ID NO: 153440 - DNA, 571 bp, Homo sapiens
  misc_feature (539)..(539): n is a, c, g, or t
ggactgacaggtcaaatggtcacacatttttactgtgttaaaacactgccaaagacaccgcatcagattacgctcccccaaccacgcgggagagaccccgtctacatccttgccaacactgtatgttatcaaatgttccttttgccagtttaataatcacatatttcaaaagttgtacttctttaattgcaaacagaaccaggcatcttttcatgtttatgtgtctttctctgttcaaattctttacccaaattgattttaaaagctctttatgcattaagaaaaaaaacaggccagtgggcagtggctcacacctgtaatcccagcatgaagattacatttgggaggccgatgcgggcggatcacctgaggtcaggagttcgagaccagcctggcgagcgagactttgtctaaaaaaaaaaatcaactctgaaatttttccagtacaagtgtctgcgatttcaccccctttaatattttaggaaaactcatctcacttgcttgctttatttgcctgtgctgttggttccacgcactcntcagctcctccaggggaagccctggttcccca

SEQ ID NO: 153441 - DNA, 371 bp, Homo sapiens
agaaaccagatttcttgaaattcagctgttacactctccagagatcctcctcccttattgaaagtgatccaggttgctcaaaccaatctttttgcttctccttgtaacctaagtgtgcttgataccttttgtttaacacttgagattgtaaggaaccttaccattgaaaatttagatgtgaaaacataagctcttacaagttgttatagaatttattttattgtttgtcatgtttataagtagtgttgagaattaacggctttcccaggattccagtttgctttcttttcaaagagaattgtttgggccatgcctggattctaaaaatattctctcccccaaaacaattggtttcaagaagcaggaactgg

SEQ ID NO: 153442 - DNA, 285 bp, Homo sapiens
acagagtaggtgcttagtaaacatgtatgaatgaatgaataagcattggatctcagaccttactgtgaagaggaagagataaaagataaatttataaattgattatgagataatgtgatgcattattgtagaatgaacaagtaatgtccaagaaagaagagatcaaagagggctataattcattcagtcaactgctatctgcatcctgtttccctgtgttagatgaactagtggattagaaatatatagtccctacaatcatggaacatgtaaactaacaaagca

SEQ ID NO: 153443 - DNA, 740 bp, Homo sapiens
ttgtatgcccagtggccaagggggccccaagtacctgctgaatggctagagcctcaaccatgttttgggaggcagttgggggcagagtgggcattaagctatctgctgagtccagggttgcttgtccttgccccagagcctcatctctgagattaaatagggagaggagatgttgggcctacacagaggtgggagatgcaggaagctaactgactgcaggtgagaagatcatctcatctttaggatctctgttttataccacctgtaggacagaggagagataaagcagtaacgacagtacccaccttcaaagtggatgaggaagtcagccccagaggcacaggtgactcccaaaaatggtctggactcactggagtccaatgattttgtcatcagatatttgcagaatgtctgctatgtgccagactcatctgggcattggagatgcaatggtgaatcctgccctcagtgttaggccatcaacagaaaaaaacaatacatgagaaagacaatctggacagtgataagcactaggaagaaaactgaaacagactggtaagggagtgactggaagggaccatttcagtttggttgtcaggggaagcctctttgaagaaagaacatgagatctgaggcttgattatgaaaaagggctagctagccatctgaagatctgggggaagtgcattcaaggaagaaagaaaagcaacgccaaaggcccttaggtggcggtgggctct

SEQ ID NO: 153444 - DNA, 649 bp, Homo sapiens
tcctagctagcagcacggggtttcaccgtgttaagccaggatggtctcgatctcctgacctcatgatccacccgcctcggcctcccaaagtgctgggactacaggcacctgccaccagtgctatggctaactttttggccaccatgcttggctaattttaggcccactgcacctggcctcttctcttcttatattgaatattttgagtaaattagattatgtagtatgaaatcaaattgcttttccaaagaaatgttcaatttatctaacgtccatcaatgacttatatgtattattttaaaaagcagaaaatagctgaaaaagcacagtcgtatgccaaataccattagatcaagaacaaaatgtctaactgtgtgaagcacaatataatgcagacatccacatattctgtttgcagttgggatagttattaacattgctgtttttaatgtggatatgggaacatagagttaaaagattaccctgaaacttcaagactgtacaacttaaaacagctactataacttcagtttaaatgtgcttttatcttttgattaatttggaatttacagttttaacatttgcagtaacagaggcagcagcaggtgtagtagtttagttattaatcctatgataatgtaattgtgct

SEQ ID NO: 153445 - DNA, 252 bp, Homo sapiens
atttactgaataaatatgtaccaggtgttgtgttaggttctaaggggctaaaataactaagatactgaactaaagtagaactattgggctcctaatgtgatagtttttccactatagacagccctcttcttccaagggtccctgccagggcttcccctaccctaaacagtgccttggtaaaaattaggaaagtcaccccttccttaagacacttgactttccaacagtgccttggtaagaattaggcgagtc

SEQ ID NO: 153446 - DNA, 346 bp, Homo sapiens
acaccatggggagttaggagacatctcggtaaaagggtgttagaaaggccctattatagcatttgggcttgtgttaggtgattttggtttggtataaggaactgggctttgctctgggttgggcgctgtcaggaatcaggaataattctttgatcggggattttaaaccttatctaggagggaagatgagagccacaccagaactgtaattaggaaagaagcagcagtcactcgtattagccaagacaggcagatgtttgaccatttttttgtggtttcgacaacattcaaatactctgttcagacatgatttcagagtggttgtgtttttgtcttgatccttcag

SEQ ID NO: 153447 - DNA, 445 bp, Homo sapiens
ataagtatataatacatatgtacacatgtaactctacatatacacatacacatacacattttagaaatcatgaatttttaccaatatctctaattccagttcatgttcacagggtttttccttaccacccctcattccatatttgtatttcttttcttctattgcaagaactctgggatggagctttttcaatcttttattagtgttaaatgtctcattaaaatttaaaaagtaggcagtgagaagagcacacagagacagacaagaaacaacaaggcccaaccagaaaaggaagagaaaatcagaagaaggatattaaagaagtccagggagaaatgcatttcagccctatcaaattttatttcgactaaaataagggacagaggaaaaaggacacattttgggggaagattttggccatattgagatcaattttggatgtatc

SEQ ID NO: 153448 - DNA, 358 bp, Homo sapiens
aaagtcccaaatacactctccgaagaagcctaggcagcagtttccaaatcaggatttgcttcagaaccctccggggcacttgtaaaaattacacaccttaagttttacatgacttggttgaaacctttccagctacaaaaggtataatggaagaataaccagaagctatttactcacttattcaacaaatgcttttttaatggaaaagctgcctaactgtgtacttggctgtgtagtaggtgctgaggatccagatgtaaacagaactgagttttgactttagggaatttatagtctggtgggaattaagtgggaaagataaatgggtaaagaaaggtgctgtggcacatgagaggga

SEQ ID NO: 153449 - DNA, 369 bp, Homo sapiens
aatggacatatatagtgattagagaatattatgcagccatttaaattgcatatgtaatagttaccactttacttggcataaagccagttttaataaatttcaaagaattagtaacaaaaataattgagaaaaacttccagaaactggaaaaggataatgtgcttttgttataaaagttcatgttatgttgaaatggataaatggaaaacaacaaaaacaaaaagcatacccagaaacatgaaggtcacattttatatcaccagaatgatataaactgatttgcttcaaaggaatgagagagactttgatttgatcagggtggtgacatcagaagcaaaaagaagtgcagaaatcaatagtgagttctca

SEQ ID NO: 153450 - DNA, 114 bp, Homo sapiens
ctggggagcagcgatgtccaaggtggatccacccctcgtagcaggatgaagagttgctgatctgtggcattgcaacattgtgcagttacgctatgtgccttaaatccatcaaag

SEQ ID NO: 153451 - DNA, 270 bp, Homo sapiens
ttaattgtgtcagaacaacaagtgcaaactaaaatcatctcagttaaaccaggaagtctggtttctctgtgaaaaaggtagttagggaagagacttgcatgctaatatcctcataggatataactagaaccaaattagtacaaattcaagagaaacaaattattgctcatgataagaaataccttttgagaattagcatattgaccaaaggtgtgctagattcctttagatcttaagagtttcttgtcatttgagacattcaagtgaagg

SEQ ID NO: 153452 - DNA, 389 bp, Homo sapiens
ttaaggtttccaattaccaaagctttgttggaagactgggcacgtactggagaggacagggaggagaataagtattagctaaggaactcttttgcaaggtacataatttacacagtacatagaaatgagccctctcttcctgggaaacatgagactcacaagataaagcccaattttattttcctatgaaaaagaaatggaatgtaagtatataaaaacatactgaccattcaattaaagacacatgaaagtataatgccatttttatatactaactaggaaagatgtaaaaaataggtagtaatactcaatgttggcaagggtttggagaaatagaaatacttttttgcgctgttggtgagagtgcaatttgataatggcactggaaa

SEQ ID NO: 153453 - DNA, 221 bp, Homo sapiens
gtcacctaatgtgtggtactttgtagtggcactaaaggaaactaaagcacagatatatgccaagatggtggtttcttttggttggcttcacacccattagttttgggtgtgaagtgtatggtactatacactccaagttccaaactgactttcaaacaaacttatgaaatgactcaccaatagcttagtccagaactgagaactgtctgcctttgttttaa

SEQ ID NO: 153454 - DNA, 118 bp, Homo sapiens
tgctgggattacaggcatgagccactcctttctaacatcctctgaggtaacccatggttccctatattgtgtgtgttctccctcactgcaacaagttaacctgacttactcaattaca

SEQ ID NO: 153455 - DNA, 349 bp, Homo sapiens
gatgagagaatgttctagcaacatacatgtgtaagcccccagccacgggcgcagctcagtgcctggctgctgagtgctctagacagcactcttctgccctggcctcctcaaccagggtgcatttccacttagaaaaaagttcctcctgtcttggttgctaaatggatttgcattttgtccaaagtgatactctgtcttcttccaggagacatccagaccttttggcttaggttgaaagccaagcacctgcttttcaaaacctacttatttcacagggatgcttgaaagtgggacagaagtattgtgtaatcctgtgaatttctgcaagaaaagggcagacttctggcaa

SEQ ID NO: 153456 - DNA, 584 bp, Homo sapiens
aagtttccatccctgcttgaagagtttgtaaagcaactggagtgtagctgcacaagtacaaggcggttgcccttttagacacttcagtcgcgagcatttggtactgaaaatacgaaaacaaccaaattgtaggagtgtccttcagctgcctttccatattgaggcgatttgggcggaagggggtggggaattgggctgcgcttctgaggtttcccgcgaggttattttttggttgtttctcagttgagatgtgtggagggttttagctactgttcctggaagttgtgctgtaagtagtaggtgaatcgtcaatagtgtcttatccgtaattgtagggagtgggattaataattagtccgtgctcctctccccacgtctccaccgtgattttcaaaggtttaagattctgtactggattctgtactagcttgccctttttaatgtgttatttatttgagaaagctgtcgtttcaagtgttaaaatagcagataagcggcattgaaaagtgacaaagtaatgtgtgaaaacaaggagctaggaagttctagagacttagctaaaatgtaattttagtttctattaa

SEQ ID NO: 153457 - DNA, 472 bp, Homo sapiens
gtggtgagctggcttccctaaagaaaggcatttaaggaaatctgaggaaggagagggatagtctgccttcagagttttgtttttgagataggtctcactgtcacccaggctgagaggctgagatcatagctcacttcgtcctcgcgtctccagcacaggtccgggtttctccacccaatgcgcctgcgcacaggcctagcccagtcggacgcagcccaggactgccaggggtggggattgcctgggtcccccaggaagggccgggttacgtccggaaaagtgaggcccgggttccagaccagcctgaccaacatggacaaaccccatctctactaaaaatacaagcctgtaatcccagctacttgggaggctgaggcaggataatcgcttgaacccaggaggtggaggttgcgatgagccaggattgtgccattgcactgcagcctgggcaacaagagcaaaactccgtctc

SEQ ID NO: 153458 - DNA, 352 bp, Homo sapiens
tctgctagttatttactgaccagtcctaatggtgaagataccaacagagtaatcctttgcaggacttggtagcctagaacatttctggaattagttgttctttgctgacttctttatttacattgtacaaatactaattccctttttatcattatgaatctggattattaacatcaggctccccatagctttctcctctccacatagggagaaggaagaagaattcacttttatagagtgctaagtactatggttatacaacttagaagtcaacagtaaaaaattaaaatagcatttggctgttaatgacactttagcctctccaaataattcttattaaaatactcatgca

SEQ ID NO: 153459 - DNA, 191 bp, Homo sapiens
tgatactctttccatcaccttaagtctctatcttttttccttaaaacaacaataatcttttatatccaccttctccaaggggctggctactaaagacagctgcacctttgctcatgatgagacccacactagttatatatgttaagactatacatatatgtatatatatacttttttaaatcagtaaatct

SEQ ID NO: 153460 - DNA, 486 bp, Homo sapiens
cacacagcacttcaaagaaatgcttactgattctttttatgaattatatggatatatgcatgcatgcctgaataagtatttgactgcttgctatttgccagcctctttgtgtctagtagggaatgaactgaacctggcttctgccctcaagaagctgaagttgtagtagaggagatgggcagaaaaaagggagcagactagcaggcaacatccgttagactgggtgactgggaacagcctctcagagcaaatgctattcacgctgatgtctgaaggagaagccacttactatgcgaagaggggaggacagtgttccagataaggaataacaggtgcaaggaccttgaggcaggaaaataagctcggcaggttcaaggaaccaatgagccagtatggctaaagcctgacaagcagagagtgagtcaaggaaagcctggaaggacaaaaaccagatcaagcaaggccttgtgggtaatggtgaaaatt

SEQ ID NO: 153461 - DNA, 278 bp, Homo sapiens
gaaaccaggatgtactctctagtgaacaagaggcagaaaggccgactggaagtcagagatctggggaaaaggctccttgcaggttcaacagttgacctggaggtagaagttgttagagtttcaggatgttgtcaaatggtcagagaacaaacctctatctaccaacaactacatcatgcattaagaaagtctcacagactaaatctccaaaactcacagcagtaaacttaaaatgcaaataattgtttcttttctgcaaataagtttctacctctttt

SEQ ID NO: 153462 - DNA, 119 bp, Homo sapiens
aaaatgatgaggggaagacactctctcaacttgtggggactggtggacggacgaggagcaaacacaccggtcaatttatccagcatccaatgctttggagctgctacccgcttcagatg

SEQ ID NO: 153463 - DNA, 372 bp, Homo sapiens
agtttggggcaagtggggtaaatgaccctggaagtgcctggtgctgctgtgggcaggttctgggggtgtctgaacagatccttgtacagaagggccgattacagctcccccatcaagccagctgggagtgaggtaaatcagcccctgggaactgcaactgctgagaaccccagagccacactacgggagttccagggcccctcacagccctgcctagaaaaaccttgaccattggcctacccagagtgtctaagggcaggggcaatttcaggctgaactacatgagagtgaggagacatgcagaccacaggtcctaagcagcacctgtcactcaagccctgcaggcaacagcaggagcagcagaatggggtc

SEQ ID NO: 153464 - DNA, 885 bp, Homo sapiens
gggattacaggcatgagccaccgcacccggcctctgtatcagttttgaatttagttctgggtgttttccttacacctaaagtgtggactttttggatttctactgagtagccagttcagcaaagtctcttcagctgattataatgttcaggaaagactcttcagctgataataacttctggcatcaccattcagcagtcagtcaaacattaaatgattacctgtaggcattgtggagtttcatctctgcatgtccaggccagcccttagtcaaggcccaagaaacatgtttttatcgtcaagaacttctaggctcttagtttacataatggaatcttacagattttcctttgtttgcttgctgaacactgtcattgtcaccctgggatttcttttctctgcttcctgggttggttccactgtttcttggagtccacatctttttctctcttggatgatcctcgttttgctgggagtagatcctctagtatgtttttcaaaagggggtttttagagtgtaaagatcccaaggcactgcaggtgtgaaaataactattttgcaccttgattgacagtttggttttaaattaacttccagatttaaattaatttccacacagaattttaaagggattaccatattcccatttatcaggatacatctgatgctgatctgagtcttactggttttacaggtacttttttttgcattttcttattggaaacctaagattctcttgaaattctgcagttttgtgaagatgagtctaaatgttgagggtttgtctcttacattcagcctacttgttactgtgctttttctgtccataaaattgagttcatcgttgttgtcttctgatatttgtgtccctctttgattctgcct

SEQ ID NO: 153465 - DNA, 275 bp, Homo sapiens
cccaaagcgctcggattgcaagcgttagccaccacatctggctgttagccaccacattcagccataagcatgttctaaatgcatcattgtgttacttcacttcttgacaacactataaggcagatactatcgttatccccactctacagatgaggaaactgatgcaccagagaaactaagtcacctttccaaagttcctcaacagagaggtataagtagcaacatcatatcgccacttccaggagatggactacggcattcagattctggtttgg

SEQ ID NO: 153466 - DNA, 225 bp, Homo sapiens
cagatggtcctcctacctcagcctccagagtagctgggactcagacacacgccaccatggctggctaatttattttgtaattttttatagagatgggtgtctcactttgttggccaggctggtttccaactcctcacctcaagcgattttcccccctcagcttcccaaagtggtgggaagctgaggaccatcgatgcaacgagtggtcctcagtctacctttttt

SEQ ID NO: 153467 - DNA, 502 bp, Homo sapiens
caatttcccactcaacagcaaacttcagatttcaaaaaacacttgggccaaacagtattaccagataacatcagtttatcaaactctaatttcccatgatttgcctggcgtggtggctcatgcctgtaatcccagcactttgggagcccaaggtgggcggatcatttgaggtcaggagttcgaaactggccttgccaacatggtgaaaccctgtctctaccaaaaatacaaaaattagctgggcatggtggtgggcacctgtaatcccagttacctgggaggctgaggcaggagaattgcttgagcccgggaggtggatgtggcagtgagcagagatcgcaccactgctctccagcctgggtgacagagtgagactctgtctcaaaaaataaaaggttatacaactatgaacccagaaaaaacaaaataatctgggttaatgtgcctttttttgacaggtgagactactttaatgtcgtacgtgaatcttctgagttacggg

SEQ ID NO: 153468 - DNA, 312 bp, Homo sapiens
caattccattccagcgtaccactggtcactattctcaggtgggttttgagaatgaatgtgcagagtttatgatgtgtgtcgtgtgcgtgtgtgtgtatatgatcattaattttgaaataactgccaacactagttgacttgaaagaaaacctttttgaaagtttttagcttgttccaatttacttttatataataaggggcagtaaaacttcactcatagtgttaataccaattactcatagtacattagcagactatttgcaacataattaatttgccttgcataattaatttttctgccagaccaatatg

SEQ ID NO: 153469 - DNA, 164 bp, Homo sapiens
ggccttccatatttcaagacaagacatcaagaacttaaagtgatgaaaagggaaaggataacaagattaagcatcgggtcagatttagtgttgagagctacctggtctggcctttgtctaaatactagagaaaggtggcagagaaagaagagcccctgtgatca

SEQ ID NO: 153470 - DNA, 480 bp, Homo sapiens
gaaatagaaaatatgaccactacctttgggggacttattacctagttggggagagaagacaaagacacataggaaaaataaagaacagcacagaagacaaagtaatgccatgctgaagcagacgctttagtctttgtgtgctgtgcattcaggaggggcgtgtggtgaggggttccttcccctgcccaagggcagcctctctccttgctccttccattgctgactctctcagctttatttggggttatgcttcatcatttgtccccagaattcttgtatcttctatttctcactcttcattggcttcttctgtttgtaatacagaagtgctcagtcaggactactgcagacaaaaccaggaattcttagtatttgcttcctgactgaggctaccaccatattttatatcctccttgttaaatattttccaagtatgcatcactgtgtccttacaatctagctctcatttgcttcaaatag

SEQ ID NO: 153471 - DNA, 104 bp, Homo sapiens
ttgttactataactctccatcacaattaaaatccaaacagttttttgaaaacagtcaactcaatcaaaacccactacttcagaatcaatagcttctttgaagcc

SEQ ID NO: 153472 - DNA, 438 bp, Homo sapiens
agccaaagtcctcagaatggccttggggacctacaggctgggtccttctctgacctctctgatcgcgtctcccactctttccctatctttctctctcttcactccagccacattgactttgttcttcctcgaaagtggcaggtcgctcccacctcaggacctttacttttactcttctctctgcctagaacattctttccccacacttatgtgtagttcacgcctagcctccctcaggtcacttgaatgttaccttctccgaacgcacctcctccttgcttgatgtgccccatagctcttagcatcatctaacatattacatattctacttatttagtcctgcttctactagaatgtaagctccctgagggcagggattgtgcctgttttgttccctgctatatccccagtttctagaagagtgactggcatgtccaa

SEQ ID NO: 153473 - DNA, 689 bp, Homo sapiens
atcttgcttaattatcattcagaaaagtgcactctccctgcaaaatgtatgagagaccccctttatttcctccaagcctgtatcagctctggatatcatcaaacattaaaaatttccactctgcttggtgggggaaaaaatctcattgctttgatctgtatttccataattatgggtttgaacatcttttcatatgtttactcactatttatatttccttttctgtaaagtgcttccctagcctttgcccattcttctatttggcacctgatttgtatgagttctttgcaaattaaagaaatttgccatttgttatatttgccgcatattgtggttattagttttcccactctgtgatttattttcatacaaaagattttcattttatgtaattaaatatatatatttaatacatataaaagaaatatatgtttcttttttggattataggtttcttaggaaaactctcatttaaagtgtataaataaatttagctgagatttcttctagaattgtttttttttttctccttcacatgtaaatatgtcataagcaggattgtatttgggggtaaaaaatgaggtagctatctggcctgattttttttccagttagccacttgtatgaatatcactgaatgaataacccctctttttctcactaatttgaaatgccagctttctcataaa

SEQ ID NO: 153474 - DNA, 501 bp, Homo sapiens
gtcctggctacacaggagactaaggtgggaggactgcttgagcccaggagtttaagaccagcatgggcaacagagcaagatcccaactctagaaaaaataaattaaattaaaattaaaaaaatttaaaaggtaacaacaaaaactcaatctaattaaaaagcagagttaggaactgaaaaagcaagttgcaattacgtgctgtctactaaataatcactttaaatacaaacataaaggagcttaaaggaaaagaatggaaaaagattttcgctgaaaacagtaagtcagagcaatggtatgaacacaggacaaaacagactgcaagataatagactactagagataacgagggaaatgtggaaacacaccagaaaggcatagaaactataaatgtgtgtatgcctaatagcagcttcaaaataaatgaagcagaaaccaacagtattaaagggaggaacagataaatccataattggagtttaacatctcactttccttaa

SEQ ID NO: 153475 - DNA, 505 bp, Homo sapiens
  misc_feature (130)..(130): n is a, c, g, or t
ggggtatgttgatatttgtcggttactatgacttcttttttttcccccctcaattgcatcaaacccttaaaacatggtggtaagtgagcgatatgcatgcttttggagtttgtttaatctccgcttcagntctatacgatgcacagttcataatgttaacacttttcttcaagtttacttcattcactttcacaactaatttggatttcagtttgctgtttaatcctcatttactttggtttctgtatcttttttctgtaattctgttctttccctctcccctgacttccctgttaggggtcaagtcgtttttttggtctgaccggtaggggagagtggtgctgcagatagtgattcagtccaggagagtggggagacatgaggctcttttgttggtcagtgtgaaagtggatttggggagacagatgaagagggctcctgggatttggcccccttgtgaatctcaactgctcccacttgcaggcatggcagctatgccggaggc

SEQ ID NO: 153476 - DNA, 404 bp, Homo sapiens
atacatctgataaaaaccaccatacacgcagagcaccagcagagtctattaaaaagaggcagtttaaacaaacattaagctcttaactgcgagacactctcaggacatgaaatacatagtccttgcctggggaagctcacagtctggttgttaaacgtcacatgcaacctcgatggcagttaagtgccatgagcaagccttgaacaaagtgctgaggggactgggagagaggtaagaccagcgtagcaggacataccagcaccctcctcacaagcctcaagaaaacatctcaagtggactctaggacaggccatccttccaagacagcgtagggaggacagagcccccgggagaggacccgggggaagagggacctgggtctgggaaggcgaggagctgtcatg

SEQ ID NO: 153477 - DNA, 469 bp, Homo sapiens
agaatttatctaggttacttttagataagtaaatcaggccatttgtttgtatttattattggtatatttctgtataatttccttatgcctgtgtagatcgtggagttcttttgaagtcaatttcaagtcaagattatatttatgtacatgatttttttctcatatttctcactttcccaccatatgatctaggtttgctacatcagaattggagagtgacatttaacttagtgtttccggaataaagaatctggagcttttactaccccataagtaatctattttagcctttctaagtctgcagcttcctttcactttgctttccaatctagcatttcacctctagttttaccccagttatgctttatagattaaacctctgaaatgtgtttaatctgtatgaaatgaaattatagctgggcacagtggtgcacacctgtagtcccagctacttgggaggctgagcatg

SEQ ID NO: 153478 - DNA, 307 bp, Homo sapiens
ccaatgaccttcaggagatgacagacaaggagccatgttccctcccagaactcaggagaggcacctggcctgtgccacaattctagcctcaaactcaggccctcttcctaggaatgcccttatccacccctccttcagtgcaaagcctctctctccagatgtctgcccaggactcccttttctagccccaaccctaagatcggcccccacagcccacagcagtgacagcgtgaccagcagcagtcttcttacctctgagatggggaggatggcgcccagctgttctggccacagaggagatgcttgg

SEQ ID NO: 153479 - DNA, 382 bp, Homo sapiens
tgatttcatgtagtaaggatcccgtctatgaactctatgaatatgaggtaagaatgcatgaactaagccaacttagctgtattcttctggaaaatgggatgtttcttgataggctagattagtggttcttaaaagttttttggggtcacttatccttcagagaatcggatgaaagacactgggccctcaagttagaagatgagcataagcgcaatcacatgatttatatatatgattttaggaacttaaactgtaatgaaatagagccaatttatatttagatctcatttgaaaacctttcattttcattgttcgggtgtgtggatgttagtatgagtttaaggtgaaggagtctatgttagtatttgaacatgttgacagg

SEQ ID NO: 153480 - DNA, 248 bp, Homo sapiens
tagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactc

SEQ ID NO: 153481 - DNA, 367 bp, Homo sapiens
acctggagaatggccccttcttgagacaggaagagctagaagcttccaaatgcacacgtttaatgaaagagcaagcctaggagcccagatggctgcaattctgcatggtaaataacataacagaagttcttacaaagtacagtgggcacatagaagatagtacaatactatctgggagtaataaagaaagtttccaatggaagtgacatggagtgggggggagatgaagaagaggcacctgaaatttcaagctgaaggaaagaacataggctaaagcagaaagaagaggtatggcattgctttccacagttaaaaaaaaaatcatggccaggtgcagtggctcatacctgtaatcccagcactttgg

SEQ ID NO: 153482 - DNA, 293 bp, Homo sapiens
ctgggggcagcactggcttggcttgggcatcggagctggcatgaggctgccaggatccctcctccttcaataaacgcccccggtgtactgtgagcaggcagtgcggtgcagggcaaaaagcccagggctgggaggctcggctctgcgaccttgacctcaggcttcccatctgtaaagccctgacctcacactaaatggaaaatattgccctgctgcctactcccacgagtcccaccattttggccaaacctccgttgtacagatggacaacctgaggcaaggtgtttctggca

SEQ ID NO: 153483 - DNA, 462 bp, Homo sapiens
ttttttcatctttgtcacgtggggctatagtgacacaactgtatttacagggaagtctgtgggtttggtgttccctaaggagggtttatttaacatacttacaacattgtttactcagataaggaaacaccgagatgctaaaaaaatgattgtgcatgtatgtatgtgatatgcgtaagggtctagcttccttttataaaatatgagtgtcaaacatatgtagcattgcactgtaatgtcatacgtaaagttctttctgaaaaattatacccaaattgaaccttgctgttaaattcatagttcattttgttagaaaggccattatactgagtgaaaaatgacttggaatttaaccttagttttgacactgtgttcctggctgaatctttgccttgagctcaaattcccattggtaaaattaagttgagaacattctcattctgcctacctctttgaggttga

SEQ ID NO: 153484 - DNA, 430 bp, Homo sapiens
tgcccagtcacacaccccccagtgttccagaccaaccaacctgcctggcatctctcccatggcccaggtacactcaggcctccatgcttttgccaggctattctcactacccagtgtgccctgctcacctctcaagatgagcctcagactacgtaattatccctgcgcgtaagggccaagggcaaggatgggaaaagccagtactcgactctcagcctgtttgataagtataaaggaaaatcagtagacgcgattagatcctcagttattcctagacctggcttacagagtcttgggaaagttgctgcagcccggcgcatgccaccgcctgcaacctgccagcttgaagtctgaacaccaaggtaacgaccccgacctcgtgatagtacccacggacgggccggctaaggccagctgcgctaacggtcct

SEQ ID NO: 153485 - DNA, 160 bp, Homo sapiens
tcctataaatccattttgcaaaaaaaaaaatcataatctctcaaggtaatggttataacatataacaactctaaccattctgctatcaggagaatgacatagtgtaaaaccccaacccagaatactttcaggcaaaaataaagtaggacatggtttgtct

SEQ ID NO: 153486 - DNA, 400 bp, Homo sapiens
cattaaaactaagataagattatttgaagtaaatgcctgaagtcaacagaggatacacttaaaaattatccaaagaatctacaaaacctacattaagagatttattttctttgtcttttagcctcatttgcttctaacaacagtagcttttcaagatttaagaaactcctgcccgggcacagtgactgacacctgtaatcccagcacttcgggaggccaaggtgggcagattacctgaggtcaggagttcgagaccagcctggccaacatagtgaaacctcatctctattaaaaacacaaaaatataaaaatagctgggcatggtggtgggcacctgtagtcccagctactcgggaggctgaggcaggagaatcactagtacctgggaggtagaggttgc

SEQ ID NO: 153487 - DNA, 386 bp, Homo sapiens
tatttatagctactccaacttgaatgcctagcagtcacctagaagacttgttcaatgcagatactgggccctacccacagggacagcccagggccaggcacaaagggctccagctcaatcgaagttggtcaaacagggacaaaggagacagttttcttcaaggacaggaagaaatctgttgctatcctgtgtaccccgaattccatttgcaaccattagttgtttcagaaaagctggtgcgtgtcagatgttttatctatgagacaatgatttcccagcacctgaccacactttctgtgtcacagaaactgtgggctgcaggttatacgtgggttctgtgcctcctggcatacctggaaagatcctgatgcagcccacactgtcag

SEQ ID NO: 153488 - DNA, 364 bp, Homo sapiens
atatgtacacattttgtacaagtgagataggaattctcagtgtttcaaatgcaaatgagccatatgaaaattaagatgccttctagaattgttttgctctgatcattgctgattcctttccccatgttttacatgccaactttatcttttagaatattttctttaaatgttataaagcctaaaactgcacatatggaagagacattttcaatttcatcagagcagcccctcccgaggctatctatatggagaatttgtgagcttatactttgatttatgaaaaagatttacatgtgtcatcttgcttcagctgaccacataatttcttaaagcaatatcaaatagcctgcctcactgtttgtgt

SEQ ID NO: 153489 - DNA, 146 bp, Homo sapiens
tcccaatcctttgacaaattccaggctttcctattaataaacatacagaatttaccattttgtacagaatttagcatctgctctgagaaaagtttctcctagaattatattttcaattaagtgctaaattaaccagaaaactctag

SEQ ID NO: 153490 - DNA, 1066 bp, Homo sapiens
tcctgacctagtctctttgagtatgaagacctatttactatgtaaagctgtcacctgccttgaaaagattaagacagcaagaaagttcttagaaagtgggtatgtggctggcctcagataaggataaattgctgagaagaaggagttgggttttttttgtgtttttttgtttcttgtttttgagacagggtcttgctctgtctcccaggctggagtgcagtggtgcgatcacagctcactgcagcctcaacctcccagactcaaataatcctccctcctcagcctcccaagtagctggaactacaggatgccgccaccatgcccagctaattttttgtatttttttgtagagacggggttttcccatgttgcccaggctggtctcaaacttctggactcaagcaatccacctgccttcgcctcccaaagtgctgggattacaggtgtaagctaccatgcccagctctggtctcctttcttaatcctgttgaataaggaagattttttttatctgaaccctcctcttactcttctttctgttctccttccatgatcactttgtccatcttcctctttgtcataggcatgtcctatttctaattccctttctcttttctttggtaggctagccttcgagactgcattaccctccccaacttaaaatcttttgataacccaggcagctgggttatccccaatttaaagtctttttgttgtagctgtatggcatttatctagagcatggggtacacacagtaggtttctctcctctcttttttaacatatttattatgtttatgcatgtaaagagtttgttgttggccaggcctgatggctcacgcctctaatcccagcactttgggaggctgaggcgggaggtcaggagttcgagagcagcctggccaacgtgatgaaaccctgtctctactaaaaatacaaaaattagtggaacagggtggctcatgcctgtaattgcagctactcaggaggctgaagtaggagaatcacttgagcctgggagctgagatcgtgccattacactccagtctgggtgacagagggaaac

SEQ ID NO: 153491 - DNA, 1714 bp, Homo sapiens
tcctgacctagtctctttgagtatgaagacctatttactatgtaaagctgtcacctgccttgaaaagattaagacagcaagaaagttcttagaaagtgggtatgtggctggcctcagataaggataaattgctgagaagaaggagttgggttttttttgtgtttttttgtttcttgtttttgagacagggtcttgctctgtctcccaggctggagtgcagtggtgcgatcacagctcactgcagcctcaacctcccagactcaaataatcctccctcctcagcctcccaagtagctggaactacaggatgcaccaccgtgcccattgtttctatatcagggtcttataatatggcagacacaatggcctcccacagagaaatgagccataaaaggaccctgtaaaagcaaggatggctcattgttttaagacagccaaatgtatggcacttggagaatttcaaagagtagaaggccttcttgattgcactcccctttaacagccttgcctcttatggggctatgtggatcgttgaaatggttcacaagtaaagtgaaaaatggttatgcgtagtgtgtcagccccaccctaagctcccagagcctccattctgagtacaaaggtcagttttcttctcgggacaggccaaggatgatggggttttaatttctctcctgatccatggcaaagcattcctaaactaggcactggaagtcttggtaactggaaagagacattcaccaagatgaggaaggccaaaaccaagtgccttatatagtccctagaaagcatttcattttatggaacaatctttggtctctctttttttttttttttttgtgagacagtgactcaggctggagtacagtgattaggtcactgctcattgcagcctcaacttcccgtgctcaggtgatcctctcacctcaacttcccgagtagttgggactgcaggcaagcgccaccatgcccagctaattttttgtatttttttgtagagacggggttttcccatgttgcccaggctggtctcaaacttctggactcaagcaatccacctgccttcgcctcccaaagtgctgggattacaggtgtaagctaccatgcccagctctggtctcctttcttaatcctgttgaataaggaagattttttttatctgaaccctcctcttactcttctttctgttctccttccatgatcactttgtccatcttcctctttgtcataggcatgtcctatttctaattccctttctcttttctttggtaggctagccttcgagactgcattaccctccccaacttaaaatcttttgataacccaggcagctgggttatccccaatttaaagtctttttgttgtagctgtatggcatttatctagagcatggggtacacacagtaggtttctctcctctcttttttaacatatttattatgtttatgcatgtaaagagtttgttgttggccaggcctgatggctcacgcctctaatcccagcactttgggaggctgaggcgggaggtcaggagttcgagagcagcctggccaacgtgatgaaaccctgtctctactaaaaatacaaaaattagtggaacagggtggctcatgcctgtaattgcagctactcaggaggctgaagtaggagaatcacttgagcctgggagctgagatcgtgccattacactccagtctgggtgacagagggaaac

SEQ ID NO: 153492 - DNA, 435 bp, Homo sapiens
cacaccctctaagtggtcaatattttaggctctgcaggccacgtacaaccactgtctcttatttttttctgggttttgtttgtttttaatttttttttacaaccgtttaaatatgtaagatatattctcagctcaacaggctttggtttggtgcagtggctcacgcctctaatcccagcactctgggaggccaaggtgggggaaagtgcttgaacccaggagttcaagaccagcctgggaaacatagtgagaccccctctctacaaaaaagaaaatttttttttaaatagctaggcgtggtggtgcatgcctacagtcccagctgctcaggaggctgagatgggaggatcacttgagcccgggaagtgcaggctgcagtgagccgtgatggtgcctctgcactccagcctgggtgacaaggtgagaccctgtctc

SEQ ID NO: 153493 - DNA, 204 bp, Homo sapiens
atgtatgcatgagcatgaactcgtgtatgtattcgtgtatgtatgtaggtatttcaagcagtgcctacattcccaccgcagctctttcaaacctggttaattctacttctggctgtcagccctatctccatcacctttagcagatgatcgccctcccataccgggggagaaaaaggccattcttcctacttcaaaaatactgct

SEQ ID NO: 153494 - DNA, 145 bp, Homo sapiens
gaaatagaggatgctgacgtgggaatgatcagaaaggataatactaatagatggtgaagacaaacgttgatgcttttcaaaatatttgttttatattcccaaactaagaaagtaaatcagacaccaggctatcaacctctcaaga

SEQ ID NO: 153495 - DNA, 949 bp, Homo sapiens
gctaaacaaaaccccaggccttagcccaatgttgtgaattttacctttattttgcttttgtagacttttattctactcaagtggtcaattgccttggttttatagctgaaatgaaagctcaaagagtaaagagattatttgtaacactgtatgtctatacatttaattaacattgtaaaataatttaagaaactttaagggtcaaggggatgtttttctttcatttaaaaagtatcatgtatattacaagagttggagtaatgttgatctattgcatgtgggtagaattagttactgcctcacaagactatggtgtccttggagcctaaaatgagtaaattaatctctacccagcacaaagtatccagtgtacttgcttagagagtttaaagggagtaagcgtatgaatgcatggcccacgtttgagagaagggagaaacattatcacacagtattaaatgtgtgggtccatttaaaaaaaaaccttgggggtaaatgggcaactcagctccatcaagtccaggaaatagaacagaagagagtgccttcaagcaacgccaggcttcccctgaacgcattcttacacgtgagttgtatttcacattcacagattcagcgaagggtttttcaacactagaaagctctgggaacttattaaaaatgctcggctgctctgaaatcacatggggtgtgggtggtcccatgctcgtttcttgctgtgaattcaacatgcctaaatagatctgaatggctagtgggcggagccgctgaaggagagggggacagtcaccacagactcctggtggccaaagaatgcagtgccttagggttaagggacccttggggcttaagggacccttgggcttaagggacccttgggcttaagggaccctgggctttaggactgcgctaagagacctggactaagccgctctgaggttagacctgc

SEQ ID NO: 153496 - DNA, 339 bp, Homo sapiens
  misc_feature (44)..(44): n is a, c, g, or t
agaactccaggacacttaaccgagcagccccattgtacatctcngtctatctctgcctctctctctcacacacacgcacacacatacagacacacacacacacacactcggccccaccaccacacacaggccaggtggctctgcttacatacatggcttggcgcttttactccttggctaagaccatttcacacatgaacaacacagcctcctcctagagatttgtcatccatctgcttgcagaagagctgtctgtttccctctgaaaattggtccaatcaacattttcctttggccagggtagcttaccagcagctcctccagaaggtccaggtatga

SEQ ID NO: 153497 - DNA, 467 bp, Homo sapiens
aaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttccc

SEQ ID NO: 153498 - DNA, 307 bp, Homo sapiens
aaagaaaagaaaagaaagatggaaaggtgccagagagtagacaactttctctgctagggtaaaaaaggtgaaacaacacaaccatttgccttcacaaatatagcacattatctaaccgccattgttcattattcttggaattcatactttgaatatatttttgtgttactgaagtgaattttttcttatttcttcatttggtctgtctacatttggcataatataagtagctacaaactaaaaagagtgctgaagtattgaattatttcttttatttcagtttcttcatttgcttatggttctgcta

SEQ ID NO: 153499 - DNA, 244 bp, Homo sapiens
agcccgctgactagctctggggataagcaggaggctggagcagcagggacacccaaagatgtccatggaagggaggaccagactcaggctgggccacgctgtctgccccggcctgcagctccggctgtggctcaaggggcttgggagccaggacctcactggccgtgactctctctacaggaccctcgtcccccaggactttagaaacaagccatttcatccttattttggagagatcccattt

SEQ ID NO: 153500 - DNA, 141 bp, Homo sapiens
caggaagagtaatgaccagatgtctgaaagtgctaggattccctcttcccctccaccagaaaagtcaaaagagggagctctagagccagaaagctaaagtcttcctgcccacttctctctctcagtttatgaaaattaatt

SEQ ID NO: 153501 - DNA, 412 bp, Homo sapiens
gcagtattttaaaaacaagcgttattttctataatctaagttgctaaatagactgaatatcaaacatacactttagactagtttatctttatccttaaagtgtatattttcaagttgactaaaaaacctgtatttggattctctcacttgggaaaatgagcttcaatgtgagctcatttaaaaagctggacacacaggagatcgagaccatcctggctaacacagtgaaaccccgtctcaactaaaaatacaaaaaaaaaattagccgggcatggtggcaggcgcctgtaatcccagctactcgggaggctgaggcaggagaatggcgtgaacctgggaggcggagcctgcagttgagccgagattgcgctactgcactacagcctgggcgacagagtgagactccgtctcg

SEQ ID NO: 153502 - DNA, 265 bp, Homo sapiens
ttgtgggtgcttagaggatccccagtatgatgagagaaccaggctcatctatcttcattcaattcactggtcttgccagggctctaaaagaagggggtggaagattgttaatgtctcatcttaacctttgccaaatggagctgtctgctgccacagatccaaaggagacccaggcttcaaaggcacatgtttcattggtgtccctccaaagaaaaaactgctcccctctgttccttgcctcccaggctgaggtcaggagaccagc

SEQ ID NO: 153503 - DNA, 605 bp, Homo sapiens
cctccgccccctgggttcaaacgattctcctgcctcaccctcccgagtaactgggattacaggcatgcatcaccacgcccagctaagttttttgtatttttagtagagacaggatttcaccatgttggccaggctggtctcgaactcctgacctcaggtgatgcatccgccttggccttccaaagtgctgggattacgggcatgagccaccacgcctgacctaaaatcatgtttactttgccagttatttgttacagtattgtggtttaaagtcttggattacaggttatttaggacagtgattcctaaccagaagcatattcaagttagttggggggtgggaggggcagatgttttctaaactttttcttttttcttttttttttggagatggagttttgctcttgttgcctgtgctggagtgcaatggggtgatctcggctcactgcaacctctggctccagggttcaagcaattctcctgcctcagctcctgagtagctgggattacaggcatgtgccaccacgcccggctaattttgtatttttagtagagatgggtttctccatgttggtcaggctgatctcgaactctgacctcaggtg

SEQ ID NO: 153504 - DNA, 213 bp, Homo sapiens
ggggagcatcatgtacatgatggctcacagcctcctcatgggatttttgaggatgacataaaggaatacatttaaactgcctagaagggtgcttggcccagagtatgtgctaattaacgttggctactattattttccttcaacccagtgccggtgcaggtctagaggaaagcatgaggtgatacgggggcacccagaggcggagtgctccca

SEQ ID NO: 153505 - DNA, 401 bp, Homo sapiens
cgaacaggacagcaggaatcacctttctaagtgcatgcggccgttcagaacagtggttctcagatccaggtgtgcatcggagccactgcagggctcgttgaaccagagattgctggatcccacccggggtttatggttccataggtctgggtgggactcaagaaatttgtgtttctagccagtgcccaggcgatgccgctgctggtccagattccccacttgagaaccacagggtttgatcgtattcattaattggccccctccccgaatcaaatgttggctgccctggggcagggattttgtcagtttcatcccctctggtcccctgggccaggcacagactaggtgctcaggaccactctctgccaggccagctcttgtacttgattgtccagggtttt

SEQ ID NO: 153506 - DNA, 358 bp, Homo sapiens
ccagcctcagctcggagccatggcacagcaccccctctccgccacggccccgacagctgggcgtgcgttctgctgtgggcagctgccctgagcaacgtagggtgctaagcagcatccctgtcttgcacactagattccacagcaccctctgaccccgtggaaaatgtccccacatgggaatatcctctgggggtggaactgcccctggtgagaacccctaggctgagacctcagaaggccctgagtcaaaccgagaagtcatcagagagccttgttttcagctccagggagcttgggcaggctggttttctgggccacacagtcccctccccagcccacctgtgctccgtgggtcccg

SEQ ID NO: 153507 - DNA, 335 bp, Homo sapiens
tgggaggcttcactagaggttttcgagtgaagatgcacgtctaaggtgtgacgggaaagggccagaaagagaatgagggaagaacattccaagccacagaaatggcacatggaagagagcagagatgagaggagaaaccatctgtgacttaggtggctcagcagagctggagagagtcgggcaattgagttgaagcacaggctggggccgtgccatgcaaggctttgccagctatacaagggcaccacatgccgtggggagaaccagagtgtttttagcagggtggtgtgatcagattcctacttcagaaagatgggcacagtgtgagggatgga

SEQ ID NO: 153508 - DNA, 629 bp, Homo sapiens
taagaggatatggatccgagatcttcccgtattatgtcctccattctcatgactgtgatcttaggtattgtgtgttgctcgagagacgtgtggtaggatagctttgaagcagaatgatttgtggatcattttaccagtcctttctcttttttggtcaaatgcagatggcatggaggaaatggaaagttctaggcatttttgcaaccactactatataactcttatggaccggataaatttagtagacaaagtaagtggttagtttcttggacctcggttttctggtctgtaaaatcaagagatgcatcaaagtttctttctagctttaaattctgtaattctttctttgagaattgtgtagcatgtataatgtttatgggaagtaaagtttaagtcactaaaaagaggcagaaatcaggttatcactcacagggctgttttttcagcctagtctctgccaatcctaaccttgttaaaactacaatgtggcaagagatgatgtcccattattatttctttcactcgagaatgcttcagctatatagatctatcaaagcagttgttacactggtgagtttccccatatccatcagaagaagaaaatccatcacacttttgactactttttc

SEQ ID NO: 153509 - DNA, 502 bp, Homo sapiens
cactacactgttcccctcctttccgattcttgtttaaagagaaaccttgtttaattcttcttccagtatattttccagcttgtacactgcatattgggaaagtttggtgtgagtctccctctatcttttgttctacttgctgctccagtggggaaagttaactgtgattttatttcccgtttatttgtaaatgtccatctaatttatatgactttgaatgtaacttaacgtcttttcccactcttcctttttaattaaggatacagaaattgttgatttagattcagacggtcctggtacttcatctggaagaaaggtgagtaaataagtgaactgctgaggagatatgttttcaggtttcctgtgtcagtgatccctaagaccaaccccatatttggagaattgctagaaggattcttgcaactaagtatattaggtatgctcattgataatatttattagagtgatgcagtaagggtacccagttgagtcatgggtgaaa

SEQ ID NO: 153510 - DNA, 709 bp, Homo sapiens
ttctgttctttataatttatccaacctcaggtattctgctatagcagcacaaaacagactaagacaatattgatgcaaaaaatcctcaacaaaacactagcaaatcaaatccaacagcatattaaaagaattacatatcatgacaaagtgagacttattcctataatgcagtaatggttcagcatacaaaactagtcatgatataccatgtaatataccacgttaacaggattaaaaagaaaaaacatgatcctctcaactgattcagaaaaagcatttgataaaattcaacactgttttaggattttaagaaacactcaacaaactaagaatagaaggaaacgaactcaacaaaataaagatcatccaacataggaaaaacccacaactagcatcatactccagagtgaaagactgaaagctttttgtctaccattgaaataagtcaaggatatacttctattcaccatagtactgaaagtcctagacagagcagttaaggaagaaaaagaaataaaagccatcaaattggatacgaagaaataaaattatctctgtttgtaaacaacatgatcttaagtatagaaagccctaaagattccacacccaaaaaaaacccacctgttagaactaataaacaaattcagtaaagttacaaaatcagcatgcaaaaatcagttgtgtttctatacattaacaacaaaccatt

SEQ ID NO: 153511 - DNA, 303 bp, Homo sapiens
agacagattggagaggaacatagattcatatttttgggctttttactatcaagtcacccagtctaaaactcaggacagagcagcattaaccattcattttgctttgtgatagagcattcgattaccaactctttaaactcttttggcaattcaaggaggttgcctatctgggtaccatttcttaggatttgctttgttggattttctaaattgtggatgtgagtttctttggttttgcattttttaaaaaaattttttggtcctttttaacttttccaagttttggagaatttttcatgttgg

SEQ ID NO: 153512 - DNA, 425 bp, Homo sapiens
ggtctaagagatgatgaaagcatcagagatggccagggggcgggaggagtgcatcttccattttcctgaggttgctctgtggttattagaacatttctgatataataacaataaatatcagaaaaggaaaaaaagggaaaagtgctttataggggtcccaggagatggagtatcctaggaggcaaggtgtggcagcaaaagagaggacaggcactgggcctggaaaatcctgggtttgatactgattctgtcacttcctaaacatgagcccttaggtaagaaacttcacctctctgagtatcagtttctatacctctgtgaaataggagcatctcagggcagttgggaggactgccctgacgctgtaaactgccctgacgctgtaactgccctgacgctgtaaactgccctgacgctgtaaactg

SEQ ID NO: 153513 - DNA, 491 bp, Homo sapiens
gcccgctctagagtatccccccacctcgtccagccaagtttggatttttcaagaggatgagagattgatacagaattacaagataccacaattgcacttcaatgttcaggtttatcagaaaaagcccttagtgcaaataacaacaacaacaacaaaagtatttactataacaattggggtatcctgacctagctcatatatcatgaagtgaatttaaatagagagatgctcaagcaatagaggaaacctgggcaattgttcttcctcttttaggtggagagtaactcatatttgctagaatgggaaccacctgttgaggattacatttccatgacgttttctgaatttaatccttatgtaggtgatgaaattcattcctttcaaaatcaagatgaaccagaacagtcatttgacccacctgtgcagttttaaaaatattttgagtaatggagactgagctaaaactcagactctgaacaatgattagataa

SEQ ID NO: 153514 - DNA, 286 bp, Homo sapiens
gtgggtcatgcctgtaatcccagcactttgggaggctgaggtgggaggatcacttgagcttaggagttcaagaccagcctgggcaatatagtgagaccccatctccaaaaataaaaataaaactaagacaaggctggaaagtcatctgccattataaacatcagtaatctggccgagcacagtggctcacgcctgtagtcccagcactttgggaggctgaggtgggaggatcacttgaactcagaagttcacgaccaccctggacaatatagtaagaccccatctc

SEQ ID NO: 153515 - DNA, 287 bp, Homo sapiens
gagtgaatagagaaggcaaacaggagacagatagaaaaccaggcatatcagcatatgggagagctgctgctaccacccatagccctggagagataaaagggatgaaatggtgttatcagaaactggggctgtccagcaagaagtaaaattatggaaaaggctgcccactgggagtggaccatagagggaagggctggagctaaacagaaaacaccaccagagggagagaatgggtgagaagaagtaccccaggcttctccctcccttttcacattccagtcttcctg

SEQ ID NO: 153516 - DNA, 346 bp, Homo sapiens
ttatttattcattgattcatggttaaaaacaacaaaacaaaatgcgtgagaatttctataatggggctaaaaaccaaaatttcttatttgcatttaaaaaaaaaaaggaataaggaagagaaagaagggagcatatgtaatgaggagacatggacagacaaatttaaaatatcttaaatgcctctcagtgacagccagttccttcattagaggctttttatttacaatcctagaaaaatattaatagcaagcaatttttcaattggcctaatcacatttcatcctttgccacacaagcaaagaatcaaagcacacttgagagcaaagaaaaacaaaattcaaagtg

SEQ ID NO: 153517 - DNA, 683 bp, Homo sapiens
atcccagcactttgggaggctgaggcaggcggataacaaggtcaggagttcgagaccagcctgaaaccctgtctctactaaaaatacaaaaattagccgggcgtggcggtgcgggcctgtaatcccagctacttgggaggttgtggcagaagaatcccttgaacccaggacacggaggttgcagggagccgagattacaccactgcactctggcctgggcgacagagcaagactctgtcttggaaaaaatgaatgaatgaatgaatgaatgaatgaatgaatgaaaaggaaatgtaccttttcatataatgaacaatttgggaccatgtgactgtttctcacactacttcacgcatgcacacaaacaaaaataaatcaactggctaggcgtggtggttcacgcctgtaatcctagccctttgggaggccaaggcaggaggatcacttgaggttaggagttttgagaccagcctggccaacatggtgaaaccctgtctctactagaaatacaaaaattagccaggtgtggtggtacacgtttgtaactccagctacaggctgaagactggaggctgatgcaggagaattgcttgaacccaggaggcggaggttgcagtgagccaagatcgtgccactgcactccagcctgggcaacagagagagacacggtctcaaaaaaaaaa

SEQ ID NO: 153518 - DNA, 431 bp, Homo sapiens
cactacccgaaattattaaacactataatcattcagtgccagtgttagttaagctcagaaaactcagcttacagtggtctgctctggcatatttccagaaggtactttcctcttttggaagttacatgaaaagggtgaaaattaactaagaaaataattatcctctctttctatccctcttctacaatataagcaaactatcaacatgcaaataatatttcgtgcctccatttctgcattttagtcattaccaattcatcattaactcagtttctgaaagtctaccatatgccaggttgtgttctggacataaagtccctgtcacgtgtgggaacccactcaagtctactttcattaagaaaacattgaactgcagaatttcaaacaatgcaagagattaggggagaggctgagggtggcctggtgtagtt

SEQ ID NO: 153519 - DNA, 369 bp, Homo sapiens
atcacaggtggctctaaaactttaggatgtgtaccaattgaagttagtgactcacctggcccaaaatctagccaaccttcctttcttatctctttttcttgtacttgataaacaatgttgtagcaataacacatattattatacaggccaaatctaacacagtgtcaatttacattagtacaatttgtaaaatggcaaatcagaaatgtcaaggtgtggaaatttttattgttttgagactgggtcttgctctgtcacccaggctggagtgcagtagccagatcatagctcactataaactcaaactcctgggctcaagcgatcctcctccttggccttccaaagcactgggattacaggcatactagg

SEQ ID NO: 153520 - DNA, 117 bp, Homo sapiens
ctggccagaactgtgccctatggccacttttgcttactgatgaccagggattcttaatggagataaggtcagaaacccaaagtatagcacctcacttacatatttagttcatttcaa

SEQ ID NO: 153521 - DNA, 104 bp, Homo sapiens
tgttcacactgaacctcagtacctagcccagtgcctggcacataaagaatgttcaatttgttgaacgcatgagggaatgagctctgaatgctatgagtgtgcat

SEQ ID NO: 153522 - DNA, 361 bp, Homo sapiens
tgacctctgaggtgcttcatccgtttctcagatctcatctaaagcaatatttgacacaattgaatagtggccttctggccacagtatccttacttgggttctaagacatcaacactcctgttttactgccacctcacttctcagtatccttggctgactcttattgcaacctcttctcctcagtcctctgacctcttcaaatattctctggtgctggcaagtttcatggtttaaataccatccttgagtgactactcctaactttatagtctagccctgatctcttccatgaaatccagattcttatattcaactgcctatttggcatctccaatttgaaatctaacagacagctcaaatt

SEQ ID NO: 153523 - DNA, 124 bp, Homo sapiens
tagacatgtttaagtttctttggaatcatcaaatggtgatgtccaagttgttggggttcagaaaagagggtatgcttgagatagagcctcaggtccatggttcattgattcacctcatttcatt

SEQ ID NO: 153524 - DNA, 385 bp, Homo sapiens
tctcaaaaccagcacagtgactacatcagggaaggagcacaacaaatgcgtgaattagcagcagcagctgcagcagcaaacactgatttttatcaaatgctggttacctgtccaagccctttacaaatactttactaagtctcattttacaactattctgtaatgtaggtactatgttgtgtccacaagaggcttagcaaggttaggtatcttgcccgtgggacacagctaaaaaatattgaagttggtctttgacccccaaatctgctgatcctagaattaatgctcttaccaccatataatcatgtgccattgatctgatgtttattattgctaattctcaccatggccttgtgaggcggatcttatattatcctcctattat

SEQ ID NO: 153525 - DNA, 661 bp, Homo sapiens
tagagttggccttccaaatactatttcactcctgtctctcctgttcatggaatcttttttgataacagaaggttacagttgggtgggagagctcttgtgatcattcgtgccaatctcaaattgcccacagggacgttttgggatcccctgcccagaaactttgctgttgtttatagatgaggaaactgaaacctaaaagatgtaaatatggtttccctcaagtcacataaagtgcttttagcaaagccagaactggacccacatctcctaatccctattcccgtggaggatctctattacactaatgcattaacttcactcctgatctttaagtaagctccacgtctgtggtctctgttttaagattgtgaaatgtcataaaggtggtttgcctttgaaaataagccagaacctagagagttaatagaaattgaacagtgaaagtggagtccttttcttctctcctcaactggggagccgccaggctgtttcacttgcaccgcatgtgttccattatggtataatgatgtaattaccagtaatgctgctgctgcttgagtagtggtgaagaggcagcattaaggaaaagactagccccagttctctcctaagagccatttcagcccacttcagtctattagattgaagatgctggaaggcg

SEQ ID NO: 153526 - DNA, 703 bp, Homo sapiens
atagctatttgctttagaggtcaaagtctgatgtacggaaacacaaatttcttataaaatgttaaaagcaatccaatttattcatatatggtaagtactgaatggttcttcccttttgaaacaatattcccccaatgggggaggtggagatctatcttcttcttatattaacatttctattacacagaatttcaatggtctgattttgtacaatactttacacaagtggattaggtgacattaagctaagagggaaatatttaatattttgacttaattactgtatacattgtaaaacatttaataataccaagcttttatattaaaggaaaagataaacatttttcctaaatcatcacacccaaataattatctcaaattggttactaaagttcttcaatagatgttggaagaaaccatttggaaatagcatatttcacagctttaatttttaaaagctttccaacatatatggaatgactgtatccaaacatatataaattttctcactaacaagaactgagaccaaatacacaaaaaattacctagtggtatcaaaattggaactacagatgaaaaatatatcatgagaaaggactataattattttcagtaggaaaaaggcagcacaccatttggttttaggagtttaatctatggaatcaaaccagaaattcgactctagcttactagctgtttgacc

SEQ ID NO: 153527 - DNA, 707 bp, Homo sapiens
aataactatgtctgttctgggccagttttgattgctttttctccacattgtgcctttttgcatgttttgtattcaaacatatttcttgtctttcagaaatcactggcttttgttgtctgatgtccagtgtcttcaaaatcattgtttcatatattttgttcaggattttttgggtagggaggagtgttttaggaaaagagtcaatctgatttctgttacactgtcttgaatagaaaaaaattgcgggatttataatgtagcaacaatcagagaaataaaaagaactgtatgaagacattaacacactatttatcttaagaaagtatttagtgtctggacagattaatagacctgaatcagatattctcattaaaagtttagatgcccagaaaaagaaattcagtatcattctatgtcaatatggtatcttcaatgcttcattcaggcctagttgcattccatttattcagaataatggtgtgtaaggttaaaaaaaaccctatacttttgaattggaatatacttctgatctttgcataaattttaattgcttgaatattaataaaagcccttggcaagggaattgatatataccagatcctgtaatatgaaagaacacgtcagtttttgacacttaagagagtctatccaaacttgaaagtgtctcctgccttaaaagtttccatcttgattattttactcatcag

SEQ ID NO: 153528 - DNA, 111 bp, Homo sapiens
caagccatctctttctctgctagggaaaaacacatccctcagagcccttaattcacagccttctagctcaataatgtgacacatgtcaaggggctacttcctcttccctaa

SEQ ID NO: 153529 - DNA, 111 bp, Homo sapiens
tgctgggattacaggcgtgagccactgcgcctggcaatcatggacaatttttgatagtcttcattcttcacagtgccttacacaattggcactcaataagtgagagctgct

SEQ ID NO: 153530 - DNA, 329 bp, Homo sapiens
taagcttctctgtgaccatggaacactacccccagccccgctgcttttgcctccggtcagtgggttttgcggggctctgaggtgtctccccactcacccagctctgggcagagcagctgggctgggctggggctgagctaaccagaacctggaagtagggctcggggttctggctgggtccccatccctgtcctgacaaatgaactccagatccacaggaccctccgtgtttcttaaaaccctggcaaaacagtgtctgcctgtggcatgttcatgcccacagctcaacaacacactagctgcaaggggccttcagataccagccggcc

SEQ ID NO: 153531 - DNA, 296 bp, Homo sapiens
accacctgaggcccgcagttcctgctaagagcaagactaagcttccctcctgccttcactcattcattcctaattccctccgcctcatcttcagtgccacctccactggaccttccatgaccattcccccaccacaggacagtcattctctttatgaatgcacagttcatagcatgtgattcatagcacaatttacatgaaataataaccaactgtccattggttgctttatgtctctctacgtgctccgtgtgtacaacactgcccccagccctgagcactgggcctggatgtag

SEQ ID NO: 153532 - DNA, 572 bp, Homo sapiens
aacctcagtatatatgtaatgccgaagagaggttagggtttctttaggtttccgtactttcctgttgagcactgcggcgcaactcgccttgctgcggttggtggtggcgatggagattgcagcgcggctgaagggaacctactgggttggtgacatttacaagagagtcttgaagattttccagaacgggaaagattttggaagaacaaagaggaactacagaatcattgcttacattgacacaattgaatgggaagccatcattctttaaagggcaatgaccaagcagtaccagcagaaattgaagtaccagcagaaggctaagaagggatcatggcacaagttgcagtttccaccctgcccattgaagatgaggagtccatggaagatgaggagtctgttgaagacgaggagtccgttgaagatgagtccgcggagagcaggatgctggtgacattgctcatatcagctcttgagtccacgttctggaggccacaagtccaaaatcaaggtgtgggccagaaatgctgctccctctgcagactcttggggaggatccttgctttcttcca

SEQ ID NO: 153533 - DNA, 812 bp, Homo sapiens
aaaagtgctattacattatatacctctaagaaggaaaaaacactcaggacagggagttcagtaggagacctaacccacaaggctggtacacccagggataaatgagaaattaacttggccatccagaaaagggaccataaagaaacatgcaggtctcaaccttgacactacatagagaatggaaaaaaaaaaatttctcagaatttgaaccacaagccctaagctttgggtgtgcagccttaccaccagtgtggtctacaaaggcctgccccaaaggattaattcagatggtatcgggctgatagcgttcccagatgacagcagaagcagatgtacatcttctctgggaaaattcttctctagtcaagacctatgaacctactgggttggtgacatttacaagagagtcttgaagattttccagaacgggaaagattttggaagaacaaagaggaactacagaatcattgcttacattgacacaattgaatgggaagccatcattctttaaagggcaatgaccaagcagtaccagcagaaattgaagtaccagcagaaggctaagaagggatcatggcacaagttgcagtttccaccctgcccattgaagatgaggagtccatggaagatgaggagtctgttgaagacgaggagtccgttgaagatgagtccgcggagagcaggatgctggtgacattgctcatatcagctcttgagtccacgttctggaggccacaagtccaaaatcaaggtgtgggccagaaatgctgctccctctgcagactcttggggaggatccttgctttcttcca

SEQ ID NO: 153534 - DNA, 421 bp, Homo sapiens
tcacgccctgtccacaagtagctgggactacagccatgtgccaccatgcctggctcattttattttgttatgttttgtggacatgggctcttcacgtgttctggccctcggttgctctctcatgcccttacctatctcctgtctcaacatcagcctcccaaagtgctgagatgacaggtgtgagtcactgtgctcagcccgtttttgtttttgacaatttggtgatctctggtatattcacagatatgtgcaaccaccatgatagtcaattagtaaagcattttgatgacctcaaaaagaaacccctgtgtctttagctatcacccacttccatcattagactattatttttgatttgttttttatttattttgagacaggaattcgctctgttgcccaggctggagtgcagtggtgcgat

SEQ ID NO: 153535 - DNA, 278 bp, Homo sapiens
agctaatttttgtatttttagtagagacggggtttcaccatgttggccaggatggtctcaatctcttgacctcgtgatctgcccgcctcgacctcccaaagtgttgggattacaggcgtgagccactgtgcccggccaacagaacatttcttatatccagtgttttatttattagtcttcatcaatgcaataaatacactttggctttcttggaagtatgatatctagtctggtcctttaatgaggaaataggaaatgaagacttgggggaaaacact

SEQ ID NO: 153536 - DNA, 269 bp, Homo sapiens
ctgggccacacatacgcagccaaagtcagagaactcagagaatctgagactgatggagaatcagctaactttagtcttcttggccaaaaataaacctcacttttttttcgggagacagggaaaaacgctatcaatttctcacacagctagttaatggctttcctacgattcaaaaagccaggtctcttgggttccagcatttgatacatctgtgctaaatgtctgcggaacacagaaccttctagaggaaatctagcagtaggccgggc

SEQ ID NO: 153537 - DNA, 393 bp, Homo sapiens
gggttatgtgctggagagtgttattagcgggctccttctatggggagcatcaacacttggggcctctggcctttgggatgactcctgtcctggctgattcgatggctctgcttccactctgaggagcaggagccccctccacagctcatgccctcagcccctcactgctgcatgaaagctcaaatccctccctgctcagaagcctccatcccagaggaagacggaacccacagaaaacgcagcttcaggctccatcctacagaaccaaccccatgccaggtactgctggaggaacaactgggctcagaaggagagagcctggagtctgtgagacaagagccaggcctcccccttctctaattccaggagtacaggcctgcacccccacttcct

SEQ ID NO: 153538 - DNA, 121 bp, Homo sapiens
tctaaacaagctggcaaaatgtgattcactgaattctgagtatgttttcaactggaatgtctcactggaaggataatgacacttggttaatttggcatagaagaggaatgaggtgctccac

SEQ ID NO: 153539 - DNA, 295 bp, Homo sapiens
aggtgccgggattgcagatggagtctcgttcactcagtgctcaatggtgcccaggctggagtgcagtggcgtgatctcagctcactacaaccacctcccagccgcctgccttggcctcccaaagtgccgagattgcagcctctgcccggccgccaccccgtctgggaagtgaggagcgtctctgcctggtcgcccatcgtctgggatgtgaggagcccctctgctgcccagtctggaaagtggggagcgtctctgcccggccgccatcccatctaggaagtgaggagcgtctctg

SEQ ID NO: 153540 - DNA, 167 bp, Homo sapiens
atttttttaatgacttaaattataaattaaatgaaaggcaagagattaaatggtgtggagtttgggaatggagagaaaatcatgtgtttctttttgtaaagtctgcttataggcatgtattaccaaacttcataatgaacacatgtgaatgtagttagctaaaagtt

SEQ ID NO: 153541 - DNA, 273 bp, Homo sapiens
gcagaacgtattttgttttgtttttaaagtctcagcaaagttgttacattcatctttcagttgtgtgagctttatagagcaggattcatgctgtgatgtgaccttgttacagattcactgaagatttttgtatgttttgtgaaaagtcaggaaaattaaggttggcatgtgaacgcctaagcttttctgagtttggtaaactttctaggttatgtgaggaggatgcatgataattgagttcttgagaagtgattgaattgtgaattaaagtga

SEQ ID NO: 153542 - DNA, 333 bp, Homo sapiens
ctcgtggcttgagaggactttctagaggcagcatcacaagccgatttccaaaggctggatcatgtagctgggcatgacgacaggctctggagcaccgtgttaggtggtggtaatgatgtggatattaaagatgcatgtgaaagtgggaatacagtttttgaagaaatatgagtgaaaatcacataatttacttatgtttttgagatggggtctcactctgcagctcaggttgtagtgcggtggcgccatcttggctcactgcaacctctgcctccaggatcaagagatcctcctgcctcagcctcctaagtagctgggactacaggcacacac

SEQ ID NO: 153543 - DNA, 777 bp, Homo sapiens
agagcattctccaaagacacaaaaatatactgcaagaaataaacatttttctttgcaaatggaagctaaatccttagaatataaaagttcccgtttatcgcctcgcagccagcccagacatctagaattttttgttcttcatgaacaagggctgaccgtacatcattctgtaattcccttcagctttctcacgaactattcgtgtactatttcagaagcagaaacacacgagttcagtgtttttgtgttgcatacgccgtccccagtgtacagagacatgaaaatgcactccgagcgctccaccggcacagcttggtcacacgggatttctgtctgtttctgtgcttacctctagtctgtttagctccttgagggcagggaccctgcctagcttgtagttggtgctcagtaaattcttctgaattaatgaaaggtgaagggcaggctgattgactttatacgggggggtctgtcacatctcatatagtccacagaaatctatgatgtccttttgtgaccccgagatagaatgccatttgagaactataattccatcttggaggtactgctgccattgcaattccagctcagatggcaagaacttgcttccttcctcctagagcagggcatgggcctcagcctcatgctgctcctgaccttgagcgagccttggtcagggtgctcctggggactaagctggggcggcccagggactggagaagaagacagaaggatgtgcatgggagccccttgcctcttgtgttctgttactatttc

SEQ ID NO: 153544 - DNA, 339 bp, Homo sapiens
ccaccctaccacaaaccccctacgggggggtctgtcacatctcatatagtccacagaaatctatgatgtccttttgtgaccccgagatagaatgccatttgagaactataattccatcttggaggtactgctgccattgcaattccagctcagatggcaagaacttgcttccttcctcctagagcagggcatgggcctcagcctcatgctgctcctgaccttgagcgagccttggtcagggtgctcctggggactaagctggggcggcccagggactggagaagaagacagaaggatgtgcatgggagccccttgcctcttgtgttctgttactatttc

SEQ ID NO: 153545 - DNA, 453 bp, Homo sapiens
ggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttg

SEQ ID NO: 153546 - DNA, 280 bp, Homo sapiens
tatataaagaaagttcctttctaaccctctgctgcaaaaatccatgtcacatgcttcctaacacatgaggattattacttgatcttagcctgaaaacaggacatttatttttcctcaaacatgtaaaaaggattgaccaggcacagcagctcatgcctttaatcccagcgctctgggaagctaaggcaggagaatcattagagcccagaagtttgagaccagacagggccacgtagcaagaccccgtgtctctataaaaaaaagtttgattttaattagc

SEQ ID NO: 153547 - DNA, 398 bp, Homo sapiens
  misc_feature (47)..(47): n is a, c, g, or t
gcttggacgctttgatctagggagaaaataagcatcactgctacttngctgggccagtgtggagactgagtctagctcccacctgtaagtgaaaactgtaacctccatctcccgggttcaagtgattctcccgcctcagcctcccaagtagctgggattacaggcatgccccaccacgcctggcttgtatttttagtagagacagggtttctccatgttggtcaggctggtcttgaactcccgacctcagatgatctggccacctggtatgcagtttctttaatgcactgatgctggaagttcacttcttcctgtcctccttggcactgatttacaacacctgcccccactgtggtcttctgggctctcacctcattgttagaatccatctcatgaat

SEQ ID NO: 153548 - DNA, 362 bp, Homo sapiens
tcgtgatctgcctgcctcggcctcccaaagtgctggagtttctgttgttttaggccaccatttctaaggtattttgttttggcagcctgagcagagggatatggttccttttccaacagttggtggaaactgcataattcatgcaacatcagttagagtatttggaagagttttgcctcagtaatggggcaaaattagccccaacttaaagctgctctggttctacctaacaaaccacaaaaccataacatctaaacccaagcaaagctcaagaatatagaaacacaaaaatatgcagcattcaataaggtaaaattaataatgtctgcatcaaatcaaactaaacagacaagcaaagaagg

SEQ ID NO: 153549 - DNA, 356 bp, Homo sapiens
gtttctgaattattttcagctgattgacaatgtttctaactgcaaaagagaacaaactcatttctatgccaaacaggactaaaaaacattcatggatgtgtccacttccttgtaactcaccaatttattttggttggggggggggcggtaatacgtccactgattgatatttgatccctaactttattcaagacttatttatttatttatttgagacagagtttcgctcattgcccaggttcgagtgcaatggcacgatttcggctcaccacaacctccacctcccgggttcaagcgattctcctgcctcagcctgagtagctgggattacaggcatgcactgccacgccctgcta

SEQ ID NO: 153550 - DNA, 626 bp, Homo sapiens
gagcagcatccaattggctgccagtgcaactagtacaaagcaggggggaagaatgtgggataagctggcttgctgagtcttctggctttcatctttattccatgtctgatgcttccttctgttcctcctgtccttggacatcagactccaggttctttgccactggactctcggacttaaccagtcgtttgccaggggtctgtcaaggctttggccacagactgaaggctgcactgttggcttccttacttttgaggcttttggacttgtactaagccactattaacttctttcccagcttgccaatggcctatcatgggacttcaccttgtgatctgtgagccaattttccctaataaaatccctttcatatacacatatatcctattagttctgaccctctagagaaccctaatacaagggagaagaaagagaaatgatctagacccaagtttttaagtgaagtaaaaagatgtaataatggtagagtgaagttagcgttggtcttgaaggcatatgtcacttacccatgtcactgttgctcagtacagacaatgtggcacgtaaaatcgtaagagtcactagtgatgtctttggtcctgtgggcacttggctaaacttaacaa

SEQ ID NO: 153551 - DNA, 471 bp, Homo sapiens
ctgatgtacattaggacatgggagtcattacttatctcattaaaatataactgttaatatttgtctctggtatgtgtcctcagggcagggaccacatcccactcagaagccaggccagtgtcccatatcttatccttggtaaactgaagagagatcattctgggactactgacaaggtctgtatgactgtgggggatggggaagtgttccccaggaagacagggcaggaaggcagtgttcaggctaccaggaaatgagggcaagaaaattaagtaagctaaaataggcaaggaccagctcatgcagggtcctacggcccacattcagccttcaaagctcatttccagctatctctttcaggcagtcttgttaatctgcctaactagatatggtctgggctctcttagcattttgtgacctccatcatgtacagccaacagttaactgtaaatcgaggtctgggtctttatt

SEQ ID NO: 153552 - DNA, 165 bp, Homo sapiens
cagtcaaagtgcactccctctcctagatgaacaggaagtggggtcaatatctgcaggcctctcctctctccaccacccagtcctgccaggatttctgcactctggtactagcctcccagctcaccttgttcccccccctccttgttacctagcccaccttatggc

SEQ ID NO: 153553 - DNA, 265 bp, Homo sapiens
ggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttagg

SEQ ID NO: 153554 - DNA, 388 bp, Homo sapiens
  misc_feature (52)..(52): n is a, c, g, or t
  misc_feature (110)..(110): n is a, c, g, or t
  misc_feature (113)..(113): n is a, c, g, or t
gaagttttattttgttgtgaattgaatctgggcagagtgtacaagggatctnctctgtattatttttacaactacatgtgaatgctataattatctcatcaaaaattcanctngaaaaaggtatcacggagcccatgtttgctgttaccgtctttgctcctcccaggttacaatgccccgtgcctctcagtgcacagtgaaaatgcagcagacgtttttgatgtgagctccacggaatggatccagactgtccccttcaacaaggtaatttgaccttaagattatgcaactaatgagttaatgactgaaacgcggaaacagaaataatccattgtacatttactgtaatgggtacttgctagtttggaggcttaacaaagagtataaa

SEQ ID NO: 153555 - DNA, 303 bp, Homo sapiens
ggagccagggttcctcctgggagcagccgcgccctgctgcctgctcgccgacctatcggtatcccgatcgttgttttgtcctcttaaaaatgcccaaggcgaaacagccttcccatgtttgaaagttattgcaagcctaaaaccttgtagactgggaaacccagagcctaacgcgcagtgtctagtccaatgtagccactccagaaatatttgttaaatgcagcgtcagaaaagtgagtggaggaaattgatactgctcgaacggtagaagacccctcgccagcgcctaccctgcgattaccc

SEQ ID NO: 153556 - DNA, 355 bp, Homo sapiens
agtgtgagtgagaagtgagagagtgtgtgtgtgtcaaatcaagtataccaaaggcccttgcttccccaatacaggaagggggtgataggatcatcatgaccagtgcttggttgatggtgggagtgtgggggtaaggattttaggcaaaaggaatcatctcaagtgaaatatgtcccttctgccctctgagcctcctaaaatacaaacatccagtatcccatgacttaagcctctttccctgctcactcacactctcacactcacatactctcacacacacactctcattttctcacacacactccacactcacacacgcacacactctcacacactttctcacacacacacccac

SEQ ID NO: 153557 - DNA, 374 bp, Homo sapiens
acatcagctattgaatgacgaagatgagcgcattggcatgggataagaatggactaaagtttagagcagcccatgtaattcagtgtggcttttgtttgtggtatccagatacctgtctatacttggtaagactcatggtgcctgcctttttttacagggaaaatgacagcaacttcccctcattcttttgactaggtttgtgaggatagaatgtgaccagaggaaaatagttttggtaaagacaacacagtgcttgggatcagacgaattttggatttcagggttttttttgggatttgggaatgtttgtattgtacttaatggttgagcattcctaaacaaaatccaaaatgttctgatgagcgttactgctg

SEQ ID NO: 153558 - DNA, 909 bp, Homo sapiens
tgaagcgattgcaggcgctgtggctttcccgcccattcgcggcgttggttttcccgcttctgagacttgtttggggaggttaaaatttggaggataactcccagctagaaaggaagaaaagctctaaagtggaatcgccttcccccggaagctgttgtaaaaattaaaggatgtatgtgagtgcacaggcaaaaaaaaaaaaaaaaaaaaaaaacaaaaaacaggtgtgagcgcggccctacagaaagcacacacaacaccatcggtcgggagcccgagggcccaaaggaagaaaagtgaaccagtgggcaacaagggagtaacaaagaacaccccgggacagaaaaaaagggcagggaacatacacacaaatataaaaaaaccaccggggtgcaacacagaagcctctgagaacaaaatctccaactgacacaacacagaagaacacaacggagccacataaaacgaggacacaagacagagcaaagaacagcaaaaataagaaccaggaagggggaaaaaaaaggaaaaaaaaaaaaaaaaaaaaaaagacaaagaaagaaaaaaaaagaaaagaaacagaagagacaaaagacgaaaagagcagagaaaaaaacagcgacgggggagagcgagagagcggcacggggcgaagggcagagaaggaagagcggagagggcggaggacgcggagaggggcgagagagaaacaagcaggaagaagacggggaggaggggagggggcgggaggacggagagcggaagggagaaggaggagggagggagcgcggggggaggggacggaggagaaggggggtaggggagggaggatgcaggggggcaggagaggggaggaagggagagaagggagggaggagaggcgagagagggggggggggagaagggagc

SEQ ID NO: 153559 - DNA, 326 bp, Homo sapiens
caaggctcctcgtccgcatcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctcc

SEQ ID NO: 153560 - DNA, 1268 bp, Homo sapiens
acacctgttatgtgtcaacttgattgggacatggggtgcccagatatgtggttaaacattctaggtgtgtttgtgagggtgtttctggatgagattaacatttaaataagtagagggaggtaaagcagattgctctccccaattttggtaggcaccttttaattcattggagactgaatagaacaaaagggaaaatttgctctctttcctaattgcttaaattagaacaatggtgttctcttgcccttggctagaacttaaaccatcagtgatcttggtactagagccttcagacttgtactaatacttacatcatcaggtctccaggttcttgggtgtttggactcagactggaagtatatcaccagctttcctggatctctaccttacagatggcaggctgtaggacttctcagtcttcataattgtctcttcacccagagacacaactctccaactccaatcaaaaaaatctttgggcagaagattgattgatccatcttggatgacactgtcatctgtggatggaggactatggatcagaccctttaatggctcagctgcagtgttcaacctgtggttagaaggagttgacctgtacaacttttatgtcatggttgtgaaggaatattttccaggagaatgtaactgctctgggcagacaaggcaatgtgttcagcagtatttcataactaacatgatgcttttcacaaattagatgctagaaaattacttattctactattacactactagatttcttaacagctttgttaaaatataattcacatacaatagcatttacttaaagtggttttttttatattcagagttgtgcaaccataaccatgatctaattttagaatattatctgaaacttggttttagcctagtgagaatttctaatgtaaaaaactgtaaaatagtaaattgggggttgttttaagccactgaatttgtggtgatttattattggtttataacaataagaaaccaatatggattcactcaccctgagattctgttttctcatatttaaattgagcataataatgtatatctcacaggattttatggaattaaatacgataatatgcatggtagaaacttctgaagactcagtactaataaatttatcatttaagtttttaattttaatgtattatagtccaaatattttacagtttattgtaaaagattatacaaaataaaacatgatgcgtgccgcccgttcctttgccttagcactttacatccggaccagttga

SEQ ID NO: 153561 - DNA, 142 bp, Homo sapiens
tgttggccaggctagtcttgaactcctgacctcaggcgatccacccacctcggccttccaaagtgtgggattaccagcatgagccaccgcacccggccttgtgatgtgaattttaatcttctagggttaaggaaatttcagg

SEQ ID NO: 153562 - DNA, 269 bp, Homo sapiens
ctgtctttaggagaatgtgttgaaaggtgaaggtatagcaggttaaaatagtggcaattcaagtcacaggggctttactatgtcttcctgtgctggcagtgctttgccaaggtgcaaatatttattgtttgattacctctctgaggctgggtgtgcatcagtgggttactgtggtgaggtgactcacattgatctgtagatagaagcctgagagtgatcttggatacctgatctgagggtgtcaagaagaattttttcaagggagtggt

SEQ ID NO: 153563 - DNA, 203 bp, Homo sapiens
agtatttagttgtgtgatcacatttcgtcacatacagtaaaacctcccaaattttacttgtagagttccagtgagttctggttgaacaagtatatggatcttggtttttaaaatattctcaattgtttttgaatttcaccattatttaagtgcttattctattccaggcattgggtaggcatttgtaaacacaagacatggtt

SEQ ID NO: 153564 - DNA, 475 bp, Homo sapiens
ggcgacaggcttcatttaagaaatggaaggaacaacagcaggctcatctctgcggctgtggctcagaggtggctgggcccacaacagagtcaggacaagcagcccaccccctcctcctactccgcagccgacccaaggtgcaagcaatgcggacaaaggcaccatacaacaggggtgagggacaacacatcccagtcctcctaggggagggggaagctctccaagtctgaaatgctcccccaaaggtacaatcttcccactcaccactgcattcagaagcactgctcccacaccactgaaggtgcacagcaccccaggaaaggagcctatctgtggacaaaaaacctcaaataaaccacggtcagaaatcagctacgcctaggagtgtgtgaacaagaaatgcccactcctctggaaaaggggaagccctctccagagcagggtggaaagcaagaggagaagcgctccacacagc

SEQ ID NO: 153565 - DNA, 518 bp, Homo sapiens
cctaaggtttgcaggatgggtaagactgggacttgcagagataaagaggcaactacctactgagaagacagtgcagctgaagtacagaggcactttcatatcacactgcagagatctggggggaaaaggggtctattgggctttgtcttcctggtggctcagctgcacagagagaagcaacggtggaaggggctgagaagtggaggaggggccaggtctaagaagttaagagccaagaagatggggctagtgatcacagatgatgaaggtgaagcgcctaggttaaaggcaaggggccaagccatagtgcggtatggaggtccgaagttacaggtctttggggccaagtcaagggctgcagggaggaagaggagagaggagctatgaaagaccaagagcaaggtgctaacagggtaattgtacagggaagctagataacgggtcagagatacaggaggaccaaggaagtcagagggtcgcaggagacggtcagggaagaggaagcaaaggctgccaga

SEQ ID NO: 153566 - DNA, 368 bp, Homo sapiens
  misc_feature (169)..(169): n is a, c, g, or t
  misc_feature (205)..(205): n is a, c, g, or t
  misc_feature (211)..(211): n is a, c, g, or t
  misc_feature (214)..(214): n is a, c, g, or t
  misc_feature (220)..(220): n is a, c, g, or t
  misc_feature (246)..(248): n is a, c, g, or t
  misc_feature (299)..(299): n is a, c, g, or t
  misc_feature (312)..(312): n is a, c, g, or t
ccatggcactctctggctgcttgagtctcctctggccacagcaggcagtgtgaaatggccagggagttaaaacttccaagaacaaccctcagccagtgagggatggaaggtggtgaataaacaccccagcacccgcagcctcctcttctgtcaccaactgggaacccanctcttcctgaaagtcctcccccactgactcaccggnttgccncangcttgncaagaatgtcccagtaaccagggggnnngcactgaagtgactgaggggttaccttggagttgatgccttggctcagatncagctcccctgtnttcttcctctgtaaccttggacaacccaacccctctaagccacgtcaacccacggg

SEQ ID NO: 153567 - DNA, 184 bp, Homo sapiens
tgtttaaatctacatatgcactttacgagtacacccaaagtgcacacctggaaacaaacaccaaactgtctcctgagacccaggttataaaacacgcttagagaagcctggttggttctcagtcattggcctgaagccagtgaaaggacacagttgcatcatattcccctagtctacagtgttt

SEQ ID NO: 153568 - DNA, 407 bp, Homo sapiens
acacgcaaacacaaaccaatctggatgtcttttatttctttatcttgcccaagtgctttggccatgacttctagtattattttgaataaaagtagtaaaagtgagcatccttgtcttgttctagatcttagaggaaaggcattcaatttttccatgttcagtacaatggtagctgtgggttttgtcatatagcctttattattttgaggtatgttccttctgtatgcagtttttggagcattttatcataaaaggatgttgaattttctaaaatgctttttcagcatgtatcaaaatgatcatttttttcccttggtgctgttaatgtgatatatcatgtttattgatttttgtgtgttgaaccatacctgcatccctgggatgaattccacctgatcttggtgaat

SEQ ID NO: 153569 - DNA, 193 bp, Homo sapiens
tactaaaattcatcaattcaattaaaatggaatttgtggatactaaatgctcagaaaataaaaaaaaaaaactgtaagacatcacatgggaactaaaaacttctagataaaacaaatccagataacagtagaacatatcctaaagtgtgatagatactctagaagtacagggaagagttacagcaggggagat

SEQ ID NO: 153570 - DNA, 207 bp, Homo sapiens
catttgtgttcactaagaagaaagagataatggttaagatgtattatatttgtcaccatgaatgaatttctataagtctaaaccacaaatgttaatttcctatatgtgttttaaacttaatacaatgttatatcctcacattaaaaatgtgtcatattttatcagtgactaaataaaaaacaatttagaataagcgcctacactgag

SEQ ID NO: 153571 - DNA, 246 bp, Homo sapiens
cctgtgtttcccccatttaaagaaatcgttcagccaactgtgctcttgaagtactctttctgtcccttgggtctatggagcagtggtgggaatgtagcagacactcagtaaatacttgctgaaccaataacagggaatcctccttttcctcttcacaataaacgccagagcacacgctgactgccgacaccagttctcaccatcccttccatcccgcctttgtagcctgccccactggcgtcccca

SEQ ID NO: 153572 - DNA, 442 bp, Homo sapiens
ccgtaaggtttgaatataaaaccctagttattattcagttgtgtttcctaacttccactatgatttctttttcttctttttaaatttagatcttaggatctcaggagcccagaatcaaattaatcacgacccttggttcaggacacattctcctcatttgttcacgcgtggcccgttttacttgtctctgtgattataactgtacctgttttcgtgggtagcgactaactgaggccagtggtgcaggtggtaaaggaatttaccaagacagttgtaggtcaagaaaggcagatttattcgagaaagcaggaagataggttgcaagaaagcaacgggcgtgtcagcaagagagaagctgactggcaggagacagagccttgccgggggttttaaaggtggtgcttgcgctggagagggccacgagcggtgctggtaacgccag

SEQ ID NO: 153573 - DNA, 510 bp, Homo sapiens
cctcctccccattctaaagtcactttatatgccagagtcagatatctctcctttcttcattccagttcacaacctaaaatttgtcaaagacttctcattcagataaagaacaaattcttaatttggcatcatttttaatcttctctgaaccactctctttaaaaccactctcacatcctaaaatttttcaaagcattctcattcagaaaaggcacaaattcttaatctggcattgtttttaatcttctccaaagcactctctttaaacaattattttcctacctttgttttagccacagtggtgaactcattgatttcagataaacaatgtcctccctgcttcccctactgcctacttcaggtgctagtgagaatgaaataatgtgcaggaaaacacctagcatgttctgccatactgagccctgtgaaatgggtaattcacttgaacttcataccccatgcaatgaggatgaggctcagttattcaacaagctgttagagtggagcctg

SEQ ID NO: 153574 - DNA, 184 bp, Homo sapiens
cacttataattcctacatcatacttttagaattaccagcagaataaatacctaaagttaattatgtacctggtccaaggaactggcatcccctagcccttactgctgcccaaagattggaagagagttgctgaggattctggtgctggagaatgagctctgtaactgttcgttcacctaaagat

SEQ ID NO: 153575 - DNA, 584 bp, Homo sapiens
cacccatcatctattccccttcatctttcgcagttgaatcgagatttggcagagtttccacccttcctccatgcagcagtgtattattactgagaagctaacgccttacaggggtggcccctgattagtcttagccattgaaatttctgttagttggaggatagaatatcctaattcatacagtcaccatttatttcctgttattgctttgattttgctgctccagccacaaaatttgagtcctattgtccttgactaactgcatcttcccaaccagatttacttctgtcgttcattatgtctcctccacacaaaatgactaagttactttaccattctttcattgttataattttctctacagtggattcacctctttgcaaaacttacgttctgaagccaatttataaggcaataatttcttataattactcctgaatattcttccttatttgatcgctagaaggagttggtttgttttttggccacaaaagggaatggtctttattatttcaatttattttctttctttgatttttctcatttttttaaatgctttggttgaattggtatggtttaatttc

SEQ ID NO: 153576 - DNA, 489 bp, Homo sapiens
gaagggagtaagtcaagaaaaggacacaggatccggaaaagggattcaacatagaaaagagacagagaaatgctcctgaaaacaaggcaaccagtctctcacccccacagaagatgcagttgataatggatggttggcctgaaggctttatcacaacccattatctggttgtgggctggcactgtaagccacagccatgccccaagtctgaccatacctgctgtggatgataaggtcagtggtcagtaaatactcacaggatgaaaagcaaaacaaaccacgtgttttttccatctgacccgagctccaccagagcttgaaacatagttttgactgctcacacgtcaaaactgcttcaagtggacttcagctaggtgtagggagaagatcatgtgtgtctgtgaacttggaaataacaggtcttggtgcaggcaactgatccagagagcttgacgctgcccactagttggagcaccaaatgctgattca

SEQ ID NO: 153577 - DNA, 506 bp, Homo sapiens
ggctctgtgtccccaccaaaatctcatgtcaaatggtaatccccacatgtcaagggaggggcctcgtggaaggtgattggatcatgggggtggatctcccccttgctattcgcacgacagtgagtgagttctcacaagagctgatggtttaaaagtgtggcactttcccctccactctctcccctgccaccatgtaagatatgccttgcttcttcttcaccttccatcatgattgtaagtttcctgaggcctccccagccatgtggaactgtgaatcaattaaagctctattctttataaattacccagtctcaggtagttctttatagcagtgtgaaaatagactaatacagccctttttgatataatctttcaaaccctagctggaatcctgacactttcagagtcaacagaagaggaaactatataacttaaggagaatgaattaatctgtcccactcacattcatgtttattttatcaacctctagttcacaagtatatggt

SEQ ID NO: 153578 - DNA, 395 bp, Homo sapiens
tccggccccacagccaaagctgagctcggccccttcgccaagtctgtccctcccgccgcctgcccactgcaggacatggtgtcgccgcccacccggcctcgttctgctctcccccacccaacacggccatcgtctctccatctacaaaaggaagtaatcacaagccctacttcacagggcagctgtggggattaagcaatcagatacccagaaagcaatcaacacagccgccgggtgcagagaaagcacgaggtaaacatcagctgctgtgactgttgctgctgctgtccttatgatctctcatctctccaagccactctccaccatccagaagaatctttgaaaagtggaaatcaggtcgggagcagtggctcatgcctgtaaacccagcactt

SEQ ID NO: 153579 - DNA, 352 bp, Homo sapiens
acaaacaaacaaaccaaccaacaaaagaaacagcagatgaatggtctcaattctacaactacaaactcccagggctggatcagagctgaaatgccactgaggccagctgctgtggtgttgagtgccctccatgacctccctatcagtgcttccaccgaacagccttcaactgagctcctcctttcatggatatcctctgttgggaagattatcctaaaagggagctgacatatgtttccttgaaaaatcattcctcccaatcgctgcctctcaggtatgggaaattctcataagtcagctgctcatctccatgccaaatattgcccaggttttttttttttttttttttttt

SEQ ID NO: 153580 - DNA, 365 bp, Homo sapiens
ggtgaaaatcacagcactgtattacagacttgtcaactgctaagcttactgtaacacaataccctacaaaatataggaaacctacttttttgtattgccccagcaggtatgggctggctgagtgacagcaggagctggacatttgatctcctaaccctcttaggaaacagcaaatgcctttgctcttcagtttcccctacagggagattccagccatgcttcctgtaagacacacctgacatggtgggcgaaggaaaatgagagggtaggagacttctttacctgctcctttagggctctttgaagctcaagagtgtttttgttgttgttttcctttgagatggagtttcactcttgtcacccag

SEQ ID NO: 153581 - DNA, 141 bp, Homo sapiens
gtgcataagtatgtgtgtgtgcatgtatgtgtgtgtgtgactgtgtgtatgagtacatgtgtgagtgtgtgggtgtgtgtgtgcacgcctgcccatgtgcacagtcactggggtggcccggcctcacggctgctctacccc

SEQ ID NO: 153582 - DNA, 388 bp, Homo sapiens
agaggggcatcggctgggggtagaaaccaaaggatgttgctcagactgccaagcagctccagcggtcgctatgcacagccattctttggggatctcatcatggaaaagggtaaaaaagaacattgctgtgtcaaggctgcacagcaggaaactggagaaggtgaggtgacttgctcaaaaagacagacccaagtgtgggtgaacttggaagagaaccttggaattctggctccctggatcccagagaagtccgtgtgccctagacagtgtggtttcctattacataagcaactcttttattactcacactcgcttgctcctgcaagactcctacagcatctccccctagaaaacacagtggaagaaaagggttcttagttccagctga

SEQ ID NO: 153583 - DNA, 472 bp, Homo sapiens
tgtataggtccatcatgccttggagtagtgttatgcatgcacctaatacatgtgaagtaaagttttagttgattgtgcagttatctggctgtgggtggctcagtctactgaggaggagcttcagttaacagtttacttctgattccttgagggatgttgataaggaattagagaaaggcttccaaactttaaggaccacataattctctggggcctctgcttgtttctttgttttctggtgtgaaaatcttgtctttcccccaccctcagcacttcagcacacacccagctctgcctctgggacagtgctggtttcttcccttcctctttaccacccttctttctcgtccctctatttctttcctggccccacaggtgattccaaggaacacccacttaacaaatagggcttggggaatgtcaattaatttgccaaaacctggttcagtttcattcttaggtttcaacagac

SEQ ID NO: 153584 - DNA, 276 bp, Homo sapiens
  misc_feature (16)..(16): n is a, c, g, or t
  misc_feature (33)..(33): n is a, c, g, or t
  misc_feature (42)..(42): n is a, c, g, or t
  misc_feature (44)..(44): n is a, c, g, or t
gggaaggagaaagggngggggaggggaaagggnggccgcgcnantgcggtaatggtgtatgagagagcttagtgtggctcctgatgaagaacttcattgtctttggccaaattgacacattttgaagatacagcttccttctcggccataagatcatcaaactgcattaataaaataatagagcttgataatgaagtaggctgagaataatctaatacaaaaccaatagcaaattttgaaatgcatccacttgcaataaaatgttatctataatgt

SEQ ID NO: 153585 - DNA, 428 bp, Homo sapiens
atggtggagaaatctggcaacaccttggccaagggatcaaaatttgcatcacaataagggacagacggacgtcatatgactccatctcagagtatcacattgcggatgcagtattcctgccaagaatccataacatcttaatctaatcacaaggaaatttcagaccaacataaaatgaagaacatctccactgaacagagtaaaggggttagggaagggttgtgttctcaaaaatgccaatgtcataagagataaagacaggctgtgaaaatatcccaggaaaaaggaggccaaagagaaataataactgaatgcagaacctgaccccagactgtagtctatacaggaagcatagaaaatgctacaagagactttcttaggtcaactgacaaaactggaatatgggcgatagatttcatcgatgtcca

SEQ ID NO: 153586 - DNA, 1308 bp, Homo sapiens
tataaaatgggcatatgataacatctaagttttcaagagtcaaataagataatttatgaaaatgcattcttttaaagtgccatgttgtgggcacccaataaacgttaattccattaatatcatgattgtgactatttccagtctcacctccagctccacacccttgctcccaatcatgcagctgggagaaaattagtatttgattttttgataactggcaacctttgtctggtatgtttttgatttgccattaattaaagcatttgataactagaagatcatgttttccaatcaatccatgacgtgtttcctttagaaaaagagagactgaagagaaaatacactcaactcttttcagccttttagcaaagtcactactgtaaattggtccacttttttctttcaaagaaaatcaagctgctatcttcaaggccatcttctcacatgattactttctccagatagcttttcattttccagggtgcctcaaataaagagtgtgtgtgtgtgtgtgtgtgtgttcccacccactaaatctcctgcttggcagagattgtttatgatttctgtgaaagggtctttttgtccctttttgtctaagaagctttttcattacaagcctggaagtcaaggtaagtgccacagggattcgaagatctcttggcttttctccgatgttcacattatctcccagaaaaatgaagtcctacattccctgcaatcagttaatagaagtgacagctgtgagagcttcaaatctggccttaattaatgggcagtgcatacatgtgaccgatgcatatttgctgagaagaggctttaaatagcatcaaatgtttgtgagcaggaggccatgcgatggcaggaaatatctgacggtcttaatgggatcaggcttttgtgtgcaaacaatggcaaacaatggcagcaaaccacagcccagctgacagccattaagatggagtattcatttgtcatggtgggtaaaggctcttcaatagctgctaatcaaaatagagaaaaatgaatgtatggcacgatgcaactctaataagactgggtgtccaaatgagtgactccacataggtatgcgtaaggcgtacatggaatgaccttctctttgaacttgctgccaccgtggagcagcatatctcccttgagaacttcctcccttgacttccgaggagatcttactctctcatttctgaccgacctttctttaccttgttcttcccacccattccctcaatgagacagtcccccagccactgctctctgttcaaattccctgcgtgactgatgccctgg

SEQ ID NO: 153587 - DNA, 546 bp, Homo sapiens
tgtctgcaggctgaggaggaaggagagccagtccaagtcccaaaactgaagaacctggagtccaattttcaagggcaggaagcatccagcatgggacaaagatgtaggctgggaggctaggccagtctatctttttcatttttctgcctgctttattttcgctggcagctgattagatggtgtccactcagattaagggtgggtctgcctttccccagcccactgagtccaatgttaacctcctttggcaacaccctcacagacacacccaggatcaatactttgtaaccttcaatctaataaagttgacagtattaaccatcacacctgcctaagtaaagattaaatgagatgatcatcacaacgcatatttgttgctgttgttgtttaaaaaagtgaatggagggccaggtgtcgtgactcacacctgtaatcccagcactttgggaggccgaggcaggcagcccactcaaagtgagtagttcgagaccaacctggccaacatggtgaaaccttgtctctactaaaaatacaaaaattagtggg

SEQ ID NO: 153588 - DNA, 471 bp, Homo sapiens
ctgtagatgtttgatatttgtcagaacaggtgcccagcccttgggatactttgcttaagaataagagaatataaaaactattaatcacatatgttcccacaaggaaatacaaaaatattatatggttgtgccagaaggttgaaataaataaagctagtgaaaataagagccaagtcttgttgggcttcagcagagagcagtgtctctatgggagatagtgatctatatagaaaatgtaggtgagaattgttgttaggtgtgtttcaacaaagcttgtgaaaaattctgattggggtgggaaagagcaaaacaaaggagggtactttcttttccttagctaactctgtttagtcaactcttattactcagttgaagcaagaaataaaaatgccaagatgaactagagacacttactgcttttaaggaatttaaactctaaaagttaatgtagggaaaagttagatacatgtt

SEQ ID NO: 153589 - DNA, 242 bp, Homo sapiens
atgagttttttttgtagagatctttaacttctgtagttaaggttattcctacatattcttagtaggtattgtaaatggaattacataaaagctaaaagatttctttttcagattgtttgctcttggcatatagaaatgctactgatttttcctctcttcctatttgaataccctttatttctttctcttgcctgatttctccagccagaacttccaatagtatgttgaataggagtggggag

SEQ ID NO: 153590 - DNA, 362 bp, Homo sapiens
atacagtgattgtcaaactatgggtaaagggcactggataattgtaggttggttcgttggtttgttttaaggaatatttttatttttcaaagcactataaaacaaattttcttagaaggtctggaatatgaaaatcatagccatgaacatttgtatgcttacaaagctgccaaatgatgcatggctagtgagtctcagagtatttcactgatgctcaaatgctgcttgtccatttatttgccttctgtatgcattaggaaacagataagctataagtagtaccagcattttaaaatatggtagaaaagaggctgggccaggctcatgcctataatctcagcactttgcggggccaaggcgaa

SEQ ID NO: 153591 - DNA, 227 bp, Homo sapiens
tgtaagggggagattcggggacagggtatttggaacatctcacccttcaccctcacattccctccctcccttgagtgtccagagccgggctgaatgggtggcaattggagacttcacagtcatgtatgtttccaccccccagggcaccatcaaaagtaaattaacattttttccatttcccctttattgcaaacacgttgaatactgttgcacaaactccgtctctc

SEQ ID NO: 153592 - DNA, 235 bp, Homo sapiens
agatggcagagataaacaggcgttctatttcaaggggcctgttcaccaaattaaggagtttggattttaacctgaacacaatagggaactttgaagggttttggtgagtaaagatttcatgatgagatttgcattttaaaagatgactctggttgcactgtggagaataaattcaggaggtagggagcatggtaaaactagaggtaggtaaacaaattgagagacttgcagtgag

SEQ ID NO: 153593 - DNA, 220 bp, Homo sapiens
aaggaagtctttgatttctctcatcagtgtttttgatacttttcaacgtacaaatcttataatactttgttagattgatccctcagtatcacatgtttcttggtgctgtagtaactggtgctttttttttttttttttttgagatggagtcttgctctgttgccaggctggaaaatctcagctcactgcaacctccacttcccgggttcaagcaatcaag

SEQ ID NO: 153594 - DNA, 562 bp, Homo sapiens
cagtttacagcgtcagggcagtttacagcgtcagggacttcctttctcaaaaacttacggtggttctatgattgtggaagaatgagatcccatctggtattgaagcttttatcattttctttaggtttcaagatctgctctcctgagacaactttctttgggcagccaagatgggtacttttctgcctcttttcttagctcatctccgatcttccatcatgacatctgtacctctcttctccaccaacccccactattctctgatccttcttagatcccaagattaattttttttaactcaacatatactcagttttcttttgctgtgtcaattctaagatttatcatagtttatgttgagaaatattcatgtatttatttggagtacaaagaaattatgtattttttcttttctttctttttcttttttttttttttttgagacggagtcttgctctgtcgcccaggctggagtgcagtggcccgatctcctctcactgtaagctccgcctcccggattcacaccattctgcttcagcctctacgagtagctgggactgca

SEQ ID NO: 153595 - DNA, 320 bp, Homo sapiens
aaacagtcagggagactcattctgatgaaatggtatctacagtgtatatacttcccttcctgggaaaagaaggaggtgaaaaaggaaatcagttccctagacgcagatgaagaaattgcaggtgtggaatggacacaatagtagtgctgataacagggggctcacagcgtgactagccctgtcccagctccttactgctttgtctcactctaacctcacaaaacccattattcctattttgcatagcaggagaccaaggtcagagaggttaatgaacagctaggaatcggccagccggggctggagccccatccacctgg

SEQ ID NO: 153596 - DNA, 125 bp, Homo sapiens
gtgattctagaggtatcctggatagatcaggaaggcgcgtcctcattcacaggattatggagtattgcaacactgcctcaatggaaaagttgggactggagtcctacaaaagatttctttttttc

SEQ ID NO: 153597 - DNA, 425 bp, Homo sapiens
ctgagacgtgcggagcaagaagtgagggcagaagtcgcccatacgggtcctgttggagcacagcctctgtctacacagggtgtccttggcacagggaagctgggagggtctggggtgtggtggatgaggccttgctgtgtttcctttagtgtctttctagtttggggctgtaggtgtgcattacctactgaaaaataaaagcagtcattaagaaatctcccccaaagtgctaagaccatctcccccttggcacagcactgccagaggcgagtgtggggctacttagggggacccaaggaagaggttctgccctctttcattggcctccccctggtttggggtatggaggacaagttgacctggggcccaactctgagaagatgtgctcacaccatgtcctgttttcttctccagaggaggcgacc

SEQ ID NO: 153598 - DNA, 465 bp, Homo sapiens
ccatgagtacttttgctaccccaccctacattagactcttgctgtcaaaagcaaatgggctggaccatggatttttcatgtaaatgttatgcaggttaatatttgaatggcttggacagaaagagcattctccctgctctgtgctatcggcatgtgttagattcattgacttgagccaatcttctacatgtaagtgaatctctcatctgaactttctttttcttattctttattttccttgattttaaattatatctagtagattatctttctcatgatctgtccaggtgtcacagttggtgcgtgctggttatgttctgctgtgggcctggtttgctggtttaaatagaggtggctttagaagctagaagaaaagagcccaaatgtggaaagtttttgccccaaccccttgagggtttcatctccagctttcatgaactgttgtcctaaatttgaaaccagatc

SEQ ID NO: 153599 - DNA, 710 bp, Homo sapiens
gcctaatagaattaagggaaaaactgccctgatgaagtataatatctggagccgctgtgattcttttatacagaaagaccagaatacaatttttagaaaaaaatactagatatgcaaagaagcaagaatgtatggttgataataaggcaaagtgcagacaataggagtagatttacagataatagagatattatactcagtggacaaggactttaagataactacaattaatatattcacaaaaataagggaaaagatgaagaaagtagatgaaaaaagtaccttttcaccagagaactaaaaactactttaaaaatcagataagcattctagaacttaaaagtacagtaatgaaaactcattgaatgggtttaataacagattgaacagagcacagcccagaattggtgaactagaaaaatatacagacagaaccacagagaaaataagggagtgtggggattgataagagcataagaaacgtgatggaaaaactccaaagatctaacatacatataattagggtctgggagatagagaagtaacagaatcgggcagaagtgatatttgaagaaatgggctagaatgttccaaaatggatgaaaggtagcctacagattctagaagctcagcagaccccaagcagaataggtacaatgaaaagcacatctaggaaaattaaaagcttaagagccaggaggaaaaatatt

SEQ ID NO: 153600 - DNA, 922 bp, Homo sapiens
agcaaaatacagggcaatggccaacaaaagaaacaatttatttcagcggccactgggtggcagacggaattcgttataggcactctcccaaggcggcatgtttcctaaatgtatagcggttacacccacatttgagattttttcctctacacgttagtacacttgaggtttatgtaagtgatttcatgttcaaaagtttattttcctctctctcttttttctttaggaagttgaagatattcatatagattttatttatttaaaaatggaaattgtcgatctccataaagacttaagatttaattctgtatttcaacgcaattttccccccatatgtgattgagtaaaggattttgaaagatatcccatgacaacgtaataaagcttaaaacaagatctgaccgaaaaggaatagggattccacccagggaccctaaatttgataacctttgtgttagcggacattcctcttcctccatgcctcaggccccagtttattttctaccataaaatcatgctctcaatgaagtaattgatatgaatcatttaatttatagcataaatttaagtcatttggttgtttcaactagaaggatttgcattttatcccttgtcctctattaaagaagaatttcacataccctgggagccttaccctcaccctaaaaactacaccaacctggttaaaggcaaccttggccctaatgtacaccccgcgaagatcaccaaataaaactatgtccctaaggaccattagccttaagcttagagagcttgaagtttacacaaccaataacaataattttatttgccccaatcttttatatgataagaatgatagaaacatttggaatttgtagatttggtagtaactggatgaatgggttctcctgttgataaatgccattgtttcccatttaat

SEQ ID NO: 153601 - DNA, 488 bp, Homo sapiens
cccaagatagatttgagtatcatctgccccacaccagccctgtgaccttgaccaaattcatttgatctccttgagcctcagattctttatctgtgaaatctgggaatacttacctaggagggtgggtgtaaaaatgaaatgagataatgaatccaaatgcaagaaaatggccaatgtagtcagttctcaatgccctcctctggcaaacggggaagggagcaggctcagtggtgagggacgggcgtggtgtcaaattcctgttctggagggaaagaagggtgcctagtgttgtttgctctggagaatgagcattttaggtggctagtccgtctactggaaggaagggaatactgaatggacaggtttgcagagccccaagcagtacgactagggcctgaacaggtgcagttatgggaggcaaagtgttgttcaatagaataaagtggtttttttgccttaaaaaatggcgacacatatacacacacaca

SEQ ID NO: 153602 - DNA, 468 bp, Homo sapiens
acacacacctactaggtaagccacaacagttaataaagtttttggagttaggtaagaattgaaaccctagcactgccgctagttggttggataactctgggagagccatttcccttcaacaagcctccatttcttctcctgtaaaatgggaacagtaaataccatctctggagggcattgggatgttataaagagtcagtggcacttgaggccagcagtttgagaccagcctgggcaacatagcaaaaccccatctctacaaaatatttttaaaaattagttgaacattgtgatacatgcctgtagtcccagctacttttaggttgaggcaggaggattgcttaagcccaggagttcaaggttacagtaagcaatgacagtgccactgtactccaacctgggtgacagagcaagactctatcttaaaaaaaataaaaatcccaaaataaaaagcgtcagtgggacagt

SEQ ID NO: 153603 - DNA, 488 bp, Homo sapiens
ttttaatctgtgtccttttactgtaataactgtaactgtgagtctaacagcttctctgagccttgtgagttctagtcaatcattgaggccgaaggtggtcttggggattcccaacacagtgtctttattagacaccttcaaaaaacaaccggttagcaaaggaggcagcatgctattgtggagatacccaatctctctgagaatgagcagtcacatccgtaaattagcagttaataatttttagtaaaaataacacccattatgggtctttcagggtgatctcataacccatccctggctagaatcatagtgattgattcaaggatgattatgagccaatgggcattggcctgaggactttagctatgactcctgggagaggcacctttttttcctggggtggctgagctggtagatctaggctcaaggatgccggcagccatctctgtcaccctacaggcagagccttcctgacagtgcacacagat

SEQ ID NO: 153604 - DNA, 670 bp, Homo sapiens
ggaagaaaatggaagattatcacaaaacgcaaaatagagtgtttcaaggagggcaaacaaaggtcaactaggcctaatcgtgctgaaaggtcaagatttcctggtcaaattgactggtaaagaagaaatggagtggtggagggcagcttttgaatatatgtgagactaggaaaaaagttaacctagaatctaaaaagttgttataattttttaaaaatcagtataaagatactttaaaatttttcaaccttgtgtagtttctcttaatgagccaataaagcatgttcttaccatgacattttcaaccttaacaaaagtgagacggcaaaaaccaaccaccaaagttctaatactgcagcatcagaacaggtcatgcttaacagcttcatatttttaaattaaactttctcttttatcgaattttttaaatcgagatggggactatgttgcctaggttggtcttgaactcctgagctcaagtgatcctcctatcttggcctcccaaagtgatgcgattacaggtgtgaaattaaactttctaaacaagaaataaaatttacatgttttgtatttctgaagctaatgctgcaaaagctgatctaaattattaaaaaattaaaatggttttcctaaaatttccacataagtttcaaaagaaaaaataaataaa

SEQ ID NO: 153605 - DNA, 520 bp, Homo sapiens
agtgggagctaaacattgagtacacatggacacaaagaagggaacaatagacactggggcctccttgaggacggagggtgggaggaggatgaggataaaaaaactacctattgggtactacgcttattaactaggtgacgaaataatctgtataccaaaccccgggacatgtaattcacctatataacaaacctgcacatgtatccctgaaactaaaataaaagtaaacacaaacaaaaaattgccacacgttacattcccgcttagtgaaattgaacatctagaaatgtgggatcctttctcaaatgtctggctgactcattctgttattctcaccccctaaaaggatgcagtttatttccaggatcctgatttcctatttctgttgatcttttattaaagctaatatttgtgtgtccttatgttttgagctgcctttaatccttttttggaaagttgtagaatagatactaaaaacaaaaaagtaaaatgggaacataaatttaaccagttcccataa

SEQ ID NO: 153606 - DNA, 337 bp, Homo sapiens
gactgaatggcaggttgtggcctggaaaaagaggcctcgaatgatggaattagaaaacttagtgtttaaaatgtatggtgaaggtgtgttcagtatataaatccaatctgtaagtgatatggaaagtggaagtttattcaatgccttatcacatattcaaatgaacgtatggctgctctaccacttaaaaatagctctgttcattaaaggaaatgtaacctagattttcagaaaattaaaatacaatgttcttaagtcagtttaaactttaactgagattcatagtttggttctgccttcctaagcatttggactaaggcagagagtataaatctga

SEQ ID NO: 153607 - DNA, 179 bp, Homo sapiens
tttgcaaatcagtcaatgtaatctaacagaccaacaagctaagaagaaaaaccagatgatcatgtcaaatgatgcagtaagagcacgtgaaaaaaagtaagatttattcatgtcaaaaactcagaaccaattagcaatagtgaggaataacttcaacttgattaaaaaaaaaaatcctt

SEQ ID NO: 153608 - DNA, 475 bp, Homo sapiens
tgaggtgcagggtgggggttaggagatgggaaattattatgaaaaaacaccaggggtaaaggggatttgcattaaaaccttacaagattcttgccaaagacaggctgaggtaatcagatatcacctgatggatggtgaaggatgaggaacctgatcagatatcaagggtgatcaggtatcaagagaagggggcttaggctgggcgcggtggctcactcctgtaatcccagcactttgggaggccgaggcaggaggaatgcttgagcccaggagttggaggccagtctgggcaacatggtgaaaccctgtctctacaaaaaatacaaaaattagccaggtatggtgtgccactcctgtggccccagctacttgggaggctgaggtgagaggattgcttgagtccaggagattgaggcttcagggagccatgatcacgccactgcactccagcctgagcaacacagaaaaactctgt

SEQ ID NO: 153609 - DNA, 234 bp, Homo sapiens
tgctgggattacaggtgtgagccactgcgcccggcctctaaagggtgatttttttttcttttttaaaggtggcggtgtaaagtacttactgtgtggttgttggttgtttgaagtggagtctctctgtgttgcccatatgggtcttgcactcctgggctcaagtgatcttccagcttcagcctcccaaatgtgtggttcttaatagaagtgtaaacctttggaaggatgtcatta

SEQ ID NO: 153610 - DNA, 387 bp, Homo sapiens
tgaaatacgtagaataaacagttgattataccagcaagctatccatttggtagatttttttcatagctaatttttaatttcatgttgacttttcggtacctatcatgtttccttcttcactttactctcagatagtagctactcagaaaatttattcaaaaacagaagttatctactgttttggactgtctcttttttagggaattggaatttacatgcattaggatgcttctaaaaattaatactctcctttctcctcttttcataaaaatggttatttttaacttgaaaatccagcaaaagaaaagcattttctatgaagttaatttcttttcccccccatctccagtcctcccactaaaaataaaacaaaaaaataaaaacaat

SEQ ID NO: 153611 - DNA, 324 bp, Homo sapiens
accctcttctgttccctcttctggacacgcccttcccttctatgctgaagcacagccccctcccccctcgccctttgccagacagccccacgccagagggtcccggcacgcccaccctgcacacacaacacccaccagactggcacagggacaggtgcggggactgcccagcccttccggctgcctgctgcttctgagctcagccctgctggggaggggagggccgcacacagccccgcctccagagggccgaggctggccacaggccacggaggtcacgtttatctgctcgcagagcaaggccacggctaatcggagcggccg

SEQ ID NO: 153612 - DNA, 310 bp, Homo sapiens
aggatactgtgctgtggggactctgctctcaggtggatgctgctctcaggggaccctgttctgaagagatgctgttcgcagggggatgctctgagaggaccttgttttgaggagaccctattcagagggggaccctgttctgggtgctcactaccctgagggaactcttatgtgaggggaatgttattctgggggggacactaccctgagcggatctcgttctaagtggggaatagtgtcatgggggaacatgttctgaggaggatgctgttctgaaggggaccctgttctgtgggggattctgctctga

SEQ ID NO: 153613 - DNA, 654 bp, Homo sapiens
  misc_feature (62)..(62): n is a, c, g, or t
  misc_feature (68)..(69): n is a, c, g, or t
  misc_feature (71)..(71): n is a, c, g, or t
  misc_feature (73)..(74): n is a, c, g, or t
  misc_feature (81)..(82): n is a, c, g, or t
  misc_feature (84)..(84): n is a, c, g, or t
  misc_feature (92)..(92): n is a, c, g, or t
cggtcctgaatacaagatgcaaatttatgcaacatagtgcaaatcactcatgtctcaaatgncatgannanannctggtgnntngagataanaaagcccctgccagcatcatctctcctaattatcgaatttcctttttgtgccatagaagtttggtttggattttctttcatttgacccagaaggagtcctaactcttggagaatgggatttgacttgtgtattttaaaaatgggcaagatattgatatgcccagggaaatgatagggtattctgggcaagcagagctgctttaatgaaggtccagagataagaatgagcatggtatatttggggaatctgagaaaatcagcctgaatgaagtaaattgggaataagtaaattaggtgggttataaaggaagaggtcagtttgggagtttgtttaaactagataagagtcgaggcttgattaaaaggaaacaaagagtttctaaaattaaaataaagaaaaactacatctgtttaaaggcaaaattttaaaagtctgttgcattaatctgctcaggctgccatgacaaaaatctcacagactgggtggcttaaacaagagacatttattttctcacacttctggaggctagaagtccaagatcaaggttctggcaaattcggg

SEQ ID NO: 153614 - DNA, 516 bp, Homo sapiens
ttacccatgaatgcttttgtgagaggagagaggcctctgtacttcaatattttccccctggacagaaacttggagtggagaagggaggaaatgtctctgtcattttattgtttttagcttcctagttatttaagaagtttcttcttctaccttataagcttcaaacctaagaacaaaaaagcaatttttccacaatattattcattgctatttccaaacaaaaaatatattattaaagcaactcaggatggaaagacatctccagaaatggtgcctgattcaatggatattttacctgaaacctagtaggtttgacagttagtaggggaagctataagggagagaaacagacaaataaaattctctctatatatgcctcgtctgtatcactgagattccctacacactaattttacattatttgtatatgcctatacaatgttgtccatgttgagtcaaaacaatacatctagaataatcctttgctagggcatattttcttaatatgacactctt

SEQ ID NO: 153615 - DNA, 160 bp, Homo sapiens
tttccacgtgacacttgttttcttggaatcctaggaaattaatatctcctttcttccctttccttattattctattttttctcctacccctctcttaatgacaaggccttacctaataattgaagacagtattgttgagacaggtataggggttgaggag

SEQ ID NO: 153616 - DNA, 471 bp, Homo sapiens
tgtgtagggacccaccccccagggagtatgggacgttccactcatgcccttgacagccccaagcatccagccatccttccctttagcagaggaagaatcagaaatccaggcgctcgagagatttttccgaggtcacatggcagcaggcctctccttcagaacccacgctgcttccaggaaacgagggccgggggcctcggcagataccgttggagtccccctttggggacccgggccactgactctccgttgctggaaggaagcctcgtctttccttgtcccctcaaacatttacttcccttgtgaaaaaccaagtgtttcggtcagtttgggactgtttacctgtgtggttgaagggcttcgaaaagaccaggaaattcaagggaagctgtcaaagagaagagttagaaccgctgcgtcctgtcccccgtcagtcagcaccgagcctttctctgtcccactgcagaaaaa

SEQ ID NO: 153617 - DNA, 329 bp, Homo sapiens
cagattctttaacggtgggaaatccaaactaaagacgaccaaatatatctctcagtagttaaagaaagagagtcttcttgggctatatatgaccctttctaaagaaatctgttcctttcaagatctattctttctttctttttttttaaagacagagtctcactgtgtcacccaggctagagatggggtttcactgtgttggccaggctggtctcaaactcctgacctcaagtgatccatctgcctcagcctcccaaggtgctgggattacaggcgtgagccaccatgcctggcaagatctattatttctatattaggatatgttctat

SEQ ID NO: 153618 - DNA, 597 bp, Homo sapiens
aattggctatagtctctctccatgcttcaagaattccaaactttgaaaaaacctttccaagtgatttgccatgaaaggcactgctggtagtgttcctggaccaaaccaagggtctggctgcttactttcatggcccaataataagatgcagatgaactgggaaagaagagagtttatttctgtaaccgggtacagggaaaaggttaggaaaatatcaccaaaccaacccaaaattgcaaagttttctagagcttatataccttctaagttatatatgtctgcgtgtaagtgtgcattcatctaaatacataagtgattaatttctagtctataactaaggtctgaatcatgaagaccttattctagagcctcagtaaatttacttaatctaaatgggtccaggtgtcaggcgtgattacccttatcttgtctcctgttaaatcatggaggtttgggagatccttcagacccccaacaaaacttgtttaatctggccgggcacggtggctcaccatcttaagcttgtgcttggacaagctgtcctatccatgcggaccagccatcccaattctgcagaaatgacgcctaccatctcat

SEQ ID NO: 153619 - DNA, 608 bp, Homo sapiens
aatatgtatgtatttgcatgcccaccacgcacaaaatatgtgtgaatgtttgccctatgctacactgaggcccagtctcatgtgacattggctttaaagtttaaggccaagcgatcaacctacctaagtaattttagttaatctgattcttaaaatatttgttttagataaaatggaggatactccatctaaagatttcacacactcagagataacaaagtattccaactttgcttcagagaacatgtctaccttcatttcattataaataactttcaactgcgagacacacaagaggtaccaggacatgagtcttctacatgggttcccatcttttagatttttttcccctagaaagccagcttttaaatgccatcacatgtgcacagcttgctttaatatttctcagaagctcagatcacatgggagggcgcttcagcctgtcacaaggctgcaatgtgacaagctgagctggatggaggctctcacataaagcctagtcaacaggggcctctgaaatcagcttctatttatatctcaaagcctgccaactcctacacaaccccaagaactaaggatgcagcgttcatatatctaacataagaaaa

SEQ ID NO: 153620 - DNA, 792 bp, Homo sapiens
gagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcctgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacgtagacacacatgtacacacagacataggcacacgcagacaggtaggcacacaacagacatagacacacatgcatacacatagtaacacacacagacacatagacacacagacaac

SEQ ID NO: 153621 - DNA, 784 bp, Homo sapiens
gagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcctgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacgtagacacacatgtacacacagacataggcacacgcagacaggtaggcacacaacagacatagacacacatgcatacaggcttggtggggaatcactagtgaattcgc

SEQ ID NO: 153622 - DNA, 397 bp, Homo sapiens
actatccaacctgcctgcaacaaataccaatgctgagaccctgatgaggctgtgaagaccaactggtcgcttgatagcaaattcactatggtaggctcattctttcctagaagcaccagcagtttattcacacaaggacagacttcctattctaggtatgtggttcctttcgggcctacagggtcctgaacacaatctaaggacttacaaaacatctgaactgtcagcgtagatttgctgaatacgtgatctatacatgttaacacccaatcagggagagttcgccagcggtcataggatccactgctcctatcacatactgcgccacctagaagctgctagactgatggaatgttggcatggcctgctttagtgccaggtgggagacaataccctg

SEQ ID NO: 153623 - DNA, 329 bp, Homo sapiens
cagaaggaatgctattaaacacatgcagtgatgtgccttgaatgtgagttatagttgaagagctttagactcacactgtttctgtgaagacaaaatgaaaacaggccaaccaaactgcaaaagccagttgcagaaatcttcaaagactgataagaaatcatcctgtttcaaatgaattgctgtcaactttagaaagagccaagagaaaaaatatgaaacggcgcaggcgtcgagacattttacgagtacaactggtacgaatatttgaactgctggcagatgctggtgtcattagtcacaggtcagtattggattcacattgttaaaac

SEQ ID NO: 153624 - DNA, 749 bp, Homo sapiens
  misc_feature (19)..(19): n is a, c, g, or t
  misc_feature (46)..(46): n is a, c, g, or t
  misc_feature (106)..(106): n is a, c, g, or t
  misc_feature (117)..(117): n is a, c, g, or t
cgctaccccagatagcggnctagcatggctaaattattggctcccntcccttcatccttgaagcacatagttccatgatgcgttctgagagctggaaatcacagantccttgttctnggtcttggccggaccaacccaggagcagggaactaatagaggaattacatcccataattaaagagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggtaattatga

SEQ ID NO: 153625 - DNA, 592 bp, Homo sapiens
ccgtgaatcgcgggcagtagctgttccagaggtagcccctagatgaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggtaattatga

SEQ ID NO: 153626 - DNA, 238 bp, Homo sapiens
tatttttatgccttttgttcatgctgcctcaaacaccctttgcaatggattttgaaaaggacagtttgaaactctgtggctggtttgtagttaatgggaacacctttcctggcccacattttgcccttatcttccttctttacagttggtgagaatcaactgtgctgaaactgtaatgcatttttaatacaatattaatattatttcaatctaagtgattaattaactcagcaaggcc

SEQ ID NO: 153627 - DNA, 197 bp, Homo sapiens
gaacttgttctggggtgaattttggccaaaaccaagcaagagattaaagtctcgaatgaacacagaaagactagaaaggcaatatattgggaaaagattttgttgtagttctgccttacagtcacataatgaaaaggaccagatattggctaggtcatattatctatataagagagtataataccatgttgcttttt

SEQ ID NO: 153628 - DNA, 387 bp, Homo sapiens
taaagatgtacatgagagatggtttaagaaaaacaaaaatttgtgtttatggattgtgtgaaaagctttaaaaggaaaaaaaaaaaagttgtataaggagaagcaactgaccaggaagtaaaaagcaggcaaagaaggtgtctagcccgaggccgggcaggatgacacaatctctcagatttccaaccgcttcatgaagaagccattaagcaccggaggaagcaagaaaaacacaaggaaaagaaaggcatctgagaaaaacaacaagggcccaaaatgaaacccatcaaagacaaaatttcaccagaggacattagagactggggtaaatatggaaaacttagacattcattccacagtgggtggtggctttgtgtgaccatctgg

SEQ ID NO: 153629 - DNA, 408 bp, Homo sapiens
cacggtgcgcttgcattcctcagcccttgggtggtcgaatgggactgggcgccgtggagcagggggtggtgctcgtcgaggaggctcgggccgcacaggagcccttggagtgggtgggaggcttagggctggccggctgctccgagtgcggggcccgccaagcccacgcccacccggccttggccagcccagaaaggggctcccacagtgcagcggagggctgaagggctcctcaagtgccgccaaagtaggagcccaggcagaggaggcggggagagcaagcgagggctgtgaggactgccagcacgctgtcacctctcggttttactttattttaggataaaatatctattgtgaattttaaaaacatgtaaaataaaattttaattaaaaagcctaaaaaatctt

SEQ ID NO: 153630 - DNA, 501 bp, Homo sapiens
cgcgggaaggcagctaaggctcggtgagaaatcgagcgcagcgctggtgggctggcactgctgggggacccagtacaccctccgcagctgctggcccgggtgctaagtccctcattgccaggggccagcagggctggccggctgctccgagtgcggggcccgccaagcccacgcccacccggaactccagctggccggcaagcgcggcacacagccccggttcccgctcgcgcctctccctccacacctccccgcaagctgaaggagagggctccggccttggccagcccagaaaggggctcccacagtgcagcggagggctgaagggctcctcaagtgccgccaaagtaggagcccaggcagaggaggcggggagagcaagcgagggctgtgaggactgccagcacgctgtcacctctcggttttactttattttaggataaaatatctattgtgaattttaaaaacatgtaaaataaaattttaattaaaaagcctaaa

SEQ ID NO: 153631 - DNA, 503 bp, Homo sapiens
cacggtgcgcttgcattcctcagcccttgggtggtcgaatgggactgggcgccgtggagcagggggtggtgctcgtcgaggaggctcgggccgcacaggagcccttggagtgggtgggaggcttagggctggccggctgctccgagtgcggggcccgccaagcccacgcccacccggaactccagctggccggcaagcgcggcacacagccccggttcccgctcgcgcctctccctccacacctccccgcaagctgaaggagagggctccggccttggccagcccagaaaggggctcccacagtgcagcggagggctgaagggctcctcaagtgccgccaaagtaggagcccaggcagaggaggcggggagagcaagcgagggctgtgaggactgccagcacgctgtcacctctcggttttactttattttaggataaaatatctattgtgaattttaaaaacatgtaaaataaaattttaattaaaaagcctaaaaaatctt

SEQ ID NO: 153632 - DNA, 266 bp, Homo sapiens
acagtgaactctaaaactcacagactggagtagtaattctcaaccatcgtcagtgggggaggggagctgttgaaagtccagatgccctcaccagactccacaccaattaagtcctaatctctgaggctgagcccaagtacaggcagtgtttaaagttcagagggattccccaaccagccaaggctgagaaccactgaggttaatgcaaagggatgctacttattaaaaaaacacacgtgacctggagaatttcctctatcaagaga

SEQ ID NO: 153633 - DNA, 509 bp, Homo sapiens
ttggggaggcacagtgtcaacaggaaatatctgccagcgacacagaaaaggcttcaggaaagataacaggaggagaggccagatcccgtcgttgccttgcactatgcagatcgaggaagtggggagtgattctgccttgtacagagcgtgtggattcacacaaagttctcttctgtcctggcaggaaacagatcaaccctcggttggggaaggtggaggcttgcttttctctgatcacacactcttgcaaaccttaaagcagtttccattaaacatattttatttcttccaaattaaggatgacaatgtgaaccgtgaatggcattattcaccgtgggaagctgttttccttcaccctcgggatgtttatgtatgcaccttcattttccttggcgtttggatgtgatttcttatgaaagacttggaaatctgcaaaaactcacgagttacaaacctaccggtactcagaactctcctgcattttctaagtggtcagttcctttattgta

SEQ ID NO: 153634 - DNA, 539 bp, Homo sapiens
tctttctctttactggcttgtctgcaaggagtccacatacttttacgtgtgtacacgtgtacacatcttgcttctccaaggcagccatttctggttccttccattttcaaacttcttcccatagccagggctatggactaccaagtcctgtataatattttggcattattattgcacttttgttttctgggagtaattttggctgtacttcctctagttcctctgttactctctactttttgtgtgtagtcttttaataagactccttttatttacttttcatacttataagcttatagcagctggaaggctacaggaaatctgttggaattttttctttttatctctacttagaggtaatttgaaagttgcagtgttttttgtttccttgtatgctgaagatctaggtcctgtgtggctttgttttccttgttgattatattttggggagttgaagaaaatagagggagagaaaagattcataatcaaatgcctgctgtgcttaatccttaagtcctgagaatatattttcaaattat

SEQ ID NO: 153635 - DNA, 280 bp, Homo sapiens
tgtccatcagtgttggctcagacactcacacaaacccacctgtattctttcacgccgtaaatcctctttggaaaaaggcgacattcaataaataaacatcaattgattggtctgctatttctttgtgtgacagtcataaaccagaactggccagcaacgtcctcatggacccaggcccagctgtaactgcccatgtgcttatgtgaccagctgtgaggactgcaggcagcctgcctcccggctcctctctcccgtgcatgctcttcatgacgcacttctt

SEQ ID NO: 153636 - DNA, 572 bp, Homo sapiens
acccaggctgcagtgcaatggtgtaatctcagctcactgcaacctccaactcctgggttcaggcgattctcctgctccagtttcccgagtagctgggattacaggcacacaccaccacacccagctgatttttgtaattttagtagagacgggggtttcaccatgttggccagcctggtctcgaactcctgacttcaggtgatcttcccgtctcggcctcccaaagttgtgggactactggcctgagctaccgtgcccacccacctctttttctttatagattacccagtctcggatatgtctttatcagcagcgtgaagatggactaatacagtacacaatttaatcaaaaggcactcccaggaagcacaagcaagaatgaagggagaacgagagaatgaagagagaatagtcaacgaagggtccatttagtgagtggattgtcactgtggacgatctgagctcagtcatgctgggagccctttgagagactatggagcatacctcagaattgtcccgctagagggcaggagggtggagataccagtgcactgcacagtccctccttggtt

SEQ ID NO: 153637 - DNA, 537 bp, Homo sapiens
tccgttgaggctgcagtgcagtgatgttggttcgctgtagcctcgcctcctgagtagctgggattacaggcacacaccaccacacccagctgatttttgtaattttagtagagacgggggtttcaccatgttggccagcctggtctcgaactcctgacttcaggtgatcttcccgtctcggcctcccaaagttgtgggactactggcctgagctaccgtgcccacccacctctttttctttatagattacccagtctcggatatgtctttatcagcagcgtgaagatggactaatacagtacacaatttaatcaaaaggcactcccaggaagcacaagcaagaatgaagggagaacgagagaatgaagagagaatagtcaacgaagggtccatttagtgagtggattgtcactgtggacgatctgagctcagtcatgctgggagccctttgagagactatggagcatacctcagaattgtcccgctagagggcaggagggtggagataccagtgcactgcacagtccctccttggtt

SEQ ID NO: 153638 - DNA, 642 bp, Homo sapiens
aaattttctacttatatgacagtatgctatttttccttaactttgggtaaataattttatggtgtgattaaaccgatctgacattttgaaaaagggcatgttttttaatgaaatataaaagagttgtaattttagttattcactgttgcacaaacctacttttttggcttcatttgcaaaaggttgttggataacctttatcttttaccactaacttcttactctgatccaaaatatttggcttttaaaattctccttatttcattatttgtcttcatatttaaaatatcttctgtgatatttcacttctaattttttaatatttttacataaaaagagatgaatactgatatccctgatttttaagagaggattttaatttggaaataaacatgcgataatatgattttaaaatgctaaagtggagctctagcaattcaactgaaaatagcattatgaataaactatactgtggcaactctttaacataataaaggaggacatcaacagagcagaaaattgatgaattttggaatatatgaagcatgttgtatcaaattgccagagaaagtaatgatcttctgttactgaacttaggtcacaaagcctactgcctgctaatcggcaagtggacctgtttct

SEQ ID NO: 153639 - DNA, 542 bp, Homo sapiens
tcccttttctccactaccttgccggcatctgttattttttgactttaataacagccattctgactggtgtaagatggtacctcattgtggttttgatttacatttctctaatgatcagtggtattgggcttttactcatatgcttattggctacacgtatgtcttctttgaaaagtgtctgttcacgtctctttttaatggggttgtttggttttttccttgtagtttaagttcttactgatttttcataataggaaatgttcttagtataggttttattttgttttaaataaaatcctattaactctattaactgtttgggaaggcaggtacgagggaaatcaaactagatacagcctaaaagccaaaattttggcatcaaatattatttgaagataacttagaagttagcataaacattctataaataaaaatagaagatagaaatcagtgtataaaatacaatttacacaccattattaaaatatatcttgtgtaaagtgagacgcccatctgttcggatttgctgtaaggttaccaag

SEQ ID NO: 153640 - DNA, 494 bp, Homo sapiens
gtcatgacacctgtgctcacggcacagaggaggagacaggatagtagcagagctgtgtttacatgtgttgcggctttgcctgaatatagggagtctgggaaactgtctagtttagctagtagttagtgatattacacttatgataaagtaaaacaagagggcagggattggagttaggtattaggtgagcctactgtagatctacctctgtatagtatgcagtggcatttccccatatacctaaacctaattcattgtgatgaatttaaaaggtgaaaatgtaactaatgtatgtgatatagttccctgagaagtgcattaagctctctttgttcagtctttgtgggaagtgatggaaaacttttttttttttttgccaaaagatactcgaacttagaaactaggcagttactttcacataaactctttgaggtataggtagtgttatccctaacgttacaaattaggaaactaagacagagatgttaagcagt

SEQ ID NO: 153641 - DNA, 141 bp, Homo sapiens
gcatttgtctttgacggtgccctggatagtggctgaagctctgaacacttaagaactaaagaacattaggggaaaggaatatcatattaggagacaggactgtgcagctgggagcagtggctcatgcctgtagtactaaca

SEQ ID NO: 153642 - DNA, 313 bp, Homo sapiens
tgtgagcacctgaggaggagaagcccctggaatagggggaggggccacaacactccaagcctcccccatggactccatatcaggggttagactggatgactcaaaatggaccattttatacactcttcccatcttctgtgggtacaagaatggccttggaggaagccctgttggggcttagaccatattccctatcccttccagcatgatgctggtgggtaataccctgggtatcagaaatggggagcagttgattattattctcactgaggtgaaagtgcaggatctcccagaggaggtcaacattctccaa

SEQ ID NO: 153643 - DNA, 350 bp, Homo sapiens
tacaggaactcaatctatttcctacctttataccttaaccgaccaaccttcaaggaaaagtggcagtaaaggtcacaggtgttgataccaggtgtcacactaaaagagataagcccacttctgcaggtctatagggctctcattaagtggaataagaaggattcagcatactgtgaaaacagcataaaaggagctatgacaaagtacaatttatatcatgtacattgtagaagatgaacaagtatatgaatgaaaattcagtacataaagtaaattactacctgacttctccatcatttaaaatacctggtgagtttcttataggtggtagttaactacagcatgttaaa

SEQ ID NO: 153644 - DNA, 639 bp, Homo sapiens
cccactttgtaagcacgaatatttaccaggtttcaaaccagcaaaaaatcaagaatgataacttattattcaatgccaaatgctatgatatataggacccactgaaatcctctaatagattatgaatttgccgaatcacttgctgttcagtattctataaaatagtatccatcaagagcataagattgaaatttaagactacagttctactttgttcaaagaagcgaaaaatactccatttccccccaagtaaatcagctaaaaattacacatctaaattaaagctgtctcctttaaatgtcactgatctggatagtggtggaactacttggactcaatactacattccactatcctaaagaacaaaaatctcattattttgaaggaggactggatatttacaaaaacaatagcaaaatatcattcaccccaactctactaatgttacgagttttaaaaaagtggagtcaaaaatcatttgaagtcaaaaattacctcaacctccagttgagacagcagagagatctttctaaccccttctctccaaagtcacaccaacatagagaaaacaagaaatataaacttttcctccatttcaatgaatagacattgcaactgtaaccacagtagatgaaaaca

SEQ ID NO: 153645 - DNA, 532 bp, Homo sapiens
agtacgtacagtatcaaacagtctccctccttttctctgtgattttggtctttctccttagagaatgtcctccctccaactccaaaagacattgcctctgtggtatagttacagtccttaaatatatgtcttgggtgccctgtggctgtgattttttaagggaaattaacttattttaaataaaataaacttaatttaaaataaaattttgttatctaaagccaaatagaaaaaattccacattttttcttacagtgctcattcatcagaaccttttttttttcttctttttttttttttttttggagatggtctcactttgtcgctcaggctagagtacaaaagcgtgattatagctcactgcagctttgaactcctgggctcatggcatcccctttcctcagcctcctgagtagctaggactacaggtatgcaccacaatgcctggctaatttttaaattttttttcagagacaaagtcttgctatcttgcccagacttgtagtgtattttttatagatatatttttagg

SEQ ID NO: 153646 - DNA, 272 bp, Homo sapiens
tgtagcactgaatggcaggcaggcagaggccaccagagccagccccccgagaagccctgctgagccaaaggggagcgccctgggacctaacccagagccccatctcaccttcccccgttctttcaaagtgcctcccccaaccccagtcaggacttcgtccatcccagttcaggaagcacaagaggctccccgaaaggaagagggggccaccaagaaggctcccagccgactcccactgcctcccagcttccacatccgccccgcctcccagg

SEQ ID NO: 153647 - DNA, 476 bp, Homo sapiens
gtggtctagaaaaaaaataccagtaatgtggcttgtctgttttagcccaatctctggaagaaaaattctccctaagacatttataaccatagatttgacttcacttgtgtttggagcttgaattacaatacttgtatgggctggaaacatctatgttgagaaattaacactaaaattaacattaaggggtggtaatactcctgggatttttagaagtaaatataagacattctggagggataaatgttggattttttcactgaagcactggtgaagatgaacttacaattgaacatttaaaaacagaatccactatgagagattgcaaatagaacaaatgctgattagatcataaagaatttcagataatataattatcttaggaagactataatactgtatatttaaaattatttaatttaattaaattcaggaatccaaacataagaaaaatatagtccctcggtaaagagcag

SEQ ID NO: 153648 - DNA, 551 bp, Homo sapiens
tctgccatggagaaatggtaatctcagtgaagacagctagatgattatattggaacctttatagaatgcctcatgagaagatggttacatgtaaacttcacaattagaatctgctagaactcatacgcctatcacattccactctatcctagtaataactacaccaaagacctttaaggatgtgttgacctccttcgtttctaagtcagtcttgattcatctttctcctcctatcaaggcctccagaaaatgcatctggtagctcagtgaagacatttgctctgagaaaatacttgttcctatggatgggacacagtcttgcatggatgggtttgttacttctgagggatccacccagtacaatcatcaagtcaatccagaaactcatacaaattttaaaatttcaaggccagaggtaatctcatctctatttcataaaaaccagtagggtttttatttgttcagaaaagtctcctttacttttctgaaaggagtctgtttcaaatctgcttctttaaaaatgtataacactcctcaatacctccaagaaa

SEQ ID NO: 153649 - DNA, 414 bp, Homo sapiens
atctagagcagaggttggcaaactgcagcctgcgggacaaatttggcccactgcctgtttttgtaaataaagctttattgtaacacccatttgtttacatatcatctgtggctgccttatgctatggtgacaggattaagtagttgtgacaaaaaacatatggcctgcaaagcccaaaatatttaccatctgggacattacagaaaaagtttgctgagccctagtctagtattatagccagggaaggtgtagggaggaaagggctcttggccaaagaagggcattgctgctgattactgatggaatgatggaatggagagggtcaacagagggaacactggatggaaagcagtgggatgaatgctaagagagcccaccaactgccagacctctgccaggcctcctggaccctct

SEQ ID NO: 153650 - DNA, 177 bp, Homo sapiens
ccaggatgatgctgcccttaatgctcagctgattacagactaaacacaaaagttcccagaggaaaatggtggacttgggagctgctgcctcaggaggatcttgagtgttagtggttcctccctatcagatgtacctaatgcccaggatttaataaaggattggcctcgttggcctca

SEQ ID NO: 153651 - DNA, 207 bp, Homo sapiens
cacctgtttctctctactggtactctttccccagcagataaatatgcaatactctttttctccagcaaaaaataaacctccccacatcttttgatcctctcagagttaagtgatcctgctttcttttcctatattacacctaccagagatgtacctctattaaagcatttttctggatgccctgtaatcactgatttttgactatat

SEQ ID NO: 153652 - DNA, 259 bp, Homo sapiens
taattttgtaattttagtagagacagggtcaggctggtcttgaatccccgacctcagatgattcgcccacctcggcctcccaaagtgctgggattacaggcatgagagtcccccacaactggcctacccaaagcttttgataatcctgggcagcaccgctcatccctccactcttcagcccattctccattctgggtaagttggtctcctttctgtcttccataggttctattttcaattttcttacaccttcgggtca

SEQ ID NO: 153653 - DNA, 328 bp, Homo sapiens
tctggtgcagtgtggaggagggacagatgataggagagcaggggacagccacagctaggagtgcatggtcagtggccaggccagatgctacccagggaaacccaagtggcagggcaggggtggtagagatgcctcaggcattgccaagccccctgcaccgtcttattcaacaaggagaggaggctggtgtggtgggacagagagtggtgggaagccccacgtaaagcattacatcagagaacattagacacatggagaggcctgtttgcaacccataggtctttattccttccctagagctctccatgcctctatttcctcacttaag

SEQ ID NO: 153654 - DNA, 174 bp, Homo sapiens
aggggccgcaggctccgtcactacctagcatttttcacaggaggagagctcttttaaaaaacacctggtcaccttccatagagatttctaaaggcattgagagcatggtttttctactggggggtgggctgggggaaaatgcagagttgggtacacataagaaaagagagccca

SEQ ID NO: 153655 - DNA, 401 bp, Homo sapiens
gggtgctggacttctggtctctgccatgagttgtagcatcacgaggcctcaacagatgggccacctgatcttggacttcccagccttcacagctgtgagccaaaataaacctttcttctttataaattatccagtctcaagtattctgttatagcaacagaaaatggactaagacaaaattggtactgagagagtggagttgttgctataacaatacttgaaaatgtagaagcagcttgaaagtgaataatagattgtagaaggtccaggtatgccggcatacctggaccttctctcctggtaaaatctcagagaaccatttgattggaccaggggagtcatgtgcctccccttgaaacaaccacagtggccagaagaatggggcttagctgagataacac

SEQ ID NO: 153656 - DNA, 424 bp, Homo sapiens
tgttcattgaatactatcagcagcattatttagccggaaaaccagtagataacatatatttcctgatcattgaaaaaaataccagaagcaatgaatgttgttatatcatccggagtgaggagatgagaaagaatgctggctttgaccttccatcctggagggcagcgtggaaagggagaagaaaagcaagctgtgcgccatgtgtgtgggcaagggggagaagggatgagaaacagactgcccctggcaggacacagagcgtttgtgggacccccgaggaatttgaactctccacagaccaaggaggtggcaggagtaagacatcggtattctgtaacatcgagggaaaataagaccagactaagaagaatacaataatgttaaaatacccagatccccagaggctggtgtgtcgctgtgggtt

SEQ ID NO: 153657 - DNA, 332 bp, Homo sapiens
ggcatccaaaagtgaataggattacaggtgtgggccaccacacctgccatttttttaaaaaatattttttatttttaatggaacatttcacgagtttgtgtgtcaccttgctcaggggccatgttaatcttccctgtatcgttccaattttagtatatgtgctgctgaagtgagcacggaatcaattatgataataacaattacaatatgataattttatagctctaccatttcttccatatttattagttggtatttattataagaaaaagttttcctggccagcatggtgactcatgcctgtaattccagcactttgggaggccgaagag

SEQ ID NO: 153658 - DNA, 410 bp, Homo sapiens
tcaaacgggcttctttaaaagagcaatgaatcacttgctcattttaaatctcctatcttgattatattaaatagtactactttttaaaataagaaattattgattattaattagagtgtaggtaacaaattagccgggcgtggtggcaggcgcctgtaatcccagctactcgggaggctgaggcagagaattgcttgaaactgggaggcggaggttgctgtgagctgagatcgcaccactgcactccagcctgggtgacagagtgagactccgtctcaaacaaaacaaaacaaaacaaccaacaaacaagacaggcaccttgtctgccctctgagaggtaggggtagagctgggaggatcaaaagagaatagtgagattcttactataaatggagcaggctggctggaag

SEQ ID NO: 153659 - DNA, 595 bp, Homo sapiens
tataatggagattgctgggcattggtaagtatatgtttaactttataagacaccaccaaacttttttccaagtgactgttccagttcacactcctgccagcaatatataagagttccagttgttccacatcgtcaccaacacgttattaccgattctcctaaagtttagccattctagtgagtgtgtgatgttatctcattgtgattttaatttacatttccctaatggctaataatgttgaacaacttttcatgtgtgtttattggatgtttgtatatcttctttttgaggtatttgttaaattttttttgcccatattttattttggttggggtcttactattgagttattagatttctttatatgttccagatagaaatcttttgtcaaaagtatgtattacaaaaccttctcctagtgtatgacttacctatttatctttttaatgctgtctttttcctccttttatagtaagttctttctatgatctctgcctaccccaccatcatgaagaatttcttctttctttctttcttttttttttttttgagatggagttttgctcttattgcccaggctagagtgcagtggca

SEQ ID NO: 153660 - DNA, 297 bp, Homo sapiens
ctaaagacttatgggggttacatatagattgaaccattttgaatttctaaagtatgtatgagtcaagaaccaaaatttgagggtgatcagaatgtcatgtttattttccttagtttaacatatctgagtatagtccctgttccaccaggtggtgggaaagccagcttagacattattcaggctttgtacccttcctcagactttggtaaagcttccaggacttaactcagtgccaaaatacaaagcaacccacccagtcccttatctacatgggttaccattgttccagcccacatg

SEQ ID NO: 153661 - DNA, 434 bp, Homo sapiens
agttcacggagcagaagactgatacaaaaatatacgatgaaagtttaccttgttaggtattatagtggaagtgagtataaagcactcctagaacacaaatgaagaaatgactgaccattctgagaagtatcagaggaggcaaagcttaaactgtgttcagaaagttgagtagtaagttttcaggaagaaaatgagtaacgaagtttaaggaacttgagaaagtaaaaaagttcatgatgaatgtaagggactgcaggaggttcattatggctaaagcagaggttgtgagtgggcgcccttccacactgtcatgcatgctgaagagaggagacaagggagatagtgaggactgacagtcctcaagttcatataaggctgggactggaaatcagatgaactggaagtacaaggaagcatggggattgaagatgctg

SEQ ID NO: 153662 - DNA, 260 bp, Homo sapiens
tgttgggattacaggcacgagctactgctcctgacactattgcacattttaaacaaagaggccagtccatagaccatctgacaaacactccttcatgactcccttcatctataattggtaaacctctgattaacctgtatgttgagcctatatctcctatctctggaatctctaatttaaaaagcactaacaaggtatgtcgacatttcaagggagtgttatacaaaaaagaagttgagccagtgtttgcggcacggaga

SEQ ID NO: 153663 - DNA, 508 bp, Homo sapiens
atggctaatctgctgaagacctatccactaagtgttgaacttcaatcctatctctagtcgtgtttctgcagaatctacttatgctttactcatgctctcttttcttttttttttttttaagaagaaactggggtctcagtatgttacccaggctgctcttgaactcctgggctcaagcaatcctcctgcctcggcctcccaaagtgtcaggattgcaggtgttaagccatggcacccggcctcttttatttcttaaaataaattattaaatataacgattttatcttctaagccttaaaaccccaacagccgaggctgctgcagggccgactctgcagcctgtggcttctgtggggcctgtggcttctgtggggcctgtggcttctgtgctgcctgtggcttctgtggggcctgtggctttccgtggggcctgtggcttccgtgctgcctgtggcttccgtggggcctgtggcttccgtggggcctgtggcttctgtgctgcctgtgg

SEQ ID NO: 153664 - DNA, 413 bp, Homo sapiens
taggtggtagttgcgtgagctgagatgcgccactgcactccagcctgggcaacagagtgagactttgtctcattaaaaaaaaaaaggtcattgatgtgggctttcaaagtctcattgtctcatttccaagcagttgtgtttgagggcaactctgaggggtgcagaggtggtggtttggagttaggaccctcgagcacaagaaggctaggacaaggaggatggaggccacgcctgaggccctctgctgctgcccccagctgtgtggacgctccaggtagctttgctgtgattgatgtgatgctgtttgtgatgcttgactccggctgggcttggaagtaagcttggatgtgagactggaatctgcttgccgcatgtaccagatgcatgctgctgttagctgtcactgatcacac

SEQ ID NO: 153665 - DNA, 425 bp, Homo sapiens
ggcgattatagagatagttaatgtcggccgtataagaaacattattaaagttactcttcggtcctttccgttcttgataaacaattcctgcgccttcctctcgaattctattttccattcctcaagtcactttaatggctcttcaatacaacaaatatttactgagtgcttactaagtgccaggcactgggctcagcgctgtgagggatgagaaagaagtggtaccttccttccaggcgattgtagtctagactacaaactgccttcctctgccaggacaagtttgtcgtctgctctgagctatcaagccccttaggagacctaggacccagctgggtcccatccctttggagtagctgcttcagactagcctaggaagcacctaattcttgtgggcaaaggagccatggaagatagagctggtg

SEQ ID NO: 153666 - DNA, 349 bp, Homo sapiens
tggccagactggtctccaactcctgacctcaagataatcctcccacctcgacttccccaagtgctgggatttgggattacaggtgtgagccactgcacctggcctaaaatgttccatttctaataaaatttttagaagagtccatttacatgatttactatttatatagagagatgtaattccttttttttttcctttttctttcttctttttttttttaaacagtcagggccatattatgattttcctgttggtcattggtaacagttataactatataattggggtgtcggtaaaggtctttctcccatgctgaacttccaatttaatgaggataggaccctggtca

SEQ ID NO: 153667 - DNA, 134 bp, Homo sapiens
agccccccgcttttttttttcactacaagacacttgctttcttctattaactcctgcttctccctgactcccagcagaaggtgccagtgataacttaaactctgcaaacgagcaacttaagggcaattattttg

SEQ ID NO: 153668 - DNA, 296 bp, Homo sapiens
gagacctacttagcactctcaggttacgagctagtcagtgagatcacacagggttatgagagccaaacatgatttatggcaagattcacatactgtgatgccttaacaggcaggatgggtaacttaaacaagggaaggtggctggcaatggggtcatgcaatgtcttattttaacaagctgttataacgccacacaggaacagtcttcaattaaactaagaaatatacttttttgttgtttttctctcaaaatgcatggctctttgggttccctattactattgtaacagtgacta

SEQ ID NO: 153669 - DNA, 339 bp, Homo sapiens
taagggataagggacaattatataccagtatgctaactagtctcaagaaaagagctagctttattagacatttacgtggagttctatctgttccacctaaaacttccttgcaaggagaaggctcctccttatcagacgtggataggaggctgctgtaacactaactccctcccactgtagcctaggaaaaactcggtcttgacatgcacaaaacaataacttctgagaacttcagagcagctgtgttcagacagagccagtgactttactccaggcaaagaagtagtttaagagttggttgaaaaaacaattttcattttgggttggaaatgaggaaag

SEQ ID NO: 153670 - DNA, 245 bp, Homo sapiens
tagaaaatgaaggcacaaggcctgggctgctggaaggggcccgagggcctggagatggaggcttggcaggcccagcactgctgaagccaagggaatgagtgacttctccaaaagcaggttgagtcatgctgaacctcactggttccccagtagcaggagcatgaggaccaaggacggacctagaagattcatggtaggggctgaggggaagagcagccaagagtcaggagggtcagaagtgtgtc

SEQ ID NO: 153671 - DNA, 577 bp, Homo sapiens
ttggaagaggttcctggtttggagaatggtcccacggtggccagcacaggagcaaatgagagggtgggacagcgggaacagacacgtgctgctctccttccaccctgagagaatgctctccagacattcctgcatcccaccccaccaaactcagaagcttgctgggatccttcgagtccaataggaagtccgggagtgccttcagttttcactcaaagcaggcccttttttcgttccttccctgttaggggaagatacacctggacgagaatatatcctcacctcaccaccctgaaaagctgctttctcccttgcatccatatcctctcttcctgtcacctccccatacagcttcacatttgcctcatcgcacttttcttttctgtccacctttcataatcccatccactccaaatcccggaccctgcacacgccaactccctgaatccaattcaggagtgccccagttcccctttcgatccatctcctttctactgtagcggagactacaagtcccaggatgccccgctagcccgtgaccggctaggaaataaagagccttctctccgcggtaagg

SEQ ID NO: 153672 - DNA, 453 bp, Homo sapiens
gttacaagaaaaaaacatcattttgaaaatggtattaataggatgattaatgtaagcatatgacacagagacaggaaagaataaagagattaactagaacacactataggtataaggttctcactgagcaaggagcccaaacctagagtccataggatccattaatggacttcagagttgtgactccttgaaactgtaaaattgtgaccatgtgcaaagatacctcaacgatggcactaagcaccgacaaatgcatatctgtccacagtataatctaaaatggtacagaattattttatggataatttaaaggctatcttcgttggtgctacctttcatttaaatcaccaaagcttgcaccttggacaatgtaagaatatgatatagtaatggctgacctatatatccgttattgtataacgggaagcagctcatgatgagggatatgctatc

SEQ ID NO: 153673 - DNA, 419 bp, Homo sapiens
gttacaagaaaaaaacatcattttgaaaatggtattaataggatgattaatgtaagcatatgacacagagacaggaaagaataaagagattaactagaacacactataggtataaggttctcactgagcaaggagcccaaacctagagtccataggatccattaatggacttcagagttgtgactccttgaaactgtaaaattgtgaccatgtgcaaaggttctatggaaagctgaaaaatgcacccctccacaaccccaaagatatccatgtcaaatccctggaacctgtgaatgttactttatatgataaaaaatgtgattaagttaagaatattgagaggaagtgcttatcctggattatccagatgaaccttaaatccaacgactcgagtccttgtgtaacagagatacacagag

SEQ ID NO: 153674 - DNA, 459 bp, Homo sapiens
atatttgtatttatttttttaataagacgtggtctcactctgtcacccagattgaagtgcagtggcacaatctcagctcgctgcaacttctgcctcccaggcacaagtgatcctcccacctcagcctccccagtagctgggaccacaggcacacacaccaccacgacagactaattttttgtatttttagtatagatggggtttcaccatgttggccaggctggtcttgaactcctggcttcgggtgatccacacacctcccaaagtgctgggattacaggcgtgagccaccacgtccggccagagctagtttgttttttgtttgtttgttgttttggtttttgtttgtttgtttttgagacagagtcttgctctgttgcccaggctggagtgcagtggcacgatctcagctcactgcaacctctgcctcccaggttaaagtgattctcctgcctcagc

SEQ ID NO: 153675 - DNA, 508 bp, Homo sapiens
ggagctgtgggaggttttctagaatgtcagttataaagctacttgttgcacacataaaatggatttggaaactcgtatttaatcttaaaaaaaatcttttagtgtttgccagagcattttaatctgaaaatatttaaaaatactcgcctgtaatcccagcacttcaggaggccgaggcaggtggattacatgaagtcaggagttcgagaccagcttgggcaatattgcgaaaccccgactctactaaaagtacaaaaaattacccaggcgtggtggcagtcacctgtaatcccagctacttgggaggctgaggcaggagaatcgcttgaacctgggaggcaaaagttgcagcgagcagagatcatgccactacactccagcacgggcgacagagcgagactccatctcaaaaaaaaaaaaaaaaacaaaaactcatctgttagtataactaatgctccaggaagctgccacatatttacctcaggacctatttctatcttcgccccac

SEQ ID NO: 153676 - DNA, 597 bp, Homo sapiens
aaactcctcctgccttggcctcccaaagtgttggcgtcaatagcatgagccaccatgcccagcaatatagtgtttaaaaatacagattttagagttgggggagggaggccatggtgcaaaaataaataaataaaataattttaaaaataaaaataaagattctgtaactaaattacatgggcaaatttaactttccaaaccttgattttctctcctgtaaaaaggaagccgtaatagtatcctatgagaattaaatgagaacacaggtgaagtgcttaccttatctcccaaacagttcaaggcaaatcccattgctttgtgttcctgaatcttcaccagcattctctattagctccttcctcaaaggctcttagtaagtttttgtcatctccaagcaagaagcaaaaatgtcttacccaatcttgaatctcttttttgcctcagcactatctcttttcccttcctttccaagcttctagaaaaaaataatctgagcaaaaaggtcagcagcccttgctattcttacttttcccatgttcttccatcttctactatcacaataaaactgctctgacatagtgaccaatgaccccttag

SEQ ID NO: 153677 - DNA, 272 bp, Homo sapiens
cctcgtctctattactaaaaaatgcacaaataaataatttttttttagaaaaagaaaaatggccagcttgctaaataaatcataggaactcccaagaaggataagtcaagcagggagaatcaagccagggagttagtgtcgggaagggctttgttggtcagacgcagtggctcatgcctataatcgcagggttttgtgaggctgtggcaggaggaacactcagctgggagttggagaccagcccaggcaatatagtgagatcacgtctctac

SEQ ID NO: 153678 - DNA, 406 bp, Homo sapiens
ccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacagg

SEQ ID NO: 153679 - DNA, 624 bp, Homo sapiens
tcctcagcgcgcactgtgccagagcagtacacaggtacaaagggcaaacgtgttcatgatttcatttgaattctgttgtttttacatcgttctgccctgatgtaaaacaaaccaggattttaaaggcagtgagtgatgaggagctactcccacttggggaagagctgctaactttacttttccgctgctgttggttccggttcaaagctcggtttgggaagtaagaggaggactcggagactttgaccagagcactccaggccaaagttttcttccagttcaggtctgtctcttcgtcccagccccgacttaagatcagaacctagatatttgaactagcccagtgaccctgtgaattctaatgcacaggtctgtactgcatgtaagacttggctcagatttatgaaccagaagcaatgcatgcacgcgcacgcacgcacactcagagaagggggcgatccctagaaaataccacatcgggctgtgtgtgctttggttgtgctgccacctgcacccctttgtcccttagagccacttttataatttccatatgttcatgcctaaggatggtgggagtcccaggtattcttttctgaactcatcctaaaattggtaacagaccgc

SEQ ID NO: 153680 - DNA, 178 bp, Homo sapiens
ctcagctgccactgcagatctttttcactcttttcagaggcagtgagagaacaggtctgtttgcattccttgctgtccagtcctacggggcgggtaaaaaaagagaaagatggggcagcagggaccctggctttccaaggactgtgaccattttgcctcatagctcttcacaccttgg

SEQ ID NO: 153681 - DNA, 753 bp, Homo sapiens
caggaggatcacctgaggccatgagttcgagaccaggctggtctcgataaaccccataaacacagataaaccccatctcttaaaaaagtaataataaaataaaaataaacttagccaggcactgtagtgaatgcctagtgtccaagctactcaggaggctgaggtgggtggatcgtttgagcccaggaattcaaggttatggtgaccaatgatcacaccaccgcactccagcctgggagacagagcaagaccctgtctcttaaggggaaaaaaattaaaactaggccattcccccttttgatcctgaattagtactacttatgtccaattaccgaaccttttaaaatatcagctttgatggggacaataggaaagagaagaaggaagggagacagaaggagtggctccaagttcccatattatttagaatacagtaattagttcaaaatgatttagaagtagtgcagtagagtaagacccggattctaggactcttctcagcaatatgcccaatcaaatcttttaacctctgtaggccagttgcttcttctataaaataaaagtgttgagtaggtttctaaagacacagctatcaaaatactaacacatgagttttgaatcttgtcctcctaagaattttggctaagttgtgcctctttaaaaaatattaacgaaaaatcaaaatcaaaggcttaagaaaggatagcacagcagcacaaagaaaagactagatggacaatttcctcaaagaaa

SEQ ID NO: 153682 - DNA, 431 bp, Homo sapiens
agtgttgtgaggaagaatcttttctacgtgtgtctcttagcttctggtggtttgctggcaaatctttggcatttcttggcttttggaagcgccaccctgatcactgccttaccatcacatgacattctccttgtctgcttgactgtgttcaaaattcccctttttatgaggatactaccacctaatccaataaggatgtttgattagggtagcaaaaagcaagggaatttccttgaatataaaagctaaaagacattttgagcactttgcttgacacactctagacctgggaatcaatctgatcagagccatagagagaaaactgcagccagtgggtaaacaggcattaagtgatggtttggatttaaaactattattcagactctgaaaggaagacaatagaaagccacagagcaaaaaagagcaattta

SEQ ID NO: 153683 - DNA, 453 bp, Homo sapiens
acctcacggagactctcactggtgtccccagtgagagcagattcagctatgattcaccgtctgattacagaagttatcttatgattgcttttagtttcttagtgaaatgaggatctaagttatctgatgaaaaatgaggagggagggaaggactctggaggtttgtgaatagaggagaagctgtacatagttgtctgaggagtgaatcagctagaaaaatacagtcagatttcaaacagaactaagaactctcttgttagttaaggtcataaatttaaatgagaccagacagcaccattgtatgcttttctccagcctgttcggctgttcaggtgggtggaggaggcagagaataggatttaagctaggttggttttgctaagcaaatatgatagagagaagaggtactggggatgtattcatgaatacaaaaggagagattataattataat

SEQ ID NO: 153684 - DNA, 300 bp, Homo sapiens
atcagcagataaacacatgtaacaacatggtaaagtatggacagcttttcttaataatgctgcaaagcctcagaatgttcatttttcaaaaatgtttaaataaaatagcaaatacttaactttagcactgtcgctgtagaaaagattgaggaacttttaaaagcatcagaaaaaaatttacaatctgttgtaatggggcattttcattttaagctcatgcttcaaaacaatttgttattatgcagaatgtaaaactcttcccccttttgttgaaaaactctcatgaagattactttaatg

SEQ ID NO: 153685 - DNA, 215 bp, Homo sapiens
aacgtaggcccacctgttaggagatttaaattttctattttgctaattcagcaaatattcactgagcacctacaaatgctagagcctactctggaagcttgggatacagcagtgaatatggtaggtggggtatggcagtgaatatgacaggtgggatacggcagtgattatggcaggtgggatctgccagtgaatatggcaggtgggaatatggg

SEQ ID NO: 153686 - DNA, 435 bp, Homo sapiens
agtcagcccgaaggggtggggtcaggagggcttcctagaggagctgctcttggagctgagtaggagcctgccaagcagggagcagggaagcaaggcatgtatgactgcagggaaaatgacacttggagagagggtcacgagcaacactggcctggttatataggaagagatgcgcgtgatacgaggcctggtgccttgacccaccccgctgtgcctcagtgggccgtcctgagctgaatctggactgctgggacttcgtgagttctgtgtagacttttctctcaaacattggctgggcacagtggctcacgcctgtaatcctgatactttcggaggctgaagtgggaggatcacttgagcccaggagttcgagaccagcctgggcaatgaagggagaccccatctctacaaaaaaatttaaaaattagctgggca

SEQ ID NO: 153687 - DNA, 470 bp, Homo sapiens
atcccagcactttgggaggctgaggtgggcgggcagatcacctgaggttgggagttcgagaccagcctgaccaacatggagaaaccccatctctactacaaatacaaaattagccaggtgtggtggtgcatgcctgtaatccctgctactcaggaggctgaggcaggagaatcacttgaacccaggaggtggaggttgggtgagccgagatcgcaccgctgcactccagcctgggcaacaagagcgaaactccgtctcaaaaaaacaaaacaaaacaaaacaaaacaaacaaaaaaaaacattagctgaagtcttcaagcccaggtaatatgcacatcaggaaggactggagaagttatgtgcttactatgtgacagggcagtaccctgtcatgttctttgccaaagcccttcaagaatctaaccaagaattcagcctgggtgacagagcgagactgtcaaaaaaaaaaa

SEQ ID NO: 153688 - DNA, 667 bp, Homo sapiens
ggcacccacagttctcagaaagctgcatgcctcctaacacccagggagaagcaggctggccctcgtccccatggtgacacgtgtacttggcctgtgtgtagacttgtgacctcaccccgtttactgtggcttcagagcctctccctcctggggcgggagccaggagccgccaaagatctcggcaacccggacaaccaagggcccagaagtcagaactgggtgggtgacagagagagaccccgagctctgcaggcacagcccgtcctcaaccctgactccagggagtgcaggtccaaccccggcccactccccgctggccagcctcaggggtcggggtggcacagcaggcagtgcccatgctgagttgctggctgggcaccagccactgggtgctgtggcttggggcccgggagcaaacagacctctccttctcctgtcccacacgcccacccggatgcgcggtttgcccaggggttttgaccttcacgggctcccgtctgcacccggctgagcgaggaacttcaccaggagagcgcctggactccgaagcccgttctgtcctgagcctctatcgcgaggcagtgcccagcatggagctggaactcagggatgtgggggaaaaatcctgcccatcgcataacaaccaccaccgtctactgagagctca

SEQ ID NO: 153689 - DNA, 164 bp, Homo sapiens
catggtcatcattcccttgatgctgattctgtagcccctgtttgagaacgtcagctttcaaagaggatataaagtttatggaggacggagccccaaaaccagctgacttctggcttcagaaatgaaagggccagagaatgagatttgaaggtaggccccatctg

SEQ ID NO: 153690 - DNA, 234 bp, Homo sapiens
ctggttgcacaactttttggaatacaacttggcaaaaatcccacttataagaacaaagaccacagtgacacaaaagtgcaaaacactcgttgcagcttttaggtaagagggaaaaaccagaaacaaccaaaatgctccttggtggggaattagctactatgtacatcaacataatggaagcattaaaataatgcaggaggctgggcactggggctaatgcatgcaatcccagca

SEQ ID NO: 153691 - DNA, 548 bp, Homo sapiens
tcacagggtccctgaggctgaaggcaaagcagcatgaaaagtgacattctacagaagtgatcagatgtcctcgtatggatttctgcttttaaaattttggtgtaggagtttcatgatagtcatttgcttgctcacagaatcaatgctgttttttgttttgttttaactcctgggaatataaatgggaactccttggtgtattgttctcagacctgcagcagatgggtgccctttgaaggagctcccaccatctttctgtggttcagagaaagatgtggttatatggctttagaattgggtgccacatattggggacaaaacataggtaaaaatgagaagtctttccttagactaaggtttcactgtgataattgtaagaatgtgttagtatgtcttcaactcccatctttcatttatattgcagataacaactttgtcttttaaaaagttttgagctttaaattattgagataccagattaccaaagaaatagtttcacagaacaggtataaacttgatttgtccagtttgactaaaacagcttttca

SEQ ID NO: 153692 - DNA, 382 bp, Homo sapiens
agaggggtcagaaggtgagggggacgcgagggggagtgccccaggcagggggcgccacggctgcaagcaccacagtcggggaagccctcacgcagttcccatggtctccacgcactcaaaaacttgggggacctcagggagactccagcctctaccgcgtgccagtggtttcccgcctctgtgccaggcctacttctctggaccatacgctcctcatgggcagcaatggctacttgggctttgcagccggcaccctggggtttagcccggttcagagctaggcacacggcaggctcgaagggagaccacacacccacagaaaacctccctctgagaagcgccccatgcctcaccgcagacagcgggcaggcagaggctgggg

SEQ ID NO: 153693 - DNA, 454 bp, Homo sapiens
aacccgggaggttgaggttgcagtgaactgagatcccgccactgccttccagcctgggtgacagagcgagactctgtttcaaaaaaacaaaacaaaacaaagaagggtatttccagatatagctgatgtagtatttgcgtgtctagaggaagcctcactcttttcctagtgtcaacataataattgctgatgtgcttttcaactttgctggaggctctttccttatctcgtgataaggtgtttgtgagtctctcattcgtcttgttggccgccttgttattgtcctctgtgtcccttttttcctcactggactgatttgaatcttgctgattcactagaggaagtggaatgttccagcagtgatcagacattgaaagggactagccttgctgctttgcgtctggttctcctcggctttcctctcagcaatgagtcctcgtatgttctcagtggt

SEQ ID NO: 153694 - DNA, 320 bp, Homo sapiens
attgccaagttcattattcagattcacaattggggtaatgtgtttcccttttgttcactcattcattcactcaacagatggtacttgggaacagacttgcgtatgcaactgagttattcattcatcatagtgactgtgcacagcaggggcctttataagtgagtggaaaatctgcaactctaaaccactaacaaaccgttctgactcagggaccatcaaacgcgggagtattaggcagggcctctgccttgaagaaggccctggatttctgagtcagctttcttcctactccttcggtacatccctggaggtagatcatg

SEQ ID NO: 153695 - DNA, 269 bp, Homo sapiens
tctactatattgtaaatgctgagtgatggaactaaaagactaaaatagtacccagttaacccagaaatgcatagtttgcacgacaggtattgaggacatgaaagacttggagcagagagtggggtggtggaagggaaggtacagttgatagtattagcacagaattttcaacactaataaacaaatagctcacaataagaagtgatcaagttaggacagaagttcttagggggaaacacagaattcatagaaggatttttttttttttt

SEQ ID NO: 153696 - DNA, 550 bp, Homo sapiens
ggcaactttagtgtcgttattctgaagggcaacattagttaaggcaaagagcagcaatgtatacttttggaagtctatgctttgcaaaagccattttggacatgatatagcaggtaggaatattttctgtccttgcatatgactctgcaggggttccagctccatccttcaggaagtagaaagttctttggaagtgagttccttcaccaaatgttttgccaaaaaacttaggcccatttctgaaagcttccttgaagcacctctggatttatgaaggaggcactgtttgctaagaccacacatgttttattgctttcagcacaagtaaaatgaaaaatgttggaaaatttgtatacatgcttgccaatatgtggtgctttagaaattacaaataatatttcttgtattggcaagatagaaactccgtatcttttaatataatactatttttggcttctggagttaagtcatttgaatttcctgtgggaaatcatagagtcaggtttaccatgacagtttaaaatctgctacacactaatggaaataactt

SEQ ID NO: 153697 - DNA, 219 bp, Homo sapiens
cataatgggcttctcttgacctaataattctctctagtctaggtctcagccttcatttcttcatacatctttcttcaataaatcccttccctaaggcttcaatcttaaatggatgcaaatgaagtcgtataattttaaaacccaaagggcccacaaatacagactgtcttcttggaaactgatgcccagagagatgagtgacaagctctgagtcaccca

SEQ ID NO: 153698 - DNA, 510 bp, Homo sapiens
aattagctggacaggtggaggtggaggatgtcccaggccaagtcctgggacatttgagacaggtggtgggcagggctgtacttgcttcctgattttttgggaactgcacacccagcaaggttcaaggcctggcacaactaggccagcacctctgttctgctaggtgcgaagttggaggtgtttgctgcatttaaggtatttaggctgggggggtcctcctttctactgtgttttccccacaaggccccaggagtccagttggctcagctaggaatcttagctgtggttgtcggggtaggtggccttgctgagggattcaaaacagggccctgtcctctgggcctctctctgtctccacccaaactgctccttgggcccaggacctggcctggaagcctgcctcttcttcccatcagcattttccccggggcttaagttggaacctgtgggtgtgtgcccctcctgggccccgttttcccggctgcctgtcaactggcaccaacacccggg

SEQ ID NO: 153699 - DNA, 399 bp, Homo sapiens
tggcctggtacttctcatctgataatacatgtgatgttaccagcacactgtatcgtttaaacatttattttcacttccactggcttggtaacttgaaccattacaaaatggctcatcaatggttttgatgatttcagagaaactgattttggaaacattggctggacctctccagtcatcagattaaacaacagcctttgggtttcaaatcatcactctgtaggatgcatctacctttcccaaaactcccttccaccctcccttccttctttcattcatttttagcttattcttatcccaaagcacaatattccatctggtcttttttctacagttataaaagttggtagtgtcgacaactctaattaaaagaagcttttaatgactgaggcaggagag

SEQ ID NO: 153700 - DNA, 500 bp, Homo sapiens
aggaaaaagtgtgaagagtaacaagaatgtgaccaccacttttccatgttttcttttttgtataaatttgattcttgaactgtataaatcagctaagtgttgaaaataaatttaaaattagaaaacagaacatttatatagatataaaaacaataaaaccatctatatcaatacaattatactagtaatttttgtgaaatacagttttcagttaaaaggttaagattagaaattttggaaaaatggaggtaacaagtagcaggcagtttttaggacttattgacatctacatagaaacaaatggagcactacatatcaaaactaaaatgaaattgacaatgtgtacaacaaaacttgttgacaaagtattcccacaaatctcaaaacataagaatggaaacaaagtgtattaataggcataaaactggcgtgttatcaacatctaggcaggagaatacagaggaaagcagaggctgtctgacagatcaaataacaaggct

SEQ ID NO: 153701 - DNA, 286 bp, Homo sapiens
ggtaagtgaactaagtgaaatctacctaattaaggtcacatgacagagtaaaagttactcaaatgatcagtcacttcggttttccaatttattttcccaatatatcacaccagggttaaataatgatacagggagctatctgaaagatttgatgtctataaaatgtcctctgtggccagacacggtggctcacgcctgtaatctcagcactttgggaggctgaggcgggcaggtaacgaggtcaagagatcgagaccatcctggccaacatggtgaaatcccgtgt

SEQ ID NO: 153702 - DNA, 618 bp, Homo sapiens
tcccccatgccaccctgcgcctagacctggctgggcgggaactgactgactacctcatgaagatcctcaccgagcgtggctataggttcaccaccacggccgagcaggaaattgtgcgtgacatcaaagagaagctgtgctatgttgccctggactccgagcaggagatggccatggcagcctccagctcctccgtagagaagagctacgagctgcccgatggtcaggtcatcaccatcggcaacgagcggttccgctgccccgaggcgctcttccagccttgcttcctgggcatggaatcctgtggcatccacaaaactaccttcaactccatagtgaagtctgatgtggacatccgcaaagacctgtacaccaacacagtgctgtctggcggcaccaccatgtaccctggcatcgcccacaggatgcagaaggagatcactgccctggcgcctagcattatgaagatcaagatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctagg

SEQ ID NO: 153703 - DNA, 479 bp, Homo sapiens
taaaactagaacagcagaccggctcctacccaggtcaccagctccaagactctcaaactagaacagcagcactgacttcttgccaggtctccagctccatgaccctcaagcttgaaccgcagcaacagctccacccaggtctccagctccacaaaccttaaacaacagcaccggctcctccagaggtccccagctacagaccctcaaactagaacaggagcactgactcctgcccagatatccagctccacgaacctcaaacttgaactgcagtaccagctccttcccgggtctttagctccgtgaccctgaaaataaaacagcagcactggcttttccccagatccccagctccacgaccctcaaatttaaaaagcagcaccagctcctccctgggtcagcacctccatgaccctcaaacctgaactgcagcactggctcctccccgggtcaccagatcccagaccctcaaactagaa

SEQ ID NO: 153704 - DNA, 654 bp, Homo sapiens
ggcaccaagtgtggaagtggaaggccacttagaaagctattgcagtagatccctgattcctgactcctagaccaaagctcctttcccaggtctctgctgcttcctctcacacaaggactccgctccagagaaaatagagtaagtaaaaagcatgtgaacttgtcgtagttactggaaattttcttaaatgcaaatgaaaatgagagagacgggaaggaaaaatcattgaaaaaattcagactgcagcagcagcctacctgaaaagtcacagcaacaggcaaaaaataaaacaaccttgggaaaacctcaggttgcacctggacagatagacagctttaagcacagataaacaagcacaggagtgggagagtctcgacttcatactcatacaatgggccccagtaaaaactgtgagacttaataagtacattcctttccgtttaggcacactaagatacggaagcgagaagcttatacagggagggtggggggatgcctgcagctgcaagaaaatgtctgggaacagacacagaaacttaagcgacacaaagcagcacagagcagcataaactaaaagcctgcttatgtgatcaaggaattgggtaaaggctgttaggaactctgctctatgccgatagcacacctggtcccaac

SEQ ID NO: 153705 - DNA, 463 bp, Homo sapiens
gagattgaatactaggatcagagaaaatatgctagatttaagtatattttactttgtcaagaagaacaggaacctggtaatagaggagtaattttaattttgtgatcaggaagggtttacttaatggacctctactgataagaacaaaataaaaacattcagatgaatgaaaaatcttttaatagtacctggcaatttccaaagtattctagcaatccttatcacatatgaattttatatctaatctgtgactgaaaacagggaaggtattttagtcccagtttaaaaaatgatgggactgagatctagagattagagcttacctaaggtttcactgttagatacaatagagctattattcaaactctggtccagtgttcattccaacagcatgatacactgctacttaaaataatcttcatcctctacaccaagcccagtggccattatcttgcttgaatta

SEQ ID NO: 153706 - DNA, 343 bp, Homo sapiens
ttgttaaactcatttgctttgaagacgacttgagtttccagtaagctctgtgactgtttaagagggttcagtctttcagccttgttacaaaagtaaaggtcattcttagctgaaacagttacttaaaactccaggaactagtctgagaatcccagctcttacaataaagtctagagggaagtcattttataaaacaacgataaactgaaagaaagctagtcaaatggcttttgtctgaatacccttaaagatctttgtccattcaatcttcttttcaggaaacttgatctgagcctctatccagacacccagttatacggtaccagttagtggaatatgtagg

SEQ ID NO: 153707 - DNA, 377 bp, Homo sapiens
ataataaattaccacaggcccagcatggtggctcaaacctataatcccagcacttcgggaggccagggaggaaggatggcttgaggcctggaatttgagaccagcctgggctatatagccagatgctgtctttacgaaaaaataaaataaaataaattgaaaaaaatcacaaacttagtgccttaaaacaacacaaatgtattgtcttatagttttgaaggtcagaagtctgaatgggtcttataggctaaatcaaggtattgtcagagctgcattatttctgagaactctagaagaaaatctgttctcttgccttttccaccttctagaagccacctgcattccttggctcacagggtgccttccttcttcattaa

SEQ ID NO: 153708 - DNA, 118 bp, Homo sapiens
cctggttgcctttttttggggggtaagaacacttaggaccgaccctcttaacaaatttcaagtacagtactattacctgtagttgccatgcttacatgttggaggtgcagaactcact

SEQ ID NO: 153709 - DNA, 548 bp, Homo sapiens
ctgccagagtcccctttggtgacactacaccaactacaagattacagatctctcatcttccgtgctcccctaaaaactcctacactctgaggtcacagcaacccaagcaaaaaggggagctctaacaagtgaggcattccagtgtctagaactaaagattctacaggaagatgcattaaacatgtacttttctgccttccatttctcttaaaactctgcacatcattaacaaaatctaaaaagtgagataaaaataaattcactaataaacgatacctctgaaggcaagaaaggaccttaaacaacatccgaactagcacagacacttgtagtttatagatgtcattgaataaatattataagtttattagaaacaggccgggcctgatggcttatgcctgtaatcccagcactctgggaagccgagatgggcggatcacctgaggtcaggagtttgagaccagcctggccaacatggtgaaaccccatctctactgaaaatataaacattagccaggcgtggtggcacatgtctgtaattccagcta

SEQ ID NO: 153710 - DNA, 352 bp, Homo sapiens
gagggagacagggctgaggaagtggagagagtgagacaggcaaagggaagcgggaagagtgttccaggtagagggagagtctgagcagaggcccagagactgaagagacaggcacatctgagaagctgaagggagtccagtgggtacgtgcatcaggacgcatgctgggaggtccctggggtggggttatgaaaggtgccaaagagactgaatggccacacagagcacactgaagccactacagttgcatattcagaaatgcctgagttcctggacctccaaggccaaggaccataatgttcacggtgagaagacaccagaaccttcagaccctgcccgaagcccttcttcc

SEQ ID NO: 153711 - DNA, 323 bp, Homo sapiens
acctgctccaagaacttgggcatgttttataatctttccaaccgcctgccctatctgtaaaatgggcatgataatatctgcttgataagtataatatcatacatctcagcaatttccaagctcagaatgcccatcacatagcaggaactcaacaataaataatggtttgctatgtatgtcttttagtttggtataagaaaagctaaatcggccgggcgcggtggctcatgcctgtaatcccagcactttgggaggctgagacgggcggatcacgaggtcaggagatcaagaccatcctggctaacacggtgaaaccctgtctc

SEQ ID NO: 153712 - DNA, 615 bp, Homo sapiens
taagtctctgtgtcgttaaaattttttaatatttagaggtcaaaccaaattccagaaggttatcaatgagaaaacgataaagtgatgttagatctctttaaagctttagctttaccaaaacacacaaatgttgaaagctatcagcaaatatttatggggcatccagtatgtgcaagtgactgtggttatgggttttcaaagaggtgtactccaagtgtgattcctggatcagcagcatcagcagtgtttcgaaactggcttaaaaatacaaattatctctgcttcccctttactaatcgaactctgcatgtggagtccaccaatgggtgatttaacaaagctctccatgtgattctgatatactttaaagtgggagaatcatggcttcagatgatgatgatgattattattagagggtcttgcactgttgcccaggttgagggcagtggcgtgatcatggctcactgcagccttgacctgccaggctcaagcaatactcccactgcagcctcccgagtagctggcatgccactatgcccagccaattttttactttttgtagagacagggttttgccatgttgcctaggctggtcttgaactcctgggctcaagc

SEQ ID NO: 153713 - DNA, 410 bp, Homo sapiens
ctgactgcccagattgtggctcccagccctaatatggcatacttttcacacagctgtcgctacttatttacaggtctgtttcttccaaaacactacaagccccttcagtgaatgaagattggagtttagaacctagatgctatgaagcagacaagtttagtgtcttgatggttggtaagacacacttctggtagcataaaaaggagcagcattctcccaagccctggagaattaggcagctaccaaatgagatattacagaaagagaactggactttgagccagaacgcctgagttcaaatcttttgtctagaacttgccttctctgaaccttaagagttctttcacctgaataagaggaaaggcaatctgtcttgcctacctcaagggctgttgtggggacaaaatgag

SEQ ID NO: 153714 - DNA, 264 bp, Homo sapiens
ttaaaaaatggaatgaggtgggattccctccttctcaaaaatgtttctagagctactaaaaaacttgcatttacaaaatagttgataaaaatagtcctctggaggccgggcgcagtggctcacgcctgtaatcccagcactttgggaggccgaggcgggcggatcacgaggtcaggagatcgagaccatcctggctaatgcggtgaaaccccatctctactaaaaatacaaaaaattagccgggcgtgatggtgggcgcctgta

SEQ ID NO: 153715 - DNA, 396 bp, Homo sapiens
ccaagcgagccacagtctgcttaggtcccacaactggtaccaatggcactggggccaagccccacgacttctaattcccaggtcactgctcaccattcctttaactcctccactatgtcctcaccttggcttacgtgtttgtacatattgtcaatcctccatgcagattcaaatttgacttcatatacttccactcatcttggcagagaaaatggactttatagtgattgttttgatttctttctttgcgttgtaacttaggttttattatagcatatccagtaggacaaaagtcacattgaaagactattgtgagtgaaatccagtctttgattgccttgcaaactaaagtgtacaattacaggtttgaagacctttcgatcggtcggccagggg

SEQ ID NO: 153716 - DNA, 162 bp, Homo sapiens
tgagagcttctttttttaaattaaatatcaagtttagagaagtctagagaacaacattgcaatgccctatgcacccgtaattcagctttgttaattcctatcactttgccatgtttgcttcagatctttttgtttggtttaataaataaatcattgcagaac

SEQ ID NO: 153717 - DNA, 388 bp, Homo sapiens
cctctctttcaggttgcaagccggccaatgccggtccacacaacaagtaagaggccgtgcgtggaccctgaactcgctgatcgctcagctaccgaaatgtctggcagaggctccgtcttggcttcactgtctcccctcagaaaagccagtctgagatcctcctcaagtcttggaccaaaggaaagacagacaggtgctgcggccgacatccctcagcctgcagtcaggcaccagggccccgagcctctcctcgtggtgaagccgacacacagcagccgtgagggtggctgccgagaagttccccaggctgcctccaaaacccacggcctgctccaggccgtcagaccccaggcacaagacaaacgtcctgcggtgacctgacagcccg

SEQ ID NO: 153718 - DNA, 486 bp, Homo sapiens
ttgggcccctcctattccctagaagacattccagttttcttacagctgaaaggtcctttggggatcatccaggttcacccctgagacagaaagactcactgacttgcctgaggccaaaccgcttttcagtggctaggacctaggctgtccctcctgtcctgtgatcaggtccctgctgcagtcatcctgctgttaggtgctagagacttgttaaagagaagacttaggtggggtggtagtgtgtctgctggctttcctgttgtctgaagttggggaaagcgtgttgcccagatgatgtgagcaattctgggggtggaagacaagggcgcagggaatatcaaagcaattcaaaaaaacctctgacactgtgtaatggcttaggtggcttaagaggaaagctgagggtaatgtttgtgatttggaggctgtgtgattttaacaggagtttgatgtttgccttttcaagtaggagctggagattaaagg

SEQ ID NO: 153719 - DNA, 788 bp, Homo sapiens
gtagatgggactacaggtgcatgccaccatgcccggctaatctttttgtatttttagtagagatggggtttcaccctgttagctaggatggtctcgaactcctgacctcgtgatccccccacgtggcctcccaaagtgctgagattacaggtatgagccaccgtgcctggctgaacaactatttttagagcacttcctgtgataggtgagccctgtgctagggtctagaatacaaagctgaacaagagacatgatctctaggtatccttataaaggtagaaagtgttcatggtgacagattgggcacctgaagtctaggcttcctggagaaaatgttgttaaaattcaagcctaaagagatgagtaagaagaggcccactgaaagaatatttgttgaagtagtcaggacgtgagaagtgagtctcacaggcatcgatggggcagcattcattcagcacttgatgtgtccctggcactatcctggggatagaaggatgagtgagatatgctttttttctttatcataattattttagcaataatgtgaccttgagggaaaccacattttggaatcttgtatgatttccatctgttttctccaatggaatagtgcaaaatttttctttttagcttgcccctttagttggcctcctgctgtttctttttccttttggagggatatttgtaatacttagttcatttccagagagcggagacaggcagaccatgagcccaatggataaacaagtcttttcctgattaggttaccagttcaggaattttcagtt

SEQ ID NO: 153720 - DNA, 386 bp, Homo sapiens
agcgccagagacgtggacattacaggatggaggggtgagtgtagggcagatcccttggggaggggagcggtctactgacctgtgaagtgttagccttggctgagaagatgccttcagctgcaagtgacagatgacccaacaaatatggcctgaaccatgaggagtacattatctcatttcaaggatcaggaatagacttccaaggacccacccagctcaaggatccaggtcattttctccactagactagtgaccgtgtccttggttgattccccagtggttttatggctctggcagctgcaaacacaactcaaggtggccaaagacagagctttctccccttgtccctccgtcggggaggaaaaccctccctatgagtccctgca

SEQ ID NO: 153721 - DNA, 197 bp, Homo sapiens
tgaagcctcaccggtaaactgtctaggtagtgatttgctacataaatttaatgccatcatgcaatgtaatgggaaaggtgtttttattcccctgacctgagaccaaacttcaaactttctattttccctaattgagacttgtcctctgaagaggatgcaacctcaagtgatgttccaactacttctaatgactgatg

SEQ ID NO: 153722 - DNA, 451 bp, Homo sapiens
caccactgagctgccacgtcctatcccacatactcccttggatgtccaatcccagtctgtagccattccgggccagatccccacctggctgaggtgctcactgttgttcctgccctgcagggctgagagtctccaggctcaccgggggagctcttatctcacctgcctccccctaccccctcctcccaggcacaattcaggtcctcagcctgctctgtggaggtgactcaggctgccagagttcacaggggtggtgccaccaccaccaaaaccgatccacccgcctttcctcaacaggcccacgagtatcttcctagcccctacccagccactgagtagatgaggcagcgggggtgggggcgttgggagggggtcagcgtgaattaccattttgaccttcaggtgagccacagtcttgggcttcattagcttcagtctatactagcacttc

SEQ ID NO: 153723 - DNA, 309 bp, Homo sapiens
atgaatgatcctgtcatgcaggtagtaagtatagtacccaaaggtttttcaacccttttcccccttccttagcaaccccactcagcagtctccagtgtctattgttcccaacttatgtccaagtgtacccaatgcttagctctcctgaggcccaggagagctgatggtggtgttccagtgtgagtccgaaaacctgagacccaggagagctgatggtggtgttcccgtgtgagtccgaaaacctgagacccaggagagctgatggtggtgttccagtgtgagtccgaaaaccatacgcccaggtaagca

SEQ ID NO: 153724 - DNA, 210 bp, Homo sapiens
ttactccattttttgaccttctcttttatctactctggggaaaagagataccaggatctcatccactgctctggctcctgcaccacctttgcctcaagcacaccctgcatctcctgtctgaagccctcacctgtctccaagacccctccctccttttctcccaatgagacctgctcctccatgaagtcagcccagccatgactccaggaa

SEQ ID NO: 153725 - DNA, 272 bp, Homo sapiens
aaggacattggatgtaagtccagccctcattctacaggaactggggacccagaggattcaaatggcttcccaaggctccacagctattgtgcagagccaggactagatcccaatcttgcaactccacctggtcccaagatttcaggaaagaagctgctcacagggaagacttggaactaattcatttccgggaaagacacagccgtggaggcctggcagggtatagagagtgagggcatggcagcttcggtttcttccccatgtcttactca

SEQ ID NO: 153726 - DNA, 727 bp, Homo sapiens
gtgcatgccatcatgactggctaatttgatttctttagaggtgtgtttccagggctggtcacgaactcctgggctcaagcaatcctctttccttggcctcacaaagcactgggattacaggagtgagccactatgcctggcctttaagatcacgtttgaataaaagattcctcagctacaatgtagttagaaaaccaaatctcttgcctacccctgctttttcctgtaaggaaaccctggcctagaggtgccaccatgacattggaaccagcctggagaactcaggctccaaaccaacagtgcctccctcctttatggcccagtggcctaggcctggggtcagagtgggggcttcatggcatggagtccattttccttcttgtcactctgtatgatttgtgtgatactttttcttccatttctgtttcgtgtcagtctcccttgtgggacactctaaggtccacaggggcaggaatcacatgttttcttatccacagtgtctccagggcctgccactgtggctggtacacgataataacaggaaacacttggaagatgctcactgtgtcccaggctctgttccacatcctgcacacacattcacacatttaatatggaaccctaactcaacatgtgtgcagaattaaaggcttcacgtcacttctgcatctgggtttcttcacctctttgaaccacagcgtcgtcatctgtaaaatggggaatagca

SEQ ID NO: 153727 - DNA, 231 bp, Homo sapiens
catgattgctacaccggctcctttacatgggctctgatgtgtaagttctgggatctcctgacctcgtgatccccccgcctcggcctcccaaggtgctgggattgcaggcatgagccaccacacccagcctgtacacgatgttttgagcaaaagctcaaggatcaccctagaacccaggcagcagggtttagacaaggggttgggggagaggatggtgaaccagaaacaggg

SEQ ID NO: 153728 - DNA, 393 bp, Homo sapiens
ttgtggttgtggtgggagagcatgggccacagaaagagggaatggtggtgtcagagagtggaatttacagtcatagcattttcaagtattttcatgttccagtgtgtgatcaagagagtggactactgaggcgaagtgaaggtgaatgtctttggaattcaggagaaatcgtgagattaaagtgatctgtgtcatcccctcatatgttaatgtgtcttgcaaacatgtcaggatctcatgatccaacactctagagctgttgccggtataaaaccaatgtttcatttcagtttcttttgctgaactacctagaatctatgcaaccagtaacatgaaaggagtaagatttagtctggttttgtgttgctataaaggaatacctgagactggggg

SEQ ID NO: 153729 - DNA, 150 bp, Homo sapiens
agaagaaatgacgtgtgattaagtgttgttgcagagtgaagtataaggatgctattgggaaggaaggcagttaagcagcagagcacataacccagtctgtggtagggtaggtggggcagagaaggctttctggaagaaaaaattacattg

SEQ ID NO: 153730 - DNA, 245 bp, Homo sapiens
ttctttcctttcctttgaagttaagcaccagaattcctcaatattgcctacaaggactatcatggtcttaccctatctacttttccagcctaatttcatataacgctcaccactgggacatcttcatctctcttccattcattcacatacacttcattttatgtcttcatttcctctgcttcttaaaattcttgctttataaaagaaaaccatcatggtgggcagacacaaattggggctgacaa

SEQ ID NO: 153731 - DNA, 608 bp, Homo sapiens
tacttgttgccaactagcagaccatagcagaaagtctgtgatatctgagggaaagatggagaaagtcttcatttctgcttcagcagatttcagttagtctctgacagttggggggctacacatttgggagcaatctcctcagtaatttcttggatcttgctgtcagtaattccagtgagtcaagaccatgccttgcttctctcatgggttttgtaggacccaatcacagtttctgttcaaatagccactgaaacatctactcttttctacacttcactgtaagtgtgttagaacacagtgcgttttcattcctctttatatctttttatcctgaccttctagatcttatttcccatttcatttatttttattgtttatttttcaagacagagcctctctctccctctctctgtcgcccaatctgcagtgcagtggcacagacatagcttactgtactctcgaactcctgggctcaacccatcttcatgcctcagcctccccagtagctgggactacagttacacactgtcacacccagctaattttttaaaaaattatttgttgagatggggtctctctatgttgcccaggctggtctcaaactcctg

SEQ ID NO: 153732 - DNA, 176 bp, Homo sapiens
cacctccctccatccagtgtctcccttgcaggagactcttccctcctctactttttccctgagtgttcatcctgctccacaaaatcatgttctcagagaaggcatatattttaattgagatataatttaccgtaaagcccataatttgccaggtgtgatggatcatgcctgtaatc

SEQ ID NO: 153733 - DNA, 439 bp, Homo sapiens
attactacagctctgccaacgggggagacagaaaggtgcacattcatggggattgggggtgaattttcaaaagacacacagcccattctgattaccaccatagcaagccacttacgcatactggtggttacagatccctgaggtgtgtgtgaggtagcacaaatatgataaaagctgcttttagaggctcttgtgatactatgtaatcagtcatgttcacaaaataaatagagttaaaaagaaacttagttttcacttagttgagccctcccctacaaataaatgaagcccaggccagcatggtggcccaggcctgtagtcccagctactcggaggctaaggtgtgagaatcgcctgagcccgggaagatcaaagctgcagtgagccgtgatcgcaccactgcactccagcctgggtaacagagcaagaccctgtttca

SEQ ID NO: 153734 - DNA, 571 bp, Homo sapiens
agttcatttttgtgttcccattttctaaaaaaaaaaaaaaaaaaaaaaaaactcacaaaaaaagcccaagcctttgtggggtctgagtcgtggcgagtgcggcaggtgagggtgcgcagacccacgaccccgcctctgcgctgccgcccccccttcctcctggcggggccgtgagtctggaaaccatttcccttcattgccttggcagtgctccagccctcccgtgatgatttccctgtggctggtcgggggtcattcaagtccaggtgtgccttgctctttaggcatgatttagattggaatctcctgccttctctgaagaacaagtgctttctgtccatacctcctgcctccccaaagaaaagaaaaaaacagacattaaaagtgaggctcagccagcaggaatttatagtcagagttgccccatgcatgtcaattatgcttaccttacaattttagaacacggagtatgtatttcaccctgtatgcccttgtctggaaaataaaggtaattaaatctcatgccgtcatgatttgaacccaaagcagcaatgtaaaacaaagccataca

SEQ ID NO: 153735 - DNA, 464 bp, Homo sapiens
agagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaa

SEQ ID NO: 153736 - DNA, 763 bp, Homo sapiens
ggtcatgaggccagttctgccattgtgtgatctgtaagtggaggtcttcttctttgggcctcagctataaaataaatgagtcatgttactgtggctttgtttggttttgttgagacagggtctcgctctgttgcccaggctggagtgcagtggcacaatcagctcactgcagcctcaaccatctgggctcaagtgatcttgccacctcagcctcccgagtagctgggactacaggcacgcaccaccacacccagctaatgttttcattttttttttttagagacagggtctcactttgttgcccaggctggtctcaaattcctgggctcctgtctcggtctcccaaagtttcgggattacaggcgtgagccgccgcacctggccaggttactgttggtataggaagtctacccgcaagtttagggagctggaggcagccctaacacggagggaagcattgtcttctcatgccaggtttagctcccaccattagccgcaaattttatgtatttatttactttttgagatgaagtcttgtgctgtcgcccaggctggagtgcagtggtgtggtcttggctcactgcaacctccacctcctgggttcaaatgattctcctacctcagcctcccaagtagctgggactacaggcatccgccaccacactctgctaattttttttgcatttttagtagagacggggtttcaccatgttggccaggatggtctgaaactcctgacctcaggtgatccaaaagtgctggg

SEQ ID NO: 153737 - DNA, 841 bp, Homo sapiens
gacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatc

SEQ ID NO: 153738 - DNA, 177 bp, Homo sapiens
tgagcatttgatcagtggactgagtgaagcagcttggcccacacagtgtgtgtgggcctgttagaaataccaaaattgttagaaatagataatcggtgctgcgaagaagagtcagcacagagacaaaagatctctcagcaaggccatctttactttctgcagaaagggtgctcaact

SEQ ID NO: 153739 - DNA, 160 bp, Homo sapiens
tcctccaaaggctccagggagggtctttccagctgctggtggctgccagaagcatcactctgatctctgtctcctccttcacatgaacttcttccctgtatctctacgtccccactctctctgtctcttttttttttttttttttttttgtgagagagtc

SEQ ID NO: 153740 - DNA, 334 bp, Homo sapiens
ccattccatctttaaaatcttacgattccacagaggaagaaaaaggtgatctttatttggaagaaaggaagatcttggtttgatatgtaataggaaagtaacaatgctattaggcaaggttgtttaaatatgaattaatgcctatcccattatctagattgggttaacaccctctggtgatattatatatcagtgtttctactgaatactggataaacgccaaacttctctctggcatttaaggctttccacacctgcccaactttatctcaaacttctcatggttcagacctctaaccctctgctctagccccagtcctgtttccttatcacc

SEQ ID NO: 153741 - DNA, 174 bp, Homo sapiens
gctgaggaagatgctgcatgaggaaggtcggagcaggggagctgtcaatgtgggggcagcatgctgagtcatctgaattttgtcacctttcttgagatttcaccaattagagattacatgttttaatatgtccttttcagtatgaagaatactatattcagggggctctgagaa

SEQ ID NO: 153742 - DNA, 292 bp, Homo sapiens
tcagaaggatgcaaaaggaaaaacaattattaaagacgaggatggcatttattcgttcttataaaaataatttatttagtagctgcagtctctgttctctctggctttccctggaaaaagacaccactccagactgtccagggctcccctggtacctgtgaatgtgctgttagttcctggtctggttagaagatgatgtctctgtggagatacatacttggcctctttctttctccctggggtgagggacattttatgtataggagatggaagaatagacggtctctttctc

SEQ ID NO: 153743 - DNA, 552 bp, Homo sapiens
tcttcaagcaaagtgttttgaaaacaaaagtcaggatctgtattagtccattttcatgctgctgataaagacacacctggaactgggaagaaaaagaggtttaatggacttacagttccacatggctggagaggcctcacaatcatggcagaaggcaaggaggagcaagtcacgtcttacatggatggtggcaagcaaagagaagagagcttctgcagtgaaactcccattttaaaaccatcagatctcgtgagacttattcactatcagaacagcacaggaaagacctgcccccatgactcaatcacctcccactgggttcctcccataacatgtggaattcaagatgagacttgggtggggacacagccaaaccatatcagggtcttaattaacatctggaatatagcatttcaacctaattaggactacacttcgttatacacattatctttttggaatttttgtggttccaaaagtgctgaatattttcatgtaatcttaagtgctataaataagaaaattaatactttctgccgggcatggtggctc

SEQ ID NO: 153744 - DNA, 449 bp, Homo sapiens
acaggaggctctcaataattacttgttcaatgaatgaatcttagatttcatactaccttttcctgacttcctagactagatggcaaactcttttatttacttttagcaactgtaccttccctttgaaacatttactgcaactgtaattacaaaactgtataatgtaatcttgatcttattctctacaggttgggcatccctaatccaaaaatctgaaatccgaaatgcttctcaatctgaaactttttgagcatcagcatgatgccaccagtggaaaatttcacatgtgatctcatgtgatgggtcatagacaaaacacagtcaagaccgggtgcggtggctcacacctataatcccagcactttgggaggccaaggcagatggatcaccggaggttggaccagcctgaccaacatggagaaaccccgtctgtactaaaaatacaaaat

SEQ ID NO: 153745 - DNA, 190 bp, Homo sapiens
tgacttacaagggaggtttctgtccagcaatactatacatcaggaagttggggtaaatcattcacctcctggaacgctggtgccaagggactaatacttaggcttatgttgcaaggtgctgtgatgctgtgaattgcaatctcaaattaggcactagattaattgtttcctggagatcaaaactctagta

SEQ ID NO: 153746 - DNA, 515 bp, Homo sapiens
ttcctagagttccattcctacctccttacttccccaatgacacacccactttcatcatttctcctacaggtgattaagtctaaactgacatttacctaagtcctcattgtctagttctatcttgatgtccctttggcctcctacatatctcaccacaaacattttttgctatatctccaaccttgctcagttcaattgcttaagccagaaaccagtcatccttgacatcctttccttctcctgtactccattagttacaaatcctgtcgatcctacttcagaaatatcctgtactacaagcatccttaaaaaccttagcttaggccatatctctcttaagaactactacaacagcatttatttctctggtatcagtctcttctaacctctaatctattcttaaaattatcttggttaccttaaaaaaaaaaaaaaaaaaaagacaggtgccgtggctcacgtctgtaatcccagcactttgggaagccaaagtgggcagatcaccttaggtcagg

SEQ ID NO: 153747 - DNA, 381 bp, Homo sapiens
  misc_feature (364)..(364): n is a, c, g, or t
cattgtgccaggtgtttaacacacctcattttaaccctactatcacctattttatagaggaggaaactgaggctcagagaggaggaagtgaccctggacaagtcacttgacctccctaagcctgagctttctcattgtttaaagaaaggaataaaatggtgtgcttgtgagacagagaaccggggtagcacagtgaaggtgctctccaaggaggtgcaggagttacccatgtcccctgctcccgcctgttccgggcaggaccgtgctcactggtgggcacgggcaggtgtccaaggcctggactgcttcccttccacccttggcttcaggatggcagggtggttctgccccaagggttaaggcntcccggggtaccgagct

SEQ ID NO: 153748 - DNA, 561 bp, Homo sapiens
gaattgcttgaacctgggaggcggaggttgcagtgagctgtgagatcctgccactgcactccagcctcggccacagagtgagactcggtctcaaaaataaattcataaataaataaaacaaacataaaatcagacttttacatgatggcaattaatccgattttctttagcactgcaggccaaccagatttgggttttacgtggatctggcccgaaggcttcctgtctcagacttcccgatctagggtttctgttgctttttgtacatgctgcttcactgctgtttcctctcactgacagcctttgaaagcatatggtcttcaatggttgtataaatttccatcatgtggataagccatcatttacgtaatcattcttgtactgttggctttgtggactgtttccaattattccttactaagtgctgggattcggatttaaattcgctggcccatggtggctactgaaccctgctgtgaaccagcagcaccagggcagccagagaaaatgtggatttccaagctcggctctcaggctttctgaaccagaattgccaagggg

SEQ ID NO: 153749 - DNA, 318 bp, Homo sapiens
cccacagggtaggatgagtgagaatggatattaggaccccgtgtcagtcagataagctgctactcctgggagcacagtttctgagaagttacccaagctcaatgtctcgaaactaaaaaaagggaaaaaatacttctcaaaatctatgccaaggaaaattatttcataatctgtattttggtattgtcatagtgaatggggtaagcaaataacaatacagacagcatgtgctttgttctaacattgccaaaattagatcagagtctgggataagatcactagcaacagacattgatttttcacatggtacctctttgg

SEQ ID NO: 153750 - DNA, 629 bp, Homo sapiens
  misc_feature (474)..(474): n is a, c, g, or t
acgggaactgctttgttcctgacagcgcagggcaggggccgttgaccaccaggaagtagcctagtacagtgggaaggactgggtctttgaagttggcccaattcaggtttgaacgctggctcacaccacttgccagttttctgactttggataagccacttaagccatctgggcctcaggttcctcatttgcagacatggggatgatagtatgaatttaacgagatatgaaaatgatacaactctttggagcagcagtgtggtgtagaaacagcttgggctttcgtgttagaatgctgttcagatctcctgtctgagccagggacacaggtgggcacagcacttgagcccaggagttcaagaccaccctggacaacatggtgaaaccccgtctttacaaaaaatagaaaaattagccaggcatcgtggcacatgcctgtagtcccaagtactcaggagatcctcccagctcggnctactgagtagccaggagtacaggcaggtggcagcacacatctcacctcattgtttttagatttatcctctgatcttttctagtcctttcttctcccattcttataggggggaagagggagtagggtgggcccctctcaggaaaagaaggcaaca

SEQ ID NO: 153751 - DNA, 231 bp, Homo sapiens
tatccccctcctgcctccccttcctttctctttttgtgaagaggtgctcaggcccttgatggggtcttctcgcccctgcaccaccctttgttattcatccttgagaggtttcctttttttttttttgccatctttatctctgtcccctactgccatgttctcagtatggcaaagggcagaacatggacttttagtgacaatgactcagtggctcaaaaagcctttttggat

SEQ ID NO: 153752 - DNA, 346 bp, Homo sapiens
actcaagcttttatcttgtctttctcagtgctgtttgcctgggcaaccaactgtaggatgaggggaaatgtctctttacaagaaagtattccagctaataaataagcaagaaatgattccactagaatagcaccatttgtagcccctcatgggccaacggcctcgggtgctaataagcctcagggactgctgatgtcacaaaggaaagacaggcaggcaggaggtgcctgctgaggctgagtcacaaccactaaggagctggcaaaaggggcggaacttatgggcctccgaatcgggcagcaccttgcagaaggacgggcctgaggaacacactgaacagcagcac

SEQ ID NO: 153753 - DNA, 392 bp, Homo sapiens
tttttttctctcttaagatgacaagaggagtaaagtgagaagctttaaaactgaggttaaaaaagtaaccaaagaattctttaggtataaggctaagagagagaagcaagggaaatatctactacctcaggggaagaaaaattgatggcagatgattactgaggagcaaatgctcatgtctttaatgtaatctttctgcagatcttccactgtgatcagatcaatagagcaagttttgtctgtgatgaaccaatcggaggagggaaggacatgattgcaaagttgcatacatgtaaagcaactgattcggatgacatatagaccaaaggactccggaaatgagtgaaaatttttgttgagacacaagctaatttctagaataactttttcct

SEQ ID NO: 153754 - DNA, 388 bp, Homo sapiens
ccttaagcaagttactgaacctctctgtgcttcagttacctcgttgctaaaagaattggcaagtgacactggtgttcggaaaaaataaagtaaatgaagatggcgatgatcatgataataccctcctcatgttgtggatattaaatgggtcagtaaatgtgaaatgaaacactcaaaacaattcctggcacataattaagtgctcagtatgtgttgccttttattaattcattccacatttgaatgatatttgagcatctactttactaggttatggaaattcaacaaaataaaaacagaccttgggccgggcactgtggctcaagcctgtaatcccagcactttgggaagctgaggcgggaggattgcttgaggccaggagttcaag

SEQ ID NO: 153755 - DNA, 362 bp, Homo sapiens
ttacggtcatcctcagttgcagaagtataatgtttatggctggagtcattttatttttaactaacattttttaaaaagattgctttgtaacaatgtgttatgagtcctttgtggtaaatactgctttttttttgagacgcagtctcgctttattgcccaggctggagtgcagtggtgcgatcttggatcaccacaacctccacttccggggttcaagtgaggctcctgcctcagcctcctgagtagctgggactacaggcatgcgccaacgtgcccagctaattttttgtttttttagtagagatggggtttcaccatgctggccaggctggtctcgaactcctgacctcgtgatctgccca

SEQ ID NO: 153756 - DNA, 474 bp, Homo sapiens
aagcacagcctcaaaatctgcaccaagatttctgggcagggaaaaagttatcatcaggaaggcacagacttgttagcgaaatgctctgacctagcccaagaaaccaggtgcttctctgctcctgacatcaggcttggccaggctgtcaagtgctccaaaaagtgctccaactttgatcctgcccatctagggcagaagctgaacggctcaacaatgatactactgagctgagagccttcagcaagtcttttccaagctgcagcctttgcttcttccctagtagagagtagctgctggtgataaccagtaaagaccttctaaaaccaggatttgaattctgttactactggagacactgagaatccggaacatggtcttttccacctcaggaaccatcaccataccccacctgaagagtagggcctcaggcagtttgagagtgaagttcccagggacttccagtctgagctgctg

SEQ ID NO: 153757 - DNA, 156 bp, Homo sapiens
accctttctcatcaccatcccctcatctgcccaaagggaatccctcacactctcagctgtgtccactgcactctatgtacagctcccttttaccacttaccaagttggactaagtagctttttccttccctcaaactccctgtgaggacagatgat

SEQ ID NO: 153758 - DNA, 193 bp, Homo sapiens
agacaggcccaagcataaacaactacaaagaaatataacctagttttaaaaaaaaaattgcctattttgttaacacgctactataacatctcaaatggtaaaaagatgccttactagtcttttcatgtattctctcaccatttggataaaataatatttacattgagtaaattcttcctcctcccctcccttc

SEQ ID NO: 153759 - DNA, 489 bp, Homo sapiens
tacgataacagcatatgttaaattcaatttccttgaccaattggataaatatattttggtgttacagtatggttgtttttatggtgagtaagtgtgtatcctacactctgtgttctattttccacctgggtggtgtaacatatcaaatgtttaagaaaaataaggacaccattctaaagagatcaggaagctattgctaaatgttattctgggggggatttcaaatagatgttagcgagatacctactgaattattgaggatatgaactgtacaaccgtataataggacattataaatatgtaggctggtatacacctgttttgagtaaacagtatatttttcttatcaatcttagttctatcttggtggtttgcagcccatgagaccaaagcgttttatgattaaacttaagagcctgggcttcagtggccagagatgatgcctgttagcatcatttagtggggcattggaatccgtgcgcagcccgg

SEQ ID NO: 153760 - DNA, 340 bp, Homo sapiens
tagctcatcctgagtcggctcagtctcttcttcagacttgtcctacaaactccccttttcagtgttgagccttgaatacatttatgtctgctgccacggctgagtcactgcctaggtgctgtgtccatactgtctctagaaggctgcctggccctgaggctgagaggaagcagcgtccagccagacaccgtcgggggttaggcttttaaagccaaacccccaacatatcccagtgatgactgcataagtgttatagtctaagataatcagagcagaatgtgcctttaaaaatcaaattcttattgatgtcttaagagaggaggagaagatggttaggtct

SEQ ID NO: 153761 - DNA, 280 bp, Homo sapiens
  misc_feature (260)..(260): n is a, c, g, or t
  misc_feature (269)..(269): n is a, c, g, or t
acgcgtctaagtaacatttttgatagcaaatgaaaacaaaagctggccaagaaactgtgtattaataagtcatttgattaaaaaaaaggacttggccaggtattgtggctcatgcctgtaatcccaacacactgggaagctaaagtaaaagctgaggagttcaagaccagcctgggcaacacagtgagacccccatctctataaaacaaaaatttttaatattatctttttacaaaggacttatttatatggcagtactntgggatccnctagtaacgcc

SEQ ID NO: 153762 - DNA, 492 bp, Homo sapiens
acgcgtctaagtaacatttttgatagcaaatgaaaacaaaagctggccaagaaactgtgtattaataagtcatttgattaaaaaaaaggacttggccaggtattgtggctcatgcctgtaatcccaacacactgggaagctaaagtaaaagctgaggagttcaagaccagcctgggcaacacagtgagacccccatctctataaaacaaaaatttttaatattatctttttacaaaggacttatttatatggcatcttcaagtatttcaaacatttcgtgtttggattatggaatatgtctccagaagaattaacactatttctatttaaggtaattttacatcatttcctttattagaagaaataacagatctgcagatggcattttgtgaaggctgccttctattaatagtgtacaaaacactcatatgtctccaaaaaggtgggtgagtaatcacaaagcaagtataactattcatcccaaaaggtagg

SEQ ID NO: 153763 - DNA, 548 bp, Homo sapiens
gaggcttggtggggagtgacatcttaggcggagtgagagggatgaagaggcatggaggacaagccatggaggctgctgtgtgtcagtgaaagcctttggactttgccccgagggtagggaagtgacatggtcagaccagcctcttctggccatgttcggggaacggaccatgggagatgtgagaggatgtgggcatcaggtgggcaagaggcaggggtctggatgaggtgttgggggtgccatggggagaagccagggctgcccctgggtgcaggtgggaaggaagaggctgagaggtgggactggcttgagattccgtggatagggtgagtgagggtcctgatggagcaggtgaggtagtgccaggagctgaggggtctcctctgagaccaatgcaaggaagtggccccctggggattagaatccagctctgacttcacagcttgtgatctttccacagcatctcagtaagcctgatgtcccgcggaggcctgggagtcccctcttccctttggctctactgagccctgcaggtctcctgggagccc

SEQ ID NO: 153764 - DNA, 295 bp, Homo sapiens
ggaaggtgacagggtcagtgatggaattcctcagacagaggaaagggaagcctgaatgtcattctagagtgagaaaaacagggtgtagggctttaggaatagtctgagggaagtagacatacagctctcagagaaagaaaggaatgagatgctctggttagcctacatcctctgccaccagtctccaactccaccacattctaacgtgtctctctcatgactctggaaataatggagctacctgttttaatatgggtcagcatgctttgggcttcaaagaaacctggccaggctt

SEQ ID NO: 153765 - DNA, 245 bp, Homo sapiens
acaggtgcctgccaccatgcccaactaatgttttttgtatttttagtagagacagggtttcactatgttggtcaggctgctctcgaactcctgacctcaagtgatccgcctccctcagcttcccaaagtgctgggattacaggcatgagccactgcacccagcctgcttggccagcttctaatcagatctcagctgaagtacttggcaggccgtcagaaacctttcacaccatccacgctgaagc

SEQ ID NO: 153766 - DNA, 323 bp, Homo sapiens
  misc_feature (22)..(22): n is a, c, g, or t
agtccatcccccttcgtctcgnccaagacgatggggaaaagtcactgaaggcatttcatggcttcacttcacagcactaattttctgtatgatcataacaaaaaggagtttaattggctcatggttctgcaggctgtaaaaaaagcatagtggcttggggaaatggcaggtaaggcatcactgtattttgcaaagtgagaaggacatgagatttggggaggcagggagagaataataagatttggttgtgtatccctacagaaactcatgtggaattgtaatcaaaatgttaaaagtggggccaggtggaaggtgatttaatc

SEQ ID NO: 153767 - DNA, 382 bp, Homo sapiens
ccatccatgggtaaatcctgctcagcaataccttcaaaatatccccgaaatgcaatcactccttactacctcccaatgtcaccacctgggtttcaaaccaccatcatcctttgcctggattatcctgccagcctcctagttggtctcccggcttccttctaagtctccctccagttgcccagatagcatctggcataaactttaaaataatttaattttattacatcattccttcatggcttcccatcttactacaaataaaactcaaagtacttcttagcacatttatgaagtcctacaagtacccccaacctcatccgccattctctcccttggtttccagagacactggcctcctgccggcctcactccaaccccagtc

SEQ ID NO: 153768 - DNA, 440 bp, Homo sapiens
aggagaaggatcgtgggagcaaggtcaggaaagatgaccagcaatgccggtgctagatgcagaggctggtggagaaacgtgacagaaaggaagccaaagttcactcagtgaactggatgcatggggctccaggacagcagtgttcaggcttgatgcgagaaatgatgacgactcggctggggaaccagctggccgcgtgggaggagctgcccgtttgttgactatctcctgtggtaagtttgttttgagtagtctgatcccactgttgtggctgcaacaaacgtttctgtacctggttatcatgaatacctcgttagctggagcccatggagcacagggtgctggagacaatacggcaacaagcaggcaggtgaagggtcttattcctcttgctctgtagccctcgtcaacgttttttctttttttagatggagtctcac

SEQ ID NO: 153769 - DNA, 572 bp, Homo sapiens
agaaatacctgaaactgggtaatttataaaggaaagaggcttaattgactcacagtttcgcattatttgctggggaggcctcaggaaacttacaagcatgggggaaggcaaaaggagaaacagacacctccttcaagagatggcaggagagcgtgagagctagagcaggaaaaaattccacttttaaaaccatcaaatctcgcgacactcactcactatcacgagaacggcggggcggtggggaattgccccggtaatccttccctccctcaacacgtggggattacaggtccctccttggcaagcagggattacgattcgagatgagatttgtgtgaggacacagagccaaaccatatcagtacccaatgtttatggttttatgtacttgtgaatggcctccagctggatctgtatggctgcaaagtacatgatttaattcttttttatgattatgtagtattccacaatgtatatgtactatgatttctttatctaatccaccattgatgggcacctacgttgattccttgtctttgctattgtgaatagtgccgcaatgcacacacaag

SEQ ID NO: 153770 - DNA, 258 bp, Homo sapiens
ttcaaggaagaatggaggtggggcgcatagctggcaagaaaccccgtgggaacaaagaaggtattttcgtgcagatcttcacccagaaagcctgagttggcctttcagtggatggtctgtcagtggaagccctctccttggttcccattgctccctgtctctttggattaatgatttggcttgtggacattgcccaagtctgagcgtgtgtggaagacccctgctggccggcaggcttctgggctgtctttgggtttt

SEQ ID NO: 153771 - DNA, 584 bp, Homo sapiens
attttttaaggctcaaaagatacaatgtctctactaagagtaactaaagtctgaattcttgatccttgaaattaggggacaacagggatttccataacctgttacacttcagttcaggatatagtttctctctgagtagctaattatttctgtacagctaaaagtctaattatttgctttgttgaaggagtacttaattactggctctgctgacatctaacaaactgtatttcttcttattttgaagatagtatccttctgtgcactctaaaatgttacaatttactgaaagctacgtgccaggcactatgcttttctaacactataccactcactttatatgttttgtagctaatttaatcgtgactctgaagcaggaatcattgttcgcattttatagaaaaggaaatggagggttggagatatcgatacacgtatacttaaaaagcgattatttccatcatttgtggccccagtgctcagcaagagtcctggaaatacggtatcttccctcaaggagctcccatacacatcctgagggcaggatggtatatttccaatgctcaggagatacaaggaggtgc

SEQ ID NO: 153772 - DNA, 304 bp, Homo sapiens
ggtccttcccaccatttgctgcagaggaactgcttctgtctcctccgcagagatggatggtatgctcaggcttcccaattagcccacaagaaaactgtgcttagagagtccacgctcctcccagagctagcctggggaaacgggagagctgacaggaagaggggaaagtggtcgggtaaggttgtatggaggcaaggttcacgcttcattcgagaggatccatgggagagaaagcaggggctgtgagaaccagcctttcctcctccaaaggtctctctgacacgctgaagggaggatcagagtg

SEQ ID NO: 153773 - DNA, 351 bp, Homo sapiens
aatctgagcgcgtttccgacagggaaatgtctgcatgtcttaggtggggacatcggcggccccctgcctgtccattatgctcgttctggtggggacattggcggccctctgcttgtccattatgctcattcttgggagatgtgggactgtttgttactattcaatctgatgtacagagggggcggagagagacccctcaaatgtgcaggcgtgcgtgtagagattccagactgactattctaatcctgttttgactgatttaatctggttttagtacagcttggcccaaaaggcttgagccagtttacactggtctcagctagttttaactggtgggctccatttgaacat

SEQ ID NO: 153774 - DNA, 134 bp, Homo sapiens
atttaaaagaaacaagattctgtgttgggttctgcttttagcttatggattttagacattgtccaaaagtgcttccgatgttgaatgtatgttgcaagtgttatgtagaaagaacatgcttatgctgttgtaat

SEQ ID NO: 153775 - DNA, 408 bp, Homo sapiens
gttatttttgtgattcctattcctgtatggacaccaaggctattgacattttctttagtttcttctgttaattctattttcttagtgtttatatcatttcatagataggatattctttattttttatttttatttaaatatttggtgattcttggttttctcagccatctattgtcaagtgttcttattaagcattgttattaaataaagattatttcctctaatcacatgagaatctttatttcccccaagtaattgaaaattgcaatgccatgctgccatgtggtacagcatgggtttgggcttgctttcttcttttttttttaacttttattttaggtttgggagtacctgtgaaagtttgttatataggtaaactcgtgtcatcagggtttgttgtacagatca

SEQ ID NO: 153776 - DNA, 287 bp, Homo sapiens
tacattgagtgtaaggtgggaacttgactagtgattgattgacaaagcagtgtaaattccataaccaccccatttgcatagatattgattgcagtaggttcaaaagactgattatgctgcttttcagatttgaaatgaatgtcttttagcttaggccttcagaaaaaccaagactgcaaatgttaaagaccttaaatatgcacatgtaaaaacatatttatgattaatgataattcattaagtgtaatactatgctaaattaatatacagagtaagactgacttgtg

SEQ ID NO: 153777 - DNA, 420 bp, Homo sapiens
gttggccaggctggtctcgaactcctgaccttgtgatctgccggcctcagcctcccagagtactgggattataggcgtgagctactgcgcccagctgtggtctctctttacaactaccatctagtttggttcttaatttttttttacttggactactgtaaaagcctcattccatcattgtcagagataccttaccaaatagccctctgataattttattcctctccctcttctcccacaactcaaaccttcagtggctttccattgcctgcagaattagataattaatggttttctataatacaacctactgcaacctactgcagtagtctaatctcccaggactctactaagcatatcaaatatgtcagccatgttggatccctggctgtttgctgaacaagcctgtataaccctcat

SEQ ID NO: 153778 - DNA, 165 bp, Homo sapiens
gactgggtgatggttggacactctgtggatgcactaaacaccacgggactacacacgaggatggatttagtgctatgtgaattaaatctcaatcaaaacacccctgacatccaagatctccaacttctccctcagtatgttccattcaacattctctgcagtaat

SEQ ID NO: 153779 - DNA, 175 bp, Homo sapiens
agaatgaggcaggtgctattatttccatgttgcagataaaagcactgaagctctgagaagctaagcagctaggcagagtcacaaagttaataaaagagcagccaggattcaagcccaggtctcctaactttacagcatgaacttagaaccactatgctgtacactggttcctctg

SEQ ID NO: 153780 - DNA, 126 bp, Homo sapiens
cccagaggaggttgtaatgtgagggtggagatgaggctgctgttacaaaggggcccagtgacacagtctgataaagaagatagacttttaggctgggcacggtggctcacgcctgtaattccagca

SEQ ID NO: 153781 - DNA, 354 bp, Homo sapiens
caaatgagtggaaaggacagttttgaagtactatctcagcacagctttgacttaactttcgtcaggtgggaatgagcaagttaatatttgcaacagatattccctgctacattcctagtcaaaatttaagggaaaacaaccatttctctctgttagaaaagctgctgatacctttttgtctctttgtaagatcagcaaggactaaaacctgtgttatcttcctgagtggacttatgatatgtttgtggtcaaaattaaagttgaatataagttatggtttgttttttatatctagcacatcaacattttatcagagaacgatgaatactgtcttattagtttaaaaatatttgc

SEQ ID NO: 153782 - DNA, 878 bp, Homo sapiens
ttttgttattagtgagtggctaattttggggggccttaaggcagctttgttttctatagatatgctctaggttttctgattgtctcgtatctaaccttgttcttagccatgataacacaacttatatttgataagtggatgtgtttacttggttagaataagcaaggacatttttaaaaagcagtaaatttgctgacacttttatctttttttaaaagaatgaatgacagcttccttatcagtataattacatttaaacttttttttttaaaccgtgtggcagcttctttatcaatcagtataattccatttatttacttagccctcaaaatgacattttgaagggagcataaactctttcaggctacttggacagtatttagtattctatattagtactacactaataatttactgagtgctacctaagtgacctgattgataatgtccttaaggacctgatacatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatcttttttttttttttttttttgagacagtttcgctcttgttgcccaggctggagtgcaatggcacgatcttggctgattgcaaccgccacctcccgggttcaagcaattctgtctcagcctcccgagtagctgggattacaggcatgtgtcaccatgacctgctaattttgtatttttagtagagacggggtctctccatgt

SEQ ID NO: 153783 - DNA, 151 bp, Homo sapiens
cctacagcacatttattctttaaacagcaactggagaattccttctaaaaagatgctactcaaagcacagtccatgagctgatgatggttcagggactgttactggtctaagaggagatgacataaattaagaataactgtttagggctgg

SEQ ID NO: 153784 - DNA, 378 bp, Homo sapiens
gggtggggaaggaaaatggatgtattctggcttgagctctgctgtcattgtgccttccagtcccactgtctccacaccctatctcttcatttttctttccctgtgtttcacctacctcccctactagcttggctctggttggtcatggtccacaattccagtattccttccccaggtattagaaccctttgcttccctgactttgtgccctgccggctatgctagttgctgtctctgaattccgcgcctggctgcttttcactgcccctagggtgcccattcccagtgtttctggacagtcaggaaaatgagttgtcttggttgctggtagttcccactgcctcacttgagctgatcgctctctgcccctcagggtgc

SEQ ID NO: 153785 - DNA, 340 bp, Homo sapiens
ttttaatgttctttatttctttctagaagaattttatagtctcacaaaataattgcggtatatgcttaatttgagaaatagaatgctacttgataaccatacacatgtatataagctgcaatgattttacaaggcttttatccagtctcccacttagtcagatgataagaccctcttgtgactcattctttttctctatttttcaattctctaacttcctggaagctcctctgttctggtggtcgggtaggagggaagcattcacccagaaaatgagctcaaaagattctcccttgagttcttggttcactgttttgttttgtttttcccatgtattttg

SEQ ID NO: 153786 - DNA, 510 bp, Homo sapiens
gaggatttttttaggttggggttcttccttgtatcaaatatccccctccccacatgtcatttgtgatgatgtttcgtgtgtgaaggatagaccctaaggtgaccctcaatcatccctacttcctgggaagtggatccttccccagcccagcctccagatgagatcccagccctggctgctgccttgactgcagcagatgaagatcctggacagaggacccagagaagctgtgcctggactcctgacccacaggagctgtgagaaaatgaacatgtgttgttgtaagctgctaagtatgtgatcatctgtcatgctgcactggataactgacatgaggggcatggtgtgtgaacgcatgtgtggatgtaaaggaggggttggctggagagggtgtgggaggaggacagttgcctgcagagctgtgtggggtctacacagccatgtacctcctttggagggtatcgagtacaagtaatttggttgccagtaagagaaacaaacccaaagagg

SEQ ID NO: 153787 - DNA, 256 bp, Homo sapiens
ataattcatactatacatatagggacacacatctgcatagatttataaaaggttggcttctggccgggcacagtgactcacaattgtaatccttgcactctgggaggccaaggcaggataaatgttttaggccaggactttgagaccagcctgctcaacgtaatgagactccatctctacaaaaaaattaagaaatgagctgggtatgggggtgtgcatttgtagtcctagctacttgggaagccaaggtgggagg

SEQ ID NO: 153788 - DNA, 371 bp, Homo sapiens
ctttatacaatactgaactgtgtacgcaaaacctgagaagtatctataagctttctctctactaacaaaaagagataaactttccccaaaatacagaaaagaatcagtttcttgtgccataaaaggatgcagaaaagagggagctttttatttcccttttctcaagcagacaaacccttttgcctaaacttagtaaaactgaccagtcagatatgacctccaaaatttcccttgaaaaccttccacgcaccatattcttctgcctattcctggagatagttactgattagtaatcagtatcctatttaatgagaaaagatttctcacagctttctataacatatctcactctacgagtattgtataacaga

SEQ ID NO: 153789 - DNA, 698 bp, Homo sapiens
cttcaggggacttggacagtaaataaccaaaataatacattatagtcattacaatcaacagttacaaacccttttacatccattattttgtctggtccatatagtaactctaaaatgagaggaaggcagattattcctcaacgaaaacatataagcacctataatgcgccaagcactgttctaagctctccagatcccacagtgaacaaaagaagcaaaaatcgctgctttcatggagcttccttttagtgggagagagagtaaaataaaatgattgaatattagctatgaagaaaaacaaagtaaggaaggagaatagtgaatgtcagagaagtgctatttttgaggacagattgacagatgttatccctattttaactagagcaaagttctcagagaaacatgattttccctgggtgttagaacttgtaaatagcagaaccaggaaagatatctgcatctcctgttccaaaatccgctatccctatggcccttttatgacagtcctaaaaatctggtaatccagtatccatttttctgtcttgtctattcccagccaaggctctgaggtacaaacttttctacttcccagttttgaaaaaaaggcaatttctttttaggcattttttttaaaataaagcactgattgggtgggggggggaatggccgggccaggagcctttttaaattaaaatccc

SEQ ID NO: 153790 - DNA, 577 bp, Homo sapiens
gacccctgccaacctcaccccttggtatccctagaactctctcttgcttcttagccttaaacatggagaggaaagagccaactttcatgatttgaagtcagaaaaaccaagtgcaacagccctcacctatggtcatctgaggagaccagatgaacgcatagaaagctattaggattgaataaaagcagtatgccaggtgtgaccacaaaataagaagcctttgaaaatcagtcacacttggacctctgtggtcaatgagtgttcttcaaatcagaacctttgggggttatcaatacgtgcttcacaagtgtttgaaggagttgagagccaccttcagagtgtgtgtgagccacatgagcaactcccttgtgtttcttgcagcaaacctcctggattgaaaatggggttgcggatctctatctactgcatctttcatcagatcgtctttgaagttttgtgtttccaaaataatccaacatcattatcaagggatggaaatgtatcattattcaggaaactcaagagaacaatattctgcaggctctattgaaaactagccagttgggtcgggcacagt

SEQ ID NO: 153791 - DNA, 352 bp, Homo sapiens
gtttgagaccagcctggccaacatggtgaaaccccatctctgctaaaaatacaaaaaattagctgggcgtggtggcaggcacctgtaatcccgcctactcaggaggctgagggaggagaatcgcttgaacctgagaggcagaggttgcagtagctgagaccatgccacagcactccagcctgggcaacagagcgaggctctgtctcaaaataagaataagaataagaataataagaataataactacatctcaaatttttataaagtaacctttaaaggagtactgaaattatgagtaaacataaattgatttcaagaaaaagaatactgacaatctctttttaaaaatcct

SEQ ID NO: 153792 - DNA, 139 bp, Homo sapiens
ctcctgggcttaagctatcctccaaccccagccttctaggtagctgggactagaggcacatgctaccaccatcagctaaaaaaaacttttttgtagagatgggggcctcactatatttctcaggctggtctcgaactct

SEQ ID NO: 153793 - DNA, 601 bp, Homo sapiens
acctgggttcaaatcccagctctgacacttaatctgtaacagtgttacattattctgaggattagtgaaaagggaacacttagcatataggaagggctaagtgtatgttcttgcctctttctagttaggcttgaaatctttctttattttatgtacttattattactaagttttctagcacctcccaactcatgaccaaaaagtttcattttcatcttatttttctctttggatgatttttataagggtatttcttatagtttctctatatttaaatactttatactgtctagggtatttaggcaaaggattcaactacagggcttttagaaatcctttccagctctaaaattataggatttaattgtttttgaaaaagatgccttctaccttcctcctcctccagctgcacacgtagtttactggttactgtggtaactgcactctaataatcctgtcaggaaatctgatgcaactatctgtctaatcttattttccagacacaaaacaagcacacggcttccttctaagaatccttctaaagcgctccagcctaagcattgtttcttcttgttctgatgttttttaagattgcacttag

SEQ ID NO: 153794 - DNA, 396 bp, Homo sapiens
ttaaagaccgggtaagcgaagatgccattagcatcctatttcttgactcaattattccatcaggcaggcaaaacttttcatgtatgatgtcatcatgtgttgggaggtacagagaatccttaaaatctggtggtggcagggaaggtggtacaatcatttaagaggatcatttggcagcatcaagttacaacaggcaggaagaacaaaaaacaaaagcaggccctctgctcaagcagtccaagtctttgcaggtactctacatgtccagagtgagacacagatgggcagcattatcttagagaaaaccgggaacattcttaactgaataatgtaaccatgccatggaatatatatgtctgtcaaaatgtaggtagactgggcactagtgtaatgtgc

SEQ ID NO: 153795 - DNA, 649 bp, Homo sapiens
tccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagattacggatagagctctatccttaatctgaagagattcactgaagcgcgggtacaaggcgggagtaactatgactctcttgaggtagccaaatgctcgtcatctaatcaggacgcgcatgatggatgacgagatccactgtcc

SEQ ID NO: 153796 - DNA, 499 bp, Homo sapiens
agaaatgccagaaaacagacgccggcccagcaggctcagcagggttaaacttggcgagagcaggctgcccaaggtaaagggggtcacacagcagatactgaatggctcaggaattgcagaccccgaggggcagcatggcggggctatgtaaggaagatttgctggtattcttcatcaagaataatgagacccaagtgtcttcttccaacccagataaaaagggactgcatcctctcagctcaaaaggactgtagacttcactctgagcaggttgaactggaggttctggactcagagcaccaggccacctaaaagtgagggtgagggttctcaccaaaaacagagagaggatgtaagactctacagaatgactcaccagacagacctctggcctccttccctgagtaggctccaaggacactggcagctggtttattctgtccatcaagccattggagaacacctctctatggatgctataagtctacaaatacatgcc

SEQ ID NO: 153797 - DNA, 580 bp, Homo sapiens
tcaacgctttatacttcaaagtaataagagccatccatgacaaacccacagccaatatcatactgaagtggcaaatgctgaaagaatccccttgaaaaccagcacaagacaaggatgccctctctcaccactcctattcaacatagtactggaagtcctggccagggcaatcagtaaagagaaagagataaaaggcatccaaatagagaggaagtcaaactacccctgtttgcagatgacatgattttatatctagaaaaccccatagtctcttcctttaatctgataaaaaattaagcaaagtttcagaatacaaaatcgaagaacaaaaatcagtagcattcccatacaccaacaacatcaaagatcaaaggtagataagcccacaaaaatgagattcagtgcacaaatgctaaaaactcaaaaagccagaataccttctagcctccaaatgaccacattcactcttcagcaaggattcagaactgagctgaggctgagatggctgaaatgacaagtacaattcagaatattgataggagcaaagttcactgagctataggagtacactgtaactcaa

SEQ ID NO: 153798 - DNA, 118 bp, Homo sapiens
ttagcctcccaaagtgctgggaggctaagttaaataggaaattctaaatgaagataatagaagtacattttagtaaagtgcatgagctttaatatgctgattttatagtctgtttcaa

SEQ ID NO: 153799 - DNA, 203 bp, Homo sapiens
aaagagattttcctgaaagaatattgcatttaaatctttaattacagttgtattttcaacgatgtatgcagtccagacattactggtagatactggatatcaaagagtacaataaagcagaatagcaaagccaaagccaaatgttttgctatgaaagtagcaagaatggccaggcacagtggctcatgcctgtaatcccagca

SEQ ID NO: 153800 - DNA, 477 bp, Homo sapiens
gctctagtacctcttctgcagtaccaggaagagggagaatggacactcaggcagagatttacaaggtctccacgcatactctattggacaaggccaattagctaaaaacatctaacctgacaggaaaggagaagtgtgatggtatcctgtgcctggataggggagaactagacaagtcagagtaacagcacaagtgaccacatgcttccatcccagattccagcaggtacctgtgaccctggccaggactgacccttgcccctcactcaagggagtttccataaactgctgtcagatggacagacacttgctggtggtggtcttccagggccatttcccatggattccctctggttgctcactacctggttgtctgtttctgcctaaaattcaccttactattgaaaatctctctcctgctgagcaaaccttctcaccttccataactgcatcagctattcaatctcatcatgatcc

SEQ ID NO: 153801 - DNA, 337 bp, Homo sapiens
aggcaataaaagggctgagagagactaagagagtgttgtactcgatgcccctgaattgctcactttaaaatggagttgattttatgctatgtgaaatttgcctcaatgagggggtggggagagaaagagagagagagagagagaactttttttcatctttggagacagctacactgagtcatagcccatcaaaaggggaggaatgaagggtcctctctcctaatctcaacctaacacccgagctaactcagcccctaatgggatcacttgaagtgcctgattgtgctccctgcagctgggagacccaatgagaaagatgaagaagactgtggttgta

SEQ ID NO: 153802 - DNA, 402 bp, Homo sapiens
tccatttaacagcttaaattctgcccaaactgatttttagtgtgtgcttcccccaccccgccccccacccctacggttacaatccttgctatttttgttttttaaaaaggggcatttgtatgtacctttctttggccagctgttagcagcaatctataaacatgttaatacttgctattgatagttaaaagcacctttttggtgactgctgttgaggtgttggcctgcccccgactccgccccccatcagtgtacaacccggtgtggagaccacttccaatgtcagggtgtttccttcccactgaaggaaggcatcagattccttgttgtcagctttcttttctccagagcagtggagttaactgtgcctttgttctttctggcccatgagtgcccgtggtt

SEQ ID NO: 153803 - DNA, 514 bp, Homo sapiens
ctaaagaaataattcctcatgaatctctggttctttgaagtgaaaaatgtgtaagcaaagtacaatcagtagatgtaatgtagttagggtttttaaaacattagtgaggttccactttaaagaataattaaaatatgagagggaaaaagggaaagtacagaagagcatatataacatggtaacatttatgaaagaaaaaaatatgtgaatatccatagaatattcctggaagaatatacaggaaaccacagtagttgccactgggaaggggaaattattttttaattgtacatcttataaagcaatttgaaaattttttagtgatcaagagattgactaggtgaagggaggagggacattttttgagataaagacttaaaacagatataaaaacctaagtagcagtatatgattgtgatgatggttatgggctgtaaaatcagcattcagagaagaaagctctttcttggttgggaggggggaagcaagtaaataactttcatatgtagttgca

SEQ ID NO: 153804 - DNA, 180 bp, Homo sapiens
aacagaccctgccagaagattccactaggcagtatagcccagtatcatatccccacaaagcagctaaaggcagaggtgattttagaacctcatgaagtctcagttactgaaaattattttcagacccaatggcttatttggtctttttctgcaagtttcaggtaattcccctggccatgc

SEQ ID NO: 153805 - DNA, 417 bp, Homo sapiens
atagctgttctagaggatcccggtcgaccgcacgtcttatgttgtgtatggttatcatttgtttgaggttagtttgattagtcattgttgggtggtgctaatgagaagtgttccattgagaaatactatagtgggtggtgacatagaaggaagagcaggtctatagaggtaagatagagttcagtttgagccctcctgagttgaagttgttcgtggataccaagttggaagatgtcttcaggcagttagatatctgagtctagaatatagagataggtttcagatttaggagctgttaggggcggttgaatgtataacatgaaaaatgatataggtttgaaaatctgagggaggttggaaaagtggttattgttgacacacgttgttacaaaacaccaacatgtaatggacgaatgg

SEQ ID NO: 153806 - DNA, 146 bp, Homo sapiens
tctacagaaaacttttttaaaaaaggatgttcttggtgaaacattaaaattattagttttattaaatcttgacctttcagtacacatcatcttaataatttgtatgacaaaataggaaatccacataaagcacttcagtttcatgt

SEQ ID NO: 153807 - DNA, 333 bp, Homo sapiens
agcctcccgagtagttgggaccacaggtgcacacctccacgcccatctaattttcatattttcttttattgtagagatggggttttgccatgttgcccaggctagggggatatatcttgatatagagtatgacaccatgtatgttaaggactgctttcccacctcctgccctcgacatctgtacccattaccctcccccaccacagcagtgagggctttctgtgtgcactgacctcagaggaagagccaacacagcttggaacaaagaagccaattgaatctctgaatggatttttttttttgagatggagtctcactcactctgtcatccag

SEQ ID NO: 153808 - DNA, 290 bp, Homo sapiens
tcatggtggcatttgcattatgcaagaaaatggccatatttttggaaatgcatacttgacagtatgtaggattaaaatgacagatgtttggaatttaccttaaaacacaatagcaagaaaaaacaaaatgggatagatgaagaaaatgtaccaaagccctaaaattattaaatctgagggatgaatatattgaaacggggtcactatattattccacctatgtttaaaattgttcataatgaaaaagaatagcaggactctccacacaggcatgttctctggtagcagtg

SEQ ID NO: 153809 - DNA, 612 bp, Homo sapiens
ccccgaacaagcaactttgagaaagaattcctacaaaaacatattgcagatggcagcataggagccctgctgtgttcttgtagttgctagagtttctgcaaacatacttggcttataaagtactaaaattgctgcccaagtcggatgaccttagatgagacagctgcttagaataaggctcacattttaaaccagatttttctcccctgatgaattgggatagagaggaggtccatttgcagtttagcacttggtcccagaataagccagagatgcccacttcttagtctgtgctggtgtcagggacacttgcagtgtttgcagagtgggaagctctgatgcttgggcagcaatttccccacaggtaaattgaggataccttctgttacctgtctcacaagtttgataggagattagagcgatgaggtaatgtctgcgaatggtttcctgtgtcagggagaaagcctgcacagctgagtggtgtcaccttaggtaatagtaggccttgggatgtttccgtagtggggcttctgacagcatctccctgcaggataagtgagagaactatttggttcatccccaatgtttttctgttttttgtttgttttgttt

SEQ ID NO: 153810 - DNA, 545 bp, Homo sapiens
caaaaaataatggcaaacacttaacaaggatagctgcaagcaaaactaaaattgcagagaacccagaaaggagtcagagaaattctctaagcaggtttcaggagccattcctaaatcagactcaaggtactctaaaacatggccaggtgcagtggctaccatccataatcccagcattttgggaggatcacttgaggctaggagtttgagaccagcctgagcctgcgcaacagtgtgagactccatctttacagaaaaaaatatttttagttagccagatgtggtggtatatgcctgtagtcctagctactggggaggctgaggcaggaggatcccttgagccacaggaggtcaaggctacagtgagctgtgatcatgccactgcacttcagcctgggtgacagtgagacctagtctcttaagaaaaaaagaagaagaaagaaactggggtatggggaaatattctctccactaatgcatttgttaatatttttctgtaataaaaagttaatgaagtctgtttcaaaggggaagagtttaaaatt

SEQ ID NO: 153811 - DNA, 345 bp, Homo sapiens
ctacagaaaagaaatgatttaaagctgggccttgaagaagggttgggaatttgaaaagtagagagaaaggcccggctaatttttttgtatttttagtagagacggagtttcatcgtgttagctaggatggtctcaatctcctgccctcatgatccgcctgccttggcctcccaaggtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggag

SEQ ID NO: 153812 - DNA, 486 bp, Homo sapiens
acaaacaatgatggtaacagttcaaatttgactattttagaataaataagtaaacacttgtctccttagcagctggccactctacctcttagagagagggctttcttctctttcttctcggtctcctgtctcccaccattttgcttctctattaccaatgagaacatgagtggcatggtcccaaagcctttctgttccccctatctccacttttcggtttttagaataacgatccccagcctttaagttttctataggattcgttagccagtggctattaagtgctgtcacggagcctaacagagagctgggaagggagcaaaccagcgggccggtggtgcactactcgagggccagcacctgcagctgcttcacctccagctccgcgttcaccaccggcccggagcccgctccagagctgacccctgccgaggcgcatttcacctgctccgccatcatcgtgggccccgagggcgccgcggccgc

SEQ ID NO: 153813 - DNA, 396 bp, Homo sapiens
ctggaagtagagatgaaggtgttggtagggttggttccttttgagggttgtgaggaagaatctgtcccatgcctctcctctagcttctggaggtttgctggcaatccatggcgtggaggagcagagtcccagtctctgccttcatcttcatatagcattctccctgtgtgtgtgtctctgtgtccaaattttccttgtttgtaaggacattattcatactggattaggacccactctaatgacctcatcttaactaattacatctgcaacaaccctgtttccaaataagttcatcttttgagatattaggggtttggactccaatatgtcattttttggggaaacagaactcaacctatagcaattgcttacactcacatagcattttattgtttg

SEQ ID NO: 153814 - DNA, 615 bp, Homo sapiens
ggagggaacagcagtcctctcacctcagcctctcaaagtgctgggattacaggcgtgagccacagcgcccggccaaccccagcctttcttaacctagctccactctctagcctaacttcaggacccacataaagctacacctacttctgcctgtttctttatgaagaatgtcttcagcttcaacctttctctgtcatgaactcctggtcatctttgaagtcctgattcagtgccattgcccccccccgttccccaggatgtttaagcactgtgtgtgctcctctatgagagccctaatcacactggatggaattgtctgagctgtgaacttctggatagtgtagtcttgttcatgtgtgtatcctcagcatctgtcccaatgcattgaatcgagtgaaataaaagcaagtacaggatatgctttgtgtatcccagtaagaccccaacctgaaaatagtgccaagacaaccaggaaactgaccagtggtccagctgagctgcatgaagcagaattaggcacagaaagtctgcagtagttcaaatggagtcctgagaaattgtgtccagccctcatgtcaccctggcctgccctgatcttctttgcttgttccgctg

SEQ ID NO: 153815 - DNA, 711 bp, Homo sapiens
aggtcggcgcggtaccccaagggtccttaagccacaatatgaaaatttgagttttagaaagtttttatagcatagctcattaagcaggcagccacttactatacatacttttgtgcttttgaatagcaccaacaaatctagtggaatttatagaagcagcaaaaatctaggatcagcacaagagttacaaagaatacctactaaaagtgcaacaacacatcttgcctctcatgttatctttcttttatatatttttttggagacagagtctcactctgttgcccagaatagagtgcatggcgcgatctcggctcactgcaacctccgcctcccgggttcaagcagttctcatgcctcaccctcccgagtagctgggactacagacacctgccaccacacatggctaatttttgtatttttagtaaagatggggtttcaccatgttgaccaggttggtctcgaactcctgacctctggtgattcagcagcctcggcctcccaaagtgctgggattacaggcatgagtcactgcacctggcctcatgttatctttcaaagagaattgaaaaagttgtaatgggtgccatggaagcaaggctaatccttctaatgggaaatttaatcaagaatgtttcataaaggttctatctcactgttccttttttaaaaatggtttccttcactttttatttttttttaagagacaagctc

SEQ ID NO: 153816 - DNA, 889 bp, Homo sapiens
atggaatctgactctgtcacccaagctggagtccagtggcatgatctgggctgactgcaatctccatctcccggcttcaacagattctactacctcagcatatagagtagctgggagtagaggtgtgtgacaccacacctggttaatttttgtattcttcatacagacagagtttgactatgttggccaggctggtctcaaactcctgacctcgtaatcctcccacatccgcctagcaaactgctgagatgagaggagtggcccactgcacccagcctactggtttatttttaaaaatagcaatttgggtcgggcgcagtgtgtctcgcctttctatatcaaccaacattctttctcgagtctgatgacctgggatctcccagcactttgggaggacgaggccacaggattcctggaagttggagttcaagaccagcctgggcaacatgggaaaaccctgtctttactaaaaaggtaaaagttagctgggtatggtggcacgtgcctgttatcccagctactcgagaggctaaggcaagagaatcgctggaacctgggaggcggaggttgcagtggcccgatactgcgccatggcctgaccaacagaacaagactccatctcaaataaattaataaatacgttagttaatcgaaaagtttaaaaagaaaacttcaaggacgttgcaggaatgcacgggaatgcttctctcattcctaaagatcagagcagaaacacagtaccatcaggttgagatacaggccattgtgaatctcttctcactgtgctcaactgacaccaaagaagggcaggtttccatgccgcccgttcatcatcaccgctctcgtcaagtataattgcagagtcatgactacacagagatctctcaac

SEQ ID NO: 153817 - DNA, 386 bp, Homo sapiens
acgatctcggctcactgcagcatccgtctcctgggttcaaacaattatcctgcctcagtctcccgagtagctggcactacaggtgtgcaccaccacgcccagctaattttttgtatttttagtagagatgggatttcaccatgttggctaggctggtcttgaactcctaacctcaatgatcctcccaccatggcctcccaaagtgctaggattacaggtgtgagccaccatgcccagcctcattgtaccattttacagtcagtacacaatggttccaatttcttcatgttcttaccaacagttattattttctgtgtctgtgtgtgtttttcctctgagaaaaggtctccttctgttacccctgctggagtacagtggtataatca

SEQ ID NO: 153818 - DNA, 119 bp, Homo sapiens
aataagcattttttattaacttttttgacaaaccgatagtaaaacatatgctacctaacggtaactgtgtccctttatgtatgagtctaagataaatattattcagatttttatctgga

SEQ ID NO: 153819 - DNA, 310 bp, Homo sapiens
tcaggtgtgctctgctctcgccattgttccatctgcgaggagcaccctttcttcagaaagtaaaattgtcttgctaagaaaactttttgtccaaatgctaatttttccttacagtacagaggtacaagcgttctgtctctaaacaaacattttacttataacagtgggtcacacaccctcctgtcagatgttactgacttttttttttctgggaacagaaaaaaaaaaattatgtatctatagtgtcaggaatttctggaccacaagttaagagcctgtgttagggagtgagtcaaaacactggctctca

SEQ ID NO: 153820 - DNA, 705 bp, Homo sapiens
tacgttcatgaaccttaccatcattaggcctaaacagatgcaatgccaggatgtttaaaccaagcaatcctgacatttacacaatcaggcctttctacagtcagtgctcggaaatctgtggatctaatcatagcttcatacccattgttcttgaacttgtttagtacccctaaaacacttcgaaactggtcagcatctatattataatatcactgtagagctaatcagtactaaccttttaagttaaagactgagttatgatctttccacaacgaagtgccccaactagacacatccacacgatttattactatcatatccataatcctatcaccatttcaattaaaaatttcaaaattcatctacccaacaaactcaacactaaaagcttttgaaatatagaaacatgaaaccccttaagaaataaaatgaacatctctttcattaccccaacaatagtagaactgcctgtagttattctttttttctttttttttgaggctgagtcttgctcttgttgcccaggctggagtgcaatgtcgtgatctcaacttactgcaacctctgcccttcgggtgcctcagcctcccgagtaactgggattacaggcatgagccaccgcgcctggccagtatcatctatagtttctatggttagggaggggttattaatttcatgttgtataccgaatattaccgactcgag

SEQ ID NO: 153821 - DNA, 481 bp, Homo sapiens
caacaaatttgaaatttgtgtttatggaaaatttcctacgaatatatactcccaagttattctgaatatgtagtctagaaatctgattgctatttaaaagccctcatatattaccttaatacataatgactttataatctgttttaattagggcagcagagtgtagtgaaaagagattatattctatcagtttctaattgggtgatctctctgaaactcttttcttacattttacatttatttttcaaaaatgttcctttcaaattttttctatagtacactctactttctagtgtggtatataatttacatatttattatgtttcttgtttttttttatctattcctcaattaaaatgtaaactctacagaacagttatttttttgaaggactctcaaataactttatttcacacattctaatactcagtttgtgaagtgaaacatctctttgactagaagaaaaaacagaaaaggctga

SEQ ID NO: 153822 - DNA, 404 bp, Homo sapiens
atgatccaacaattacacccctagagaatacccaagagaaattttaaaaaatgtgtccacacaaaagcctttgggttatttagcagtgtactgtttattttcaaatttcttgttatctagacacacacacacacacacatacacacacgtgcacgaaaatgaatatgtgagatacagctaaagaaatgctgagagggaaatttctatctctaaattcttacattaggaaaaaagatctcaaatcaataatcgaagctcacacctttaaaagctagaaaaaggctgggcacggtggctcagacctgtaatcttagcacttttggaggtgggcagatcatttgcagtcaggagtttgagaccagcctggccaacatagtgaaaccccatctctactaaaaatacaa

SEQ ID NO: 153823 - DNA, 259 bp, Homo sapiens
ctgccattaggacaagaaaaccaaaacagaaatttcaactgcttcttagcaatacatattttccgatagcatcccacaagaatgagaaatttagaatgcaataagcagatctccaaagggcaagcacaaagcacctgccacacagtgcttagaaatgtgccttgtgtggtgcctcacgcctataaacccagcactttgggattacagccataagccgccacacccggctggaaaagacagatttctcaaaaaaaaaaaa

SEQ ID NO: 153824 - DNA, 307 bp, Homo sapiens
gggagatgatcatttactttttacaataaataattttatctcacatctttagtcaagtttctcctaagtttggggagaatggggaaaaaatgtagtaagctttatgggactagcaacagaacgttttatcctattttgtgattttcagtattaagagattattgatcacttgcagagttacaaggcaagcactagtttaaatctgaattagactagggccattgaccttatatacctgtaaaagacactacggtgtatacaactgtagaaacaatatacacatagtagtttaatattacagtctgta

SEQ ID NO: 153825 - DNA, 248 bp, Homo sapiens
gcccgccaccacgcccggctaacttttttttttgtatttttagtagagacggggtttctccgtgttagccagaatggtcttgatctcctgacctcatgatccgcccgcctcggcctcccaaagttctgggattacaggcgtgagccaccgcgtggttgtgcttcttgttgttttaatatttatttggtctccacaatatactgaacatcaaacaacacacagaatacatcattacttatgtcaaggag

SEQ ID NO: 153826 - DNA, 278 bp, Homo sapiens
gagtggtaatcatcaacaagctcccaaagctgccttctgcccaggaaataggcatagaacccttggtgctgttgcactcatttgtaaaacagaggtcccaggtaatcccttctctccctcaggggaagcttagagccggtcaaaagatgggaaattaggagacccaagttctcatcctgtttttgcctttcccaggctgtgtgaactttcccctctggctgtttgctcctaaggtcagctgtgttcactctgggctttagaattcggggactggtatc

SEQ ID NO: 153827 - DNA, 292 bp, Homo sapiens
tgttaaattgatgtgcatcttataaacaatgatctcttataatcaaggaaatacagtattataactacaaaaagcattatctggtttaatggttctcaatcctttttcaccacccactcaatggatgacttccccttggttacctagaggaatgagcactcactctaaaagcaaattaaaatgcaagatatgggagaattatgctaccctggaacaatgaatttgctttaaattgtattgcaaagtaaatcttttattatactttagtactttattattagtaaccaattac

SEQ ID NO: 153828 - DNA, 421 bp, Homo sapiens
caggactttcctaatttttctacaatgagcatggcttttgaaatttaaaaaaagatgagaagactttggccaagatagattaagtaactggcccaagattacatggccagcaagtggcagagctggaaacctcagagttggacctcagaatttgtgctcttaatcatattttatagcctcacaataaattagaataaattaaccgttccaagcagaggattttagacttcatgcaacatgacagtacttctcaaagttgttcagggaataaaacactcagagaactcttattaatatgtttaatttcatcaaccagattcagcaaaatcaccaacagaaaacaagactatgatacatgtggacaaaaagaatcacagatataaatatcctgtgctttctcaataaatgatgctgccttact

SEQ ID NO: 153829 - DNA, 292 bp, Homo sapiens
tgctatgtagcccagttcctaacaggcttcagaatgggggatgggaaccctggttctatgagagcagaatccatgtatctttttgtaccactgaatcccaagcatttcgtgttggtacatttttctgtaagggaatccgtgtcttttgttggcttttaaaatggccacctaaaaaaatttaggaactactataagagtaatgttgtcaaaatcaaataccactgttgagattttgaatctgtgaaggataattgcattcttaatattttgtcttcccttccaaaatcatgct

SEQ ID NO: 153830 - DNA, 549 bp, Homo sapiens
cccccaccatggttatttctatggactttgtggcaactttgcgcaacagaactgctaccttaaaaagctatggataaaatatggctccaggtcacatgaagtgtaaaggcttatgcccatgactggaacgtaaggtcaacaagatgattccaaactggagcactttccaggggttgtttgggggtaaaaacaccatgtttacacaaagagaaagctattcacagcttttccttttgggaaaaaaagcattatcagctttttgtggcttatttattctatggcttatcagttgactagcttttaatgttcccttccttatggctttttttaaaatcctttatccaaaaggataaggagatgtttactttgaacttgccagaggtagcccagattcaagaaggctttatgaaccttaattatcaatagtggagagaagggtctttgtttaaccaggaataataggatttctatgattttcctcatcaactttctaagctaataagttttgttgctgctagcatttgtttagtagttcagcatagaaaaatg

SEQ ID NO: 153831 - DNA, 160 bp, Homo sapiens
atccaggaagtctgcctccagagcttaggctcttaactctatgtaataatatctatcaatagatgaatgaacgaaataaccagaaatcaaactcccattcctaaggcaaaggtcctccaggttccaatttctaaaatcccaagaatagctgccacactgg

SEQ ID NO: 153832 - DNA, 555 bp, Homo sapiens
tataaagcggagatcatactttcattcgactccgcgagcatttcctaacccctgcgcgccgtgatagcccaaccttgactcgtacaacccctctcgcgacacctgtctcctgagcaaatgcatccagtagggatgtgagaggaaaaacaggatccatcacccaacctgtctgcacttgtggcctcctggtaatgcagggactcaagcgactctatggtgggaaccctagacaattcctgatcaaaactttggaaaccagttcctactggaagattagtgttagaagaaacacacatttcagaaaatacatggaaggagccacatgttagggatagaggtgagatgagtaagggagggaagctctttggatgggcaggtggaggagagaatgaggccatgtggaaaatggaaatttaaaaccagagaagactctagacattaaccaagcaatattagataacgtcatggatttcctaagaaatctatgcctaaaaaattcaaccaactagtgtggctatgagtttgggttttattttgggcgctttcttgttttct

SEQ ID NO: 153833 - DNA, 129 bp, Homo sapiens
gtaaagtgtaaatataactcattattaaagagtaacttaacccctagagactcttattgggatgaattttagtatatggttacatttatataatttcaaaaaataattttgacttttttttagattcag

SEQ ID NO: 153834 - DNA, 580 bp, Homo sapiens
agggaagagagatacaaacattttcaaggactgaaggattcagtttccaaactgaataggctctcagaaaagcccagccaaatagatgagctagatctcaaccaaggccatcatgatatttcaaactactaaggactcagagaaacctctgcgggcttctaagaggcaaaaaacaaaatgggttacagtcaaaggaatagataccaataaagctttagacttctcatcaatactggataaacaatggatcaatactttttaaagtatgagggaaaaggccaggcgcaggagctcacaactaaaattccagcactttgggaggccaagacaggaggatcccttgaggccaggagttcgagaccagtgtgggcaatatagtgagaccctgtctctaccaaaaaaaaaagaacttttattattattattattaaaaattagccaggctaggcgccgtggctcacgcctgtaatcccagcactttgggaggcctaggcgggcagatcacctgaggtcagaaattcgagaccagcctggtcaatatggtgaaaccccgtctctccttaaaaaaaaaaaaaaaatt

SEQ ID NO: 153835 - DNA, 371 bp, Homo sapiens
tgtacccgttccgcactgcccactccctccaggtttctccagggcttggcctgctccacactttccccatctctcagtccggggtaccctggacatattcctgcaggcaacatgggccctctcaagcccaggctgctgctccatgcaccctctcaaaggtggggctccacggcgctgctgtctagagagctgtcaccagtcttcatccactgcagcgagggcctggctccagcagcgtccagcaactgctcctggcatctagcaagttcttatgcttggcacctccctggcaatagcctccccggtccccaagggaaggcttctagcaagttccaccagtacagcccctaagtacctttcctgccatcccc

SEQ ID NO: 153836 - DNA, 157 bp, Homo sapiens
cattattcttgctacttttctgtaagtctgaaattgaaataatatcaaaacaaatagttataagagtaaggaagcgttatactgatatgatctttaaaaatatgcaaaataaaaaaatgcaaaatgagatgtatggaatatcaccattcatttcaga

SEQ ID NO: 153837 - DNA, 370 bp, Homo sapiens
ctttgcaatccagcctacctctgaaaagctgcccagcgttatgccgcatgcccatttttatcagccgagaactgggcagaaaagtcatgtcctcttcttcctcctctagtttgtaaaggaattttctctttagctttaatagcagatggatagaggtgcttagtatagaaccttccgaacagctgacgtttagacctaaatgtaaatcaggaccatagcttcctgtcaccactcggatcagcaccctttacagccttgctatacctctgctgctgcctcccccagtgctggaacagactctgggaccaagatcctcttgtcactgggtctttgcagttctttttcaaaagcttgccttccctgctgttta

SEQ ID NO: 153838 - DNA, 573 bp, Homo sapiens
aatcccagcactttgggaggctgagcgggcagatcacgaggtcaggagatcgagaccatcctggctaacacagtgaaaccccgtctctactaaaaatacaaaaaaaattagctgggcgtggtggccggtgcctgtagtcccagctactcgggaggctgaggcaggagaatggcgtgaacccgggaggcggagcttgcagtgagccaagatcgcaccactgcactccagcctgggcgacagagcgagactccatctcaaaaaaagaaaaagaaaaagaaaaaaagaaataaagggaatccaaatcagtaaagaggaagtcaaactgtccctgtttgctgacgattatcgtttaccttgaaaaccctaaggactcctccacaaagctcctagaactgataaaagaattcagcaaggtttccggatacaagattaatgtacacaaatcagtagctcttctatacaccaacagcaaccaagtggagaatcaaatcaagaactcaaccccttttacaatagctgcataaataaatacataaataaataaataaacaagaaagataggaatatacctaa

SEQ ID NO: 153839 - DNA, 987 bp, Homo sapiens
atggagttatgaccacatgtggggtgtggacacgtataaacacttcagcattgccagttcacactgtcctgggagaagcaggaggagagactagagaggaagggggaacaggacagtaggcctccagtgctgagccaagaaagaagcttgatttttattctgtcggcaatgaagaaccatcaaagtgtttttttaaggaaaggtagagagggagggaggaaaaaaagttgtattcaggaagttcaacagaaaatatgttctgaaatgttatgtgatgtctgccagtcatctaggttctgagcttgagagtgctgtcatccttatccctgccctttgaaatgctaataggttgttaagctactctttagttactctttattctcataaacctttatacttttagatgccctacttgaaattgggtgtaaaatgaacacttgtaacatgggaagggggactggaaaatattaaccagaacaacaatgaaagtatcccaaggctgctaacaagttttcccaccccaacctagaccatatattctaactataaagattagactagacaaggccccatgcaaaacaaaacaaaaacaaagacaattcaggagaagtaactgcccaaatcttatctctgttataatacatgagctaaattttaaaataatcagtgggttgtagttacgaatggtaagttcaagtatctgttgttacaagcagagttaaacagtccacacctgacacctcaggaatttaagttataaaagtatttgatatttttaaagaataaatacagaaataatgcctatttaggtagaaaaaaaacttttggtgccatctaatatcaatctgttctattagtaactgacataaacatctcatgcaaagaaatagcttagaaaaagtagatttgttccaatggtgtccctgatgccaagtctgatgttaaagctattttgtaaaataaaagaatataattagacgaagtgat

SEQ ID NO: 153840 - DNA, 231 bp, Homo sapiens
atttgagtacgggaggcccctgcggcccacatttgtaacccatactattctgagtgattaagacctgaaacttgtgcaggggtaggggatcagaggaagattcattctaactagaggaaaagtaaaccagtgtcagagctattgggatttgaaggggcttcgaaacatcaaaggtcttgagagcaggaagattcccacctttttcagaggttacctaggataatagtcttt

SEQ ID NO: 153841 - DNA, 207 bp, Homo sapiens
gtctccggaccctcctcaaatagacgtgcacatgtgtccacagactctggtttgaaacttcaggggatgctgccctgtggctgggaactggggagggacaggtacactgtgatgtgttagatcctcggcccactgagtgggggctgaggcagatcaggggccatgattccagataggaagaaaccagcccttcctggcctcccaggt

SEQ ID NO: 153842 - DNA, 335 bp, Homo sapiens
caggcagacaccagatcccttccctgcctgagctccccggcatcatccccctcaacattctcacaggcagcccacgctccttcaccaggcccagtgggagccttagttctcccgggccagccggtgcagaataagaaagggaacggagaagggtgagaactacctgtgtcgtaacatcctgcctccctgacctgccgagtgcccccatcagggatcctgcgctcctcggggccggccaaatcacccctttcctcaggggccggccaaatcacggccaaatcgtgtgctcctgggtaagaggagatagagacccagtctgtaagaagctgcaccct

SEQ ID NO: 153843 - DNA, 387 bp, Homo sapiens
gagaataaactaccttaagaacattttaatttaactttaaaaacaaaagtctgaataaagtgacaacttttaactagcaaatcttaaaaggagtataactccagagcaatataacagggtattacctgaatagccataattatacaactggaattatttatgctacagggagacaaagtcagattattgaagacacaggcccacacttttgttttaaatcaggtttcacagttctctctcacccacaacacagtaaattgtatccattcttcttttgctctgagaaacttaaagactaaaacccttgcagcttccccaatatcatcacactgcaaaagcatagaagtcttgtatgcatatgcaggagcagggaggagggggagtaac

SEQ ID NO: 153844 - DNA, 519 bp, Homo sapiens
cgcctgtaatcccagctactcaggaagctgaggtaggagaatagcttgaacccaggaggcagaagttgcagtgagccaagtttgcgccactgcactccagccagggcgacagagcgagactccatctcaaaaaacaaaacaaaacaaagttttatttttatttatctaattatacacacatgcacagacacctacgtatacagacacacacacgtacacacacacgcacacaaatatatatatgtgctgatgcactggggcttccactgctcttacttgatgtgggtgatattatcatcattatatatatatgaggggggagagagagagagagagagagtgagagagagagagcgagagcgagagagagagagagagagagagggggaggtgctacacattttaaaccaccagatctcacaataactcactcaccatcacgagaacagcgccaaaggggaaaccccccccagaatgatcctgtcatctctcaccaggtctcacctccaactttaggga

SEQ ID NO: 153845 - DNA, 675 bp, Homo sapiens
ctagggacactgtgctagccatcctctaggagagggaccccattccctctattgcactctctctttaagcaaagtgattatgaaagtggcaaatggactgcttggacagtctgaacttaattgccagctattttggggagtgctgagaaagctggctgcccaaaatctggagactttgtgggaagatgagtttagatgcagggcctcctgctgcagagagaggggatccctagttctagccattctcatttctgggtctccaaagttttatcaagcatatttgtctgcacaaatatccgaggtttaatactctgtatatttgtttgtaattcaggcatcacaaaattctgaacttgctatgtagcatatgaaattgctaatggaagattgtttatttttttaaaaagactagaagtctttaaatttctggcacagacaggcactcaaatatttgttgaatgagtgaatgtaaggataatagaatataataaattccatttgggatcagattactaggctatctaacatttatgatgaatccagttcatgaaaaagtgttacttagtgaaataattatatatacttaacctcaattttatttttgatttaattttaatttctttttttttttttgagacagtctcgctttgctgcccaggctggagtgcagtggca

SEQ ID NO: 153846 - DNA, 341 bp, Homo sapiens
gtcatattctgcaaggcagaaataatgaatgaaagggatcatgcctatgggcctggaaatttgaattgagatccagctttcaagagcattgaggaaaaactcaggggtttgcagtctacctttgggtaacagggagccattgaaggcttctacctgagtgatgatttagcattcataaagataattctgatagaaacataggaaagtttaaaaggagacaaaccaatcagactaagacaaactcaagggcaaacgaaagcatacacttctgttttggaaaataaataatggtggctttaaggcaggagcagtagggtagaccaaacagatcactctgaaga

SEQ ID NO: 153847 - DNA, 354 bp, Homo sapiens
gggcaacagagcaggagtctcaaaaaacaaaacaaaacattaacctgagactcaaatagattgctagagaaaagggaagtgtagaaggaactgaaaggcttattctaccttgatgggagcatttactctgattataattgacagctagcttttctcctttatcatggaaaatacttctcccttctaaaatatttcttacaaatatttcttacagtgccttcattttttgatttctcttgattcttgagcatctttttctgagtattagttttgtttcctaggaagaattttgtctggagagtctgccctgtggcagtgactgtacaaaatacagctcccagtatgaataaataa

SEQ ID NO: 153848 - DNA, 462 bp, Homo sapiens
atgaagtcatcagtgaaagccattattaccaagtggtttatccagtcccattcttgaagaattgctgattttgtcattgtacaggagtgtcgtggttgccaacattacttggaactgcacacagataagttataacatactttgtggagcaatgccttcttaaacttttgtgtcttgggttattttgtgctgctataacagaatatctgagactggataatttatgaagaacagaaatttattctctctcatgattcttggaggctggaaagtccaagatcaaggcttcatctggtgagggcctttttactgtatcctcacgtggcagaagacagaagggcaagagagggacaaactctttgtccttacatggcaaaagggcaaaagacagaacccattcctccaagccctttcatagaggcactaatccattcgtgaggttggagctttcatgacctaaac

SEQ ID NO: 153849 - DNA, 735 bp, Homo sapiens
taaaataataatgaccatttatttagctcacaagtttgcagtttgcccagggttcagcaggggaagtctgttttataggcaggaactggagccgttcaaaggtgggagtgaggcccattcatgtcagaaggaggttgatggaagctcgtagctgggacctcaactcctcaatggggctgtcagtgggcatacctacccatggcctctccatgtgccataggcttcctcacagggtggaggctgggtttaaagtgcaagcacctcaaagaggatgaggtggaagctgttgcctttttataacttaacttcggaagtcacatagtgtcactttgtttttagtcactggcctacccagattcaggagaatgggaagactgtcagcatcatacagtacacacagcatatgggattgggatacactggtgcagccatctttggaaaatacaatttaaagatgtcttctattgtaaatctattgaatactatggggtaaacagagatacaaacgatctgccctttttccagagttgtgtgcaatctattggcgacagggaatgagataggcatgtgtctatgcccgggaggtaaggaggcgggggaaagaaagccacacactgagtaatagtaagaatccctatgtggtaagtgcttgttcaggttgcactgatcatgctgatgaagggaagaatccactctcatttactcactgacatgcacaaacaagcctgcatgttt

SEQ ID NO: 153850 - DNA, 637 bp, Homo sapiens
gtatttttattctttggctgttgtcacaaaatcaccatgtccttgtctactaattcccttaaaattattttatattagtcttattattttcttaaagaatccaggttatcataccttatggtattctcccaatatctttattttccaaattactatgaactctaatttcagttaaatgtcaataataaatatctaagatcatagttactttcacttatctttaatagctcttaattgcttacaccactaattaatattactaaaattaattgtcaagatgtatttccagattaattttaagccctaactcttgtataaaccttctactgcagtatagatttttgtataagtattcaaacatttcctgtgtcttctcattagttcatatcaaagtgttctctagaaaaacaaaaacaaaaacaaaaacaaaaaacttgccttcagaaaagtttccaatgcaagtcagaacattgtaaagccctgaaattagctcttatgacaaactcctatttgttaatacgctacaaaacatagtttgacatgcttgaaattaaaaatattttgtctaatttaagaactaaagcactaaagtgcatattttgatttgaattttcctagtatttctcagtaaataatt

SEQ ID NO: 153851 - DNA, 467 bp, Homo sapiens
tcctagtgattggtcagacaaatgagacatcaaccttacttttaactttgccacatttgtattttcttttttttgagatggaatctctctctctcacccaggctggagtgcagtggcgtgatctcagctcactgtaacctccgcctccagggttcaagcgatttttctgcctcagcctcccaagtagctgggactacaggtgcctgccaccacactcagctaattttttgtatttttagtagagatggggtttcaccatgttagcctggatggtctcgatctcctgacctcgtgatccgcctgcctcggcctcccaaagtgctgggattacaggcgtgaggctctccctcagagtggggtgtgtttaggggagggacaactgtgaggcatagttttgttgagccatggtttgttcataaggctgtcctttgtggtacagaaaactctgccagcagcctttaaagcca

SEQ ID NO: 153852 - DNA, 426 bp, Homo sapiens
tcggggcccgtctgtttctggaaatgacttctttctctctttccccttctccccaaagcaaaggccaggtcaggaaaattatatacttcgttttcccaacaaataaagtcgcctagtttgcagggaaagttttacaagccaatgatgcagagagaagaccacactgtttagctttcttaattggctggctttgaacttgaggtgggaggagaaaagaacccgctccagccccaggaaaacttagttttgctgggtttaccaactccaacagtttttagccagctgctgaaggtggcagggagtcactgaaggtttgtcccattttctcccgaacagagaagaattcagacagttgttgtctctctgagcccaggacagccagtctctgccctcaaaccccaagggaggagcctggaatccctggtt

SEQ ID NO: 153853 - DNA, 384 bp, Homo sapiens
gtaaaagggactcctggctaaggaatgaaattacatatggtttatatagttatatatagttataagagtgtggtactgtgaagataaggtaacaagtttttatgtcaatgccaattttcagcgttcacccattgccccagatacagttattcattctctatcaactgtgcctcaccaatatatttcacattcttataattacaaccattctactttagacctttttttttgttgttattttgactattgcagtggcctcaaatttcgttcctccactttcattcatcttgctcaaaagctacccaccataatgatggaaaattatcttcctaaaatgcaaattattaaacttttgatagatctggccccttcttgcctctcctg

SEQ ID NO: 153854 - DNA, 213 bp, Homo sapiens
taatgttattggaaagttaaggtccatagtataaaccttagagcacctacctaacaggacaaaataagcaaaaacatatgactaataatctattagttgaaataaaataaaattcaaaattaaacacttaatccaaggtaaagcatcaaaagtggaaaatagtaataaagaacagattaaattttatggaaaataaattttatgatagtagat

SEQ ID NO: 153855 - DNA, 360 bp, Homo sapiens
tcagaattgttgggaaggctgaagaaaagactctgggctgagctttcaggaacaaactccccaacctgctccccagacagatcaccaaggctgctacaatcaggaagttacagaagcaggcggtggggatgttatcatgcagccagccacagaaccatagctctggcacaatccaccccaggaaggggtgcctcgtaccctggccctctccctactgcttcacatcaaagtctaatcagcagagccggagtcacacgcagaggctactgtgaggaagtctggggagggttttcgactttctggcctttggatgctgatcaaataatccacagacaccccatggtacaggtcattgtatcc

SEQ ID NO: 153856 - DNA, 470 bp, Homo sapiens
gctttccctctgtgcttaacattcatgttaaatgaataaccttttattacacgtcaggatgtggagggaaatgtattttacaaaagtaacaaagtaagaaatttggaagtgtacaaaaaatttatgtctacaaacaccttccagtggatttgaccagaattacatatttaaagccttgattgactattttggagggaacctgaaccccacccagatcctgaaagagtagggccagtgttctaaggactaaaaatgaaaacctctgttaccaggaaacccgaagacgagaagtagcacgattttaagtactgtgcaccagtcattcgtcaatgcacagcaaactctggcaactttgccacgttaaaaaacttgccatcaaaatccaacctgagcacaaacttaataatctaccacaaccttaagcccctagcgaaaaggcttcctgtgagtccctggctctccccaacccc

SEQ ID NO: 153857 - DNA, 369 bp, Homo sapiens
aacctcaatctcctaggctcgagtgaccctcctacctcagcctcctgagtagctgggactacaggcacacaccaccacacaattttgtttttttagtagagacggggtcttgctatgttgcccaggctggtctcaaactcctgaactcaagcgatcctcccactgtggccttccaaagtgctggagatataggtgtgagccacggcacccagtcagaaccacagctcttgacagctctgaccttgtgtgtgttcagccttgtcacctatgagaataggactgtgtttgagttgctccctcagtcccttaccctggtgccaaactgcagtttgaaaaatcctggagagggattccaggcctggggagaag

SEQ ID NO: 153858 - DNA, 306 bp, Homo sapiens
gctgggttctggagttgtctggaccagttgcccctttcttcttgcctatctctcccttttggaatggaatatctgtcctatgcctgtcccatcactgtactttggaagcagacaacttgcttgatttcacagcccatgactggaggggaatttgattcaggatgaaccataccttgagttttacccacagctgacttagatgagactgtggactttggacttttaatgtggtgctgaaacaaataagaatttgggattataggtaagaagcaaatgtattctacatgtgacaaggacatccatttt

SEQ ID NO: 153859 - DNA, 171 bp, Homo sapiens
acgggtgtgacccacagtagatgggtaatgaatgttgaaaacagtaagcatgtgaatgaataagtgggtatgaaggtagaaggctgccagttgtaccccagagcctactgaaagaatggtattgcggcacagaatgccctctgccacttgagactgcctgttcagaagagg

SEQ ID NO: 153860 - DNA, 364 bp, Homo sapiens
gcccacctctccactctctcagggcaacacgagtggatcctctgggtcctgccctgccctggggatacggaggtagtgagacttcgggcagccacagaggagcccacatctcctgcagatgtgtgtgttgtcaggaagggctcttcaaagactcagaagtgcttcagaggctcacccctcacgggaacagtgctcctacaaaccctgcttggcagcccctcctcaggacgctcattcaaggcagggagaccccagccaagggtggggctgagggttccgtggagggccatccctggggcctagcctgctgttgtccacctctgggccgtcctgcgcccccggccttgctctccggccactgcag

SEQ ID NO: 153861 - DNA, 458 bp, Homo sapiens
tgaaacagtacagggttgagctgtcataaagcatgactttgtatctgacctcgcaataattattggaacacactgattagcaaagaaaagcaaactgttggcaatgaagaagtttctaattcctggaacatgctcctttgatatggtgatgcattttctgaaacatgccttacacacctccttactagcttttgaaatctgcattgcacaggcgaatatcatgggcatggggtttggcaacccgggggttaagcaatgtcaggctgacgctattcgtgtaaccagcacaggtgcagggttttagtgctgtagcagccaatcaggggcagacagtgtgggttgagtcatattttccgtttacagaaccaatgggtattttacataacgacagggaggtcacgctgaggacatactgaagttagcacatgtatactacactccagggaacaggaaggcag

SEQ ID NO: 153862 - DNA, 188 bp, Homo sapiens
ccatactgttcagtcacagaatatcttctctccagatttaaaaaaatagtatgctgatttctataacaaagctttttttcgtacaaaaaccaaataatggccatcgatggctcaaagccaaacccccgtcaagtaagatgaagacttcttagaattgaccatgagatttggttgcatgtagatcattg

SEQ ID NO: 153863 - DNA, 518 bp, Homo sapiens
tgtggtctccactttcttacttgccatcagtgtctctcaaacaccaatgaggtttttctccccattactcctctgaaaaccaccaacaacctccatgtggacacacattgtggttatttttctctcattattttcttgatcactttgcaaaattctcacacaaactgttcacttcttttaaaacacttcgtcttggcttccagctcatctctttttcctaatttactatttcttctcactttcctttgctgacctcaggttctgggcctactcatttccttaaaaaattgcttcccatgtctgggaaggttcttttacatagccttgacttaactctagacccctatgtccaactgcttatttgatgcttatatttagattcctaatatgacatgctgaatcaaattaaaatgaataattcaaagcacttttcaccctccatattttcaacttcttccttctccaaaattcctcaagttcatcaaccaccaccctctacccaattgttcaaaccaaaa

SEQ ID NO: 153864 - DNA, 278 bp, Homo sapiens
agaaagtgaaggtgggtgccatggatctgatgatttcagtgattttctactcaagaaaaatgaagtctcggatgggcagagcttaactgccttaaaaacttggtacagggcaaggtgtgagtttcccggtgagactgtgtgaactgtgaacgggtagagtctgaaactacaaaccagatgtttccgggctccctcccgcctggtctggcctgtcttccttctgctgctatgcagttcatcctgggtccctgagggcctcgcagatgcttcactcgaaa

SEQ ID NO: 153865 - DNA, 494 bp, Homo sapiens
agggaaaggctagggtcccagccagctggcacctgactgaacctcacttgagctgtatgtgttcccctcattctgccaggacactggtcaaagctgaaatattattactattacaagattttagcagtgccacctccatcaagatttccatttgtcttctcgcttctcttctcattgtttacaaatatttcttgacttctctctcttctttcaaacagtgccctgcccatttataatcagaagacaaataaactttgtgcaaatctccctgttccctcatgaactagccaggcatagaaggggcaacaccaagggtgtgcctattgactcaatgccatgttttgaccactctcagggccgcccagtggggcttccatagcatcacctatcatcttgtgcccacttactccagagccttcgctggctccctatttcccacctcaccaagtctgagcacctctgcctgctcgttaggtctcgtgccctagccagtc

SEQ ID NO: 153866 - DNA, 533 bp, Homo sapiens
acattcacagtgttgtacaactatcaccactatttactttgaaatagaaattttgtatccattaagctataactttgtgtttctccctcctcccagcccctaggaacctctgatctactttgtctttttgaattttctattctagatattttgtataggtagaaataggttatgtttgcccttttgcatctggctcatttcacttagcatgttttcagggttcatccgtattgtagcacaatcaggaactttattcctttttatggctgaataatccattgtatgtgtatatcacattttgtttatccattcatctattgataggtatttggattgtttccaccttttggttactgtaaataatgctgcattgaatattggcatatagggatctgcttgagtccctgttagaaattcatgcgggtatatgcctagaagtggattgctgggtcatatggtaatctatgcttaactttttgaggaactgccaaactgctgttcccagtagctgtgccactttacattctcacctg

SEQ ID NO: 153867 - DNA, 470 bp, Homo sapiens
ctggcctcagaaggacttcaggcaaatgctgttttatgggtgctcaggttcctggtttgtaaagaggagggaggctgccagaacaggccattatccaatcctgtgagatctcctaagctgactagaaccaaaaaattaattcaggaaagccagttctatctgaaattatattccatgaactctcctatttgtttccttctaatctgcccaccaaacctaatttttctagcacatcacgcaagccttttcagcaactcaaaattttaaatcctactctctaaaaagacagcaacattgccattcaatcactagtccccaaaattagcaacatttcattctttccttgactcccacctgctgctggcctcccactttcagagacggtcttttctctgttcccattttctcctttgattcacttttactctcttcattttttttgaagaacacctgcttttctcttcatccct

SEQ ID NO: 153868 - DNA, 261 bp, Homo sapiens
ggtggggtgggcagttgggtagaaaagccagccagccaagaatagaagaaattgtggctatggagttggaagggatgtggagggagactggagaccgggaaagggatgctaaggaaaggaggggagggtcaatgaggaacttgagagtgttttatttggaacaagtacaaagagctgggcagggtcaggcaaaacagaaatgtaattgaagggaaagaaagatgagactcttggctcttgaggctgcctgactgttctccc

SEQ ID NO: 153869 - DNA, 184 bp, Homo sapiens
tgccacagggagaaactatttgctttcaagttttcttacctaaggggagcaaagagaagggcaaaccaatgttcttttccatggatgaagcatcagaaaggtcacaaactttgccacttctctggccagtcttaaagctttgacaataggctgggcacggtggctcacgtctgtaatcctggca

SEQ ID NO: 153870 - DNA, 210 bp, Homo sapiens
agtgaaacaacctagtgagatccagtacagcttccaacttatattagaccaactttcctccctatgacattaatagctggggtatggagctgtcagagtgacacgtaaactccaatcagatcaccaagtggcctcagaaatgcacacatacaagagtccctctgtcagttctgagacacctgaagctaggagtggagtgaaaccagcacc

SEQ ID NO: 153871 - DNA, 578 bp, Homo sapiens
atctccttcatgacaacatccaaacaggccctgccagctttaatctgacccttcgggtttgagctccctttatttcctcacaattgtttagctcacctctatttcatccagacctgaagagcagagccacccttttagggcagccaggcggccctgtggtgaggcaccaggcttacctggttctaccaagagaggatgctcagccactggcagggtggagttcttgtccagcccagagccaaatcctgaggtcggtaatgctggaagcccacgtctgtgtcttaggtccagacagcacagaaacacctggagtttggagtatctataaccgtgtagaagtgctagtgactgaggtctattctttggccaatgctgggctttccatcagcccctccatcgcaccccagcctcagtctcccctgaagggcaaatatctcccagagccatggctctccctactccacttccatgcactggcctggccttctgcataatgtacaggacacactggagccaggggcagtggggtgctgtataccccatcccctcagtaacctctgcaggtatccagggcattg

SEQ ID NO: 153872 - DNA, 314 bp, Homo sapiens
cggtcggtcctattttatttcttttgtcaagatatttcggtgttataaatcaagcttaaaagctactaaattttatgcacaacatgcaagtccaccttgaattttcacacttctcagaattccatgcccaaagatggcagccaggggagaaccagcctgcagcacattgccttccttctcttccacccgctccttcagtattctgaagggcttcacaggaacacttgtgtattcttcagcctacatgcctaagtaagtaagtttttccacagccttgcaaatagctgccccttggacaccttttcaaccagggt

SEQ ID NO: 153873 - DNA, 413 bp, Homo sapiens
gtaaaacctcaaaaagaaaattagctggtcatatttcccagaatcagaattatcagcagcatgaaggccagagtatatcttgaaacaagccaatgatttggagatgaatttctctgtttttcttttggctgttaaaaaaattacatataccaaatattaagtgtcttgtctctctttgcgttatccttcatgttattacatgcttttgtctaagatgtactatcactgggaggcggtgatttattaaggccaagaacaggatcaatttaaaaatatctcagaagattttctggctattgtctgtcctgttcttccaagttgtatgtgggtgcagcattaataaccttggagaataaataacattgccagttgcaaaattggaacatgtagaagttgactgataactatattat

SEQ ID NO: 153874 - DNA, 357 bp, Homo sapiens
ttctgtcaaagcactggtagattgtacctaacaagttttgcagctctgtggtgacagctgttcttggagaatggatttaacatagttttgaattagatgttcctttgaggtcaaaaggattacggcatgtctctggataatttcccacttcctttcactgtttcatcacttacaggaagattgatcctgtcatccaggttcctgccatgttctgcagaatcaagcatggccttctccatttcttcagtcagtccccagctctccctgtctccattcagcatgaacagtgatattcaaggatatggttacttgaaatacacacacctcagcacatgcatgcacacacacacacataca

SEQ ID NO: 153875 - DNA, 300 bp, Homo sapiens
ggctatcccgtggtgtttggaaacagggcccatgcctgccatccacatcaatggagaacaggctggatgctttgggctggaaagatgccgacattatccctggtggagctttccatcgaagtggacatgcataaagcaacttaaaaactctggtgaaatgccacaagaattgggtgagtgtgaaggggagggaggagagttagaaggggctggtcacgaaggcttgtgggaggagaccttggcgatggccccactgtgttggcagcaggtggctgtatcttggccactcgtggattgcag

SEQ ID NO: 153876 - DNA, 259 bp, Homo sapiens
cggcgccagcacggatgtggtgtctaaatcactggtctcacctaactgcggcggtgctttctcttccctctctgtgacacagtcccggtagtaagctatttgatgagttattgcccgtgacatttgctgtcacctcacaatttaaagctgatcatttctcaaacttttatttcagcctcttaacactgggacctgtagtttggcaatgctgccagcaggtggaggtggtgtctaaatcactggtctcacctaaatgcgg

SEQ ID NO: 153877 - DNA, 381 bp, Homo sapiens
cgctacaactccatctagtaagtgctatcataagtccaaatttatagaggggaaaccaaggcacaaagcagctaaataacttggcaaaagtcacatccctactaaggggctgagaaagggtcagaagccagttcgtttagctccaaaatccacctgttaaccactatgttctcgacctcttatctaaagtgaagataagctccctggaaaatcccaagagtaaactgattgacaggaacagtgtttctcaaagcagaagccggcaggcgcggtggctcacgcctgcaatcccagcactttgggaggccgaggcaggagaatggcgtgaacctgggaggcagagcttgcggtgagctgagatcgcgccactgcactccagcc

SEQ ID NO: 153878 - DNA, 346 bp, Homo sapiens
cgctacaactccatctagtaagtgctatcataagtccaaatttatagaggggaaaccaaggcacaaagcagctaaataacttggcaaaagtcacatccctactaaggggctgagaaagggtcagaagccagttcgtttagctccaaaatccacctgttaaccactatgttctcgacctcttatctaaagtgaagataagctccctggaaaatcccttcaggagcagagtatccccatccatagagtggaatattagggagctattgaaagtggtgctgggattacaggtgtgagccaatgcgcctggcccttatttatttatttttaaatggacacataataattg

SEQ ID NO: 153879 - DNA, 120 bp, Homo sapiens
ctcttcttttttagtttattagagtggaatgataagtcatttaagatccttttttgtaatatactcatttatttctttaattttttctctatgtatagctttagctgcatcccataagct

SEQ ID NO: 153880 - DNA, 309 bp, Homo sapiens
ctcttgaggggttcatgttttgcccgcctctccttgtctctcagtgggggctgagtgagaccttggaatccgtcaggggcaccgtacacactcactttgggccccgggaaatcacaatccttttgtttccctggcagagtggcaggaaaggggcgatgaagaaagaagaacaagcgtgttgggcatgtgggggacacagagtggtttaagcaatggtttacgaagtggaagcctgctgagcctgtagcgccgtggccaggggtgcgggagggagtgtggcacacctggtctcccctaagacacagccac

SEQ ID NO: 153881 - DNA, 606 bp, Homo sapiens
gtccgcagctgggctttaaagttgcaagctgaaattcacaggagccagttatggcagtatggatacttaatatggaacgtaactcatgctttgggaagtgttggcagttgagagaccgtaaatgaagagattacttaatatgcggtattactgaggattctgaagagagtatgttatcagagactacaaattcggtcagcccttgggagtgttgaggaatgttgtgcaaatttagttaagtagtggatgattagtttctttcagctttagattctatgaagtttttggctaccatcttaagttatctaggattttataaaggtagggataatggtttctactaatgacaaatgtaaagaaacacagacataagctaagcattacatatttcatatatatctatcaacatatatatgggttccctctccccctttctcttaactaactatttgggagtaatttctcccaaataataatggcagtttttggagcctatgtcttaaaaaggtaattgtgaagcaaactaatactcacacagaaaatgacctatgctaagtggaaggaggatcaagagagaaaaaatgggtctgagttcttgaatcaatt

SEQ ID NO: 153882 - DNA, 125 bp, Homo sapiens
tcctgggattacaggtgtgagccactgcgctcggcctactgctctatgactttgtggtgattaacctttctgagccttcagggcataggtttttatgctcaaactagggataacacgttcgcgag

SEQ ID NO: 153883 - DNA, 133 bp, Homo sapiens
ttccttatctcctccttctaacaacctgccctccttccaggctccccaatttcagtagatgggaattttaccattttgttacttaggccaaaaatgtgggagccaggcagatcacgagttcaggagtttgaga

SEQ ID NO: 153884 - DNA, 1020 bp, Homo sapiens
caagataaccaggataaccaacaatattgagggagaaaaataaatgagaggactgacactacctaacttcaagacttactataaagctataaatatccagatagtgtggtattggacaaagggacaaatagacaaatagattactggaatagaatatatatatacagcccagacatagatccacataaatatggtcaaccgatccttgacaaaggagcaaaggcaatgcaatggagaaaacataatcttttcaacaaatgattttggaacaactggacatctacatgcaataaaatgaatctagacacaggctttatgcccttcacaaaaattaacctaaaaatgaatcaaatgcctaaatgttaaagacaaaactctaaaactcctagaatataacacaggagaaagtctaaatgatttggggtatggagataactttttagatgcaacatcaaaggcatgatccatggacataatcattgatcagctagacttcattaaaattcagaatttctcctttcagaaagatgttgtcaagggaatgagaagacaaaccacagactgggagaaaatatttgcaaaagacatattccataagggactattatccaaaatatacaaagaacaataagaaaatgaacaatgcaatttaaaaatgggcaaaaggacagacacctcactaaaaaataaatacagatggaaaataatcatctaaaaagatgctccatataaatgtcattaggtaattgcaaattaaaacaacaatgagataccactacacacctgttagagtggccaaagtccaaaatactgacaacgccaagttcttgtgaggatgtgaagcaacggaaattctcattcactgctggtggggatgcggaatggtatggtcactttggaggatagtttgtcagtttcttaaaaaactaaacatactcttaccatttaatcatttgggtatttactcaaattagtcaaaagtgtatatccacacaaaaccttgcacatggacgtttatag

SEQ ID NO: 153885 - DNA, 654 bp, Homo sapiens
gtttagctcctgtaagtaaaactcacaaaagcatgggggcctccctataactaggtccccctggagtttttatcactggggcttgtccacacctagcaatttttgtcagctacagtttgtttttctgcccctctcccagtttctgtggaggtttctgctccagcctgttgtgattctctgtatccacctgactgtctctccagttctgggagcagtggtgtcttagcctgttttcacactactatcaagaactacctgaaactgggtaatttataaagaaaagaggtttaattgactcacagttccacattgctggggaggcctcaggaaacttacaattatggtggaaggggaagcaaggcacttcttacatggcggcaggagaaagagagcaaagggggaagtgccacttttaaatcatcagatctcatgagaactcgctatcgcaagaacagcatgggaaactgcccctcccccccgatccagtcaccgcccaccaggtccctcccctgacatgggattacaattttagatgagatttagtggggacacagagccaaagcatatcaagtggtttctcctgtgacctcactgaagtttttgagaaatacatgcacgtgtattttttaagtcatcaagagcaagtaagtataa

SEQ ID NO: 153886 - DNA, 355 bp, Homo sapiens
gtcaaagatcaaaagcgaggctgctttccctgctccttttacacaccagtggttttctttgcacgcaacccttcatcagtcaaacattcactaaatgttgcatattttatctctcttagaatatgccctagatcctaatcttcacaagtgtcattggttatctagtgcgtcagcacagcacataagcctaggttcaaacctctgtcactcagtagtagtctgggcctcacttcattcattcattgatgcatttattctagattccaggaaagcagtagagaataaacagacaacaataacctgcctcactgaagtttacattctaatgaggacagtccaattaacaaaacaaata

SEQ ID NO: 153887 - DNA, 380 bp, Homo sapiens
acataagctatttgcctgcaatagagattttgagaggctttgaaatatatttgattccttctttaaagtaaagcaacgtgcatattgtggaggagagtttttgaagtgaagaagtgacccaaagcaaaaggaatcaataggtagcaagtacatatacaaagaaaggttaattcaccaagggctgatgtgctgaaaatcctgctccccaaactccgctccagaaccatcaaatacagctggagcaattacgtcagacacgactggtattaaagtccatcgtgggtgcacaacaggtggacaacgacgataaaaagaacaatttcattcacaaaatgagtttttgtcaggttcaatgacaaagaagttttcattttttttca

SEQ ID NO: 153888 - DNA, 528 bp, Homo sapiens
atactgaagcttcaatctctactccttttaggagctaaagataggaaagcataaaacattttctattactaaaaattagaattctaaaaaaaactttcccactgaacttgctaagccactgaagatcttaaaatggagtcgagggtgagaattcgggagaaaagaatgagggcaattgtgctgaggcgaggcccagcggttactccagtgaaaggcagctgcagtggagcgccacctgcatccacacacttcacacggtgcccatacacagctggggctcgatgaacatctgctgaactatattaataagtgcacaacttcagatgtgaaataactttataaattagttaaggctttaagagtcttcacaggaatccaatcccttgggtatgacccttctcatgttaagtgtcaccctcaggtaaggccctttattttcccttgaggatatctcttcagcctataaaaaagaaaagaaccaactcccactgaggcaaccacatctttcaatttacccttaaagcagag

SEQ ID NO: 153889 - DNA, 388 bp, Homo sapiens
agaagcacagcgagcccgccaggggcacagcaggcgctcgatacacagccactgccgcgatcaaggggggactcaatacatagccactgccgcgatcaaggggggactcgatacatagccactgccgcaatcaagggggcacagccactgccatgatgaaggtggggaggccctcactggtccaactccaggacggagcagaaaggcagctgcgggttcgtggccccacccagctcccccgacccgggtcgtccagccacgagaagcaggaaaggctgtcacgccgcagatggcccacaaggaccaggagatgtcacgctcagggtccagacacgcaccgcgccagcccatgtgtacaaaatgcccacaggtacatctacagaggcag

SEQ ID NO: 153890 - DNA, 343 bp, Homo sapiens
aattaacaaactggccttagagagacatatggaatggtattcaagaatacaacagaggagcaaacagtgtggtgtcaaagaagttgatatttgaacagagtacagagtcctcaattccttaaaactcggcaaaataagccagacaacaggaatgtgcagctactatgaaatgctccaagcaggatggatgccttcatgcatgccaaatccagagaccaaaagctatcaggtcactaaaactgaaaactgaccagtgtctaatcctttcctcctctttcagcaactacagactgagttacctaggaaaacaaaacaaaatacgatgtctctttgaagtcctcag

SEQ ID NO: 153891 - DNA, 540 bp, Homo sapiens
tgaggtgatctagaggatcccggtgttccttcgtctggctttaagatcaggtataatatatcctcataatacagctgggaagtgttccctccacttcaattttgggaaagacttagagaagaactgacattcattcttctttaagtatttggtagaattcaccagtgaagccatctggtcctgagcttttcctcgtggggatgtatccgattactgattcaatctccttttcatgatgggttggttcaaattttctgcttctttattattcagtcttggtaggttgtatgtgtctaggaatttatttcttctaggctatacagtttgttgatgtatgattattcatagtcatcacattactgactgcctgatactgcttgtagtgctttttaaagctatacaatcatagttaagaaaatacatcattctttactttcaaggacttaacaagtcaaatgaggtcaacacaagtagatagaaaaaacccctaatacctttataatgtgcaggagaaagacaaagactagacttgtttgcaat

SEQ ID NO: 153892 - DNA, 242 bp, Homo sapiens
tcatagtgctaaaatcccttgggtgtttaatgatcatggagtagccaggagcaataaaatcagtcacaggaaatgaaaagaaagcacttggatcttttctctgcaattgtctcatcagttgattcaaagcttcttgaaggggtgtctgttctacttcttcttgtttggctaaagagcttgtgagaggcttctcaggaggcaagtctaatctcacaggggcgtgacaaacaagatggttacag

SEQ ID NO: 153893 - DNA, 475 bp, Homo sapiens
attctcctgcctcagcctcccgagtagttgggactacaggcgcccacgcccagctaatttttgtatttttagtagagacggggtttcaccatgttggccaggattgtctcgatctcttggcctcgtgatccgaccgcctcggcctcccaaagtgctgggattacaggcgtgagccaccgcgcccggcctctgggcacttttaacaacactgcaaactgccccgtgcccttcctgcgggacggtcactgctccaagcacctttcaaatgctttccacccggagagcacactcggctgactccccaccccgagagacctcagccccaccacgacccttcctccatccgcacggtggaacctgcccctaccagcttcagagcgcctggtacccacggcctggagccacgcccagaacaaaaggggccctcagtatgcactcttcagtggtatcaagagagcggctccgtcgtccccac

SEQ ID NO: 153894 - DNA, 489 bp, Homo sapiens
aaggggtttgaagagggggatgtgacttgatctggaggtcccaggggaattgtgctggggcctaaggatggggaggagtttgccagggtggcagtgttgggatgagggggtgatccaagcacaggggcaacataattcagaatgtttttggtggcggggagcaaggatgcagggcaggactggaaggagagtgggctgtggtgcagagggcgtagaggggactcaggatggccacggggtaagatgagaaaagcctcttaagagccacagaaagtcactgaaaagttttagctgaggaccgttgcaacgatggtcctcagctggtactttttatttttttcttcgtctcttcttcttttttttttttgttgtcggatagggagtctctcgtgagggccaggtttgattgaatgtggcgttgaccatagtgcagtgcagcctcaagctcctaggctcaggtgaccctttcgcatcagcctcccaattagc

SEQ ID NO: 153895 - DNA, 215 bp, Homo sapiens
acaggcacagcaacaggggctggcaaggatgaggtccccaggaggcaggaatccagacaaatgtgaaggcattagcagcgagtggtagagccctcttctggagtcaggagggatgaaagagcaaagaggaacagtggagagggagcacaagagaactcgtaagttggattttttttttttcccaaagagacagacagagtcttgctctgtcaccc

SEQ ID NO: 153896 - DNA, 485 bp, Homo sapiens
ccggccagcactggtttcttataataatacctacctcataggttctggcaagaaacaaaaatgattcatgtaaagcgcgtagcggaagccgtggtaaatgttaacttgttttctttgttcctcattcctcagttctcttggatgaacgtgccctgataagcactctgtgcaaaagcatgggtaggattttaatttgattgtgtcctgaagtatacatttgagaccccaagtctaactcgggggctccacgcaaaggtggggaatttaactttcccattccttatccaggccggtccctctcagccgtcacggacccccgctgccccagacacaccaccgttttatggctccacacaacgacagcaccatgttgctgtaagggtcccaccttcttaggggaggcgatggtggattcagctatagttgccaggagaccagttttgtactgggcagcttggtattggacctttcagtcaggaaactga

SEQ ID NO: 153897 - DNA, 263 bp, Homo sapiens
tcaggaagagttgttgaggactcggtttatgtttcatagcatcctcctctaaaggccttggggaaagtggtcctgtcaggtctcagtctgagggcttcatgtcctttttccccaagcattgggtttgtgtttctattttacattgcataactggtcataggtcctgtccactttgccaaagaaaggttgcaagtttgattctgagcttcttcagtagcaatgcaaaaaggaaatatgaccagttatgcaatgtaaaatagaaa

SEQ ID NO: 153898 - DNA, 268 bp, Homo sapiens
cacctcttctagaagaagggtttaggcagttagcttttatttcacaaagcatttacaatctagctagtctttgtattctcatgtccctctattttcccctggtgtatcctgtgttgtaacctctctcctgcctcccattctgcaactactttgttctttcgtttcctcccttatcttttttttttttttttttttttttgggagacagtctcactctgtcaccaggctggagtgcggtggcaccatctctcctcactgcagcctccgc

SEQ ID NO: 153899 - DNA, 456 bp, Homo sapiens
agatatgaatttgcagggggatggacaacgtgttgttcaacccaacacaaacaatatcctccctgtttgttccaaagcacacttacttccttttactggtaactttttacatctgacattagcttgctgaactaatttatagattgcagttgcctggtcagataatttgtctttaatcagacttttattactttgttgttattggagattattctagtgaaaaagggaataagcttaaaaagttgcttgtcaactacacacacacacacacacacacacacacacacacacagaaattcgttgtaaagaaaatatactgtagtctgggtgtgatggctcatgcctgtaatcccagcactttgggagactgagtcaggattgcttgagcccaagagtttgagactagcttgggtaatatagagaccccatctccacaaaaagttaaaaaattagcca

SEQ ID NO: 153900 - DNA, 333 bp, Homo sapiens
aagagttggtgggttaaaatggagtcatctcattttctgggttgacaggtgaagctgcgctgggatgcttgattcttggctggtctctcctggggtcactgatgaagccgcagtcagctggagtagatcggcacactacagcctcaccgacatgtttggacagctgctggctgtaccacctcagaatgggtccatcgccactttcgcttccttgtagtgctccaagccagttatggggtcagtccaaatccagatcccaggacctcctcttcttgacgggagctgtggcaatgtcacagtgccaagggctgggctgtgtgaaacaggatgaga

SEQ ID NO: 153901 - DNA, 217 bp, Homo sapiens
ggtcacacctcttgaaaaggttttgtttcccccgtcaattggtattcaaaccaggtcagcagattctgtttgcccggctccgctgccgttttcattttaatttgcacctgttgtgcagttgttcggaaggcaagtgcagacccgcggattatacaaagatcatattatgagcagatatgcacggtgtaatctttttgtccccagcttcacatgacaa

SEQ ID NO: 153902 - DNA, 361 bp, Homo sapiens
aggtgattcaaagcaatatttgcagtttatttaaggtcgttctattccttttgccgtctttatgagagttccatttccttcctgatattttaccctttggatcaaaaacacagaatgtgttaacatcacataccctgcccagccacccactatcacctattcagctctatagattcaagccccttctcaaagcaagttcacagcatgtagaaaccggaaaaagaaggaatttgagagagactacagctcacagcccatggaatgaaaaccaggagcacccatggctgggtgtggagggactgcctaaggaaaaacaccagagaaaaatcaatcctcaacagcccatcaccagttatgaatc

SEQ ID NO: 153903 - DNA, 231 bp, Homo sapiens
cccttttgtcaatacccctatcaatttttgctagattactgcaatgaacttcaagatgatcatacctgtagttatcccaatttcaatgggattcctatatgccattttgattcatctgcccagtatacaacttttatcaataaagaaagcagctccaaaaatccacaggtgcccccaagattctacaaaaatgggaagaaatctcacctggcaggactcaatgccaccccc

SEQ ID NO: 153904 - DNA, 194 bp, Homo sapiens
ctactgacggagtcctgtgtttgtgagtcgtttcccctatggggaaggttatcagtgcttcccgagtgagcatggaacacttcgagttcccagggttatagacagtcgttcccagtgtggctgaggcaggagaactgcttgaacctgggaggcggaggttgcagtgagccgagatcgcgccactgcactccagc

SEQ ID NO: 153905 - DNA, 275 bp, Homo sapiens
cctccccagtgtgtcccctttgcttttagatcaaccgtcccaaggctcttggcacattcgtccccctcttgcctctgtacttggcttatgccctttctcctccttggtgtccttccctcctcttgctatgcaagaaaatcctcccttctatagttgatctctctccctatgaactcctaatatatttatagttggttccatatagcatgatatttcattgaatacagctttaccctatttgataatttttgtctgttactcttaccttcctaact

SEQ ID NO: 153906 - DNA, 467 bp, Homo sapiens
aatgatgctatttaatttatattttaaatttgggtgctttgtggagaatgggtgggaagatggagatagggataagagaggaaaatggaaagccagatggttggctgcaatacaagcaagagctgatcttgacttagaccagggcggtggcagtagagaaaagggacaggcagattacatatacatatagagagagacagtttttgtgtttgtttgttttttcactttttgttgttttttttttgagatagtctcgctctgtcacccaggctggagtacagtggtgccatcttggctcactgcagcctctacctcccaggttcaagtgattctcgtgcctcagcctctccagtagctgggactataagcacgcaccactacacccagctaattttttagcagaaacagttttgtcatgttggccaggctggtcttgaactcctgggctgaagtgatccacccgcctc

SEQ ID NO: 153907 - DNA, 286 bp, Homo sapiens
cctgtctgttcccctcaatggctggaggccccctccttccccagcagaatgagcccagcactccctgcagcagtggggccgtacggcgccatccaactctgatccgtgttcagattccaacagcctcagccgcaaagcacacagaagcctgtcctgggcccagggcagactcccagtggacaggagagttctgggccccgtgtccccttaaccctgtcccaggcccagggccaactcccagtggacaggagagttctgggccctgtgtcccccttaaccctgtccc

SEQ ID NO: 153908 - DNA, 357 bp, Homo sapiens
ataaatctataagagctttggataacaaccaccactttgaccttggattacaatgactaaactttcattttctgaagacttacaaaagctaatcatttggggtagctcaagtttgaggggagattcttttgttactgtttttaaaaagctcaactggatagttaatttaaaaaatattcaagtgtctttcagatccttcagaatgaaacttcaaaatgttcaacgtaacagtttcctccctattctgggtgtgtgccgaagttttccttcccaccaattaagagagaaggctgggcccaactgaattatttggacaggagtttgatgtcagttaaataccacagtaactggcatttt

SEQ ID NO: 153909 - DNA, 207 bp, Homo sapiens
acaaagcacactgcactttcataagggatccccatgactgacagatcagccattcaaaagaagggaagtgtcagagatggctctgctagactcatgtatttttcagtagaacctgggtcaggatggtatggttgggagatgcttctggagctctgggaaccacaagcctgcatgtcccatggtggagtattagcacaacttgaaaac

SEQ ID NO: 153910 - DNA, 305 bp, Homo sapiens
cagcgtacaatctaagatgacagttgagattttcttaacgaaagtttttcatagttggacaacagagtgctcctacatgcccacattcagtgtccattccaaaacaaattctacttcttccatgtgtagcattttgcagataaactgagtagtgattattcatccagcacatagttcttacccctgtttctcacttgctttggcctcggcaggccgggatatatgagaaaaaccaagaatttggagtcactggatttattagttccatctcttactaattcagtgaccatgaataagctccaaca

SEQ ID NO: 153911 - DNA, 290 bp, Homo sapiens
tgctcacatgcactgtacacaagaggacacacatacacccatcctcacacttgcatacacacagacacatacacagggtgcatgcacacgtccacaccacgtgcttgcatgtacatacacatacaggcacgtacacacccccacaccacatgctgtctctctcacacatacacacatgggcacattcacagggatgcatacacgcccccacaccacatgcttccatacacatatgcatacatgagggcacatacacacgcccatgccacatgctcacacacatacatggg

SEQ ID NO: 153912 - DNA, 398 bp, Homo sapiens
actgaggttgtcagtttctgttatttcttttttcttttagtgatgattcctgcgtattccaagaaccgggcctatgccatcttcttcatagtcttcactgtgataggtgagtgcaggtaacgtggccagcattttgtgacaggatcccgagagctcagggaccgatacaccctgctgcctccacgacctgaaacttcacatccgtgtttttcactccagagatcaccccagggatcccctgccaacagcttttaaccccagagatcccccaccaacagcttcacccgagggatcccccaccccacggcttcaccccagggatctcccgccaacaggttcaccccagggatcccccaccaacagcttcaccccagagatcccccaccaacagcttcacc

SEQ ID NO: 153913 - DNA, 493 bp, Homo sapiens
tggtgccctggagctgccgcttctgctcttagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggtgagtgcaggtaacgtggccagcattttgtgacaggatcccgagagctcagggaccgatacaccctgctgcctccacgacctgaaacttcacatccgtgtttttcactccagagatcaccccagggatcccctgccaacagcttttaaccccagagatcccccaccaacagcttcacccgagggatcccccaccccacggcttcaccccagggatctcccgccaacaggttcaccccagggatcccccaccaacagcttcaccccagagatcccccaccaacagcttcacc

SEQ ID NO: 153914 - DNA, 945 bp, Homo sapiens
  misc_feature (106)..(106): n is a, c, g, or t
  misc_feature (185)..(185): n is a, c, g, or t
  misc_feature (223)..(224): n is a, c, g, or t
  misc_feature (230)..(230): n is a, c, g, or t
  misc_feature (242)..(242): n is a, c, g, or t
  misc_feature (282)..(282): n is a, c, g, or t
  misc_feature (292)..(292): n is a, c, g, or t
  misc_feature (299)..(299): n is a, c, g, or t
  misc_feature (354)..(355): n is a, c, g, or t
  misc_feature (357)..(357): n is a, c, g, or t
  misc_feature (372)..(373): n is a, c, g, or t
  misc_feature (382)..(382): n is a, c, g, or t
  misc_feature (385)..(386): n is a, c, g, or t
  misc_feature (388)..(388): n is a, c, g, or t
  misc_feature (393)..(393): n is a, c, g, or t
  misc_feature (395)..(395): n is a, c, g, or t
  misc_feature (398)..(399): n is a, c, g, or t
  misc_feature (408)..(409): n is a, c, g, or t
  misc_feature (412)..(412): n is a, c, g, or t
  misc_feature (415)..(415): n is a, c, g, or t
  misc_feature (422)..(422): n is a, c, g, or t
  misc_feature (425)..(425): n is a, c, g, or t
  misc_feature (429)..(429): n is a, c, g, or t
cgtgggctgctggatggcggaaccccaggcggagtcggagcccctgctgggcggggcccgcggcggtggcggcgactggccggcggggctgaccacttaccgcagnatccaagtcggccctggtgccgcggccaggtgggacctctgcattgatcaggctgtggtcttcatcgaagatgctattnagggttacctgttcgggtgggcccatttccagaaaaanntttggntgctgggctacntcgtggtgctggtggtgtctctggtggactggaccgtgtncctgagtctngtgtgtnatgagcccctgcggatccgccggcttctccgtcccttcttcctgctgcagaactnntntatgatgaagaagannttgaaatgnatnngntggtngntgnnggaaatggnnagnatngggctgntgntggncatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggtgagtgcaggtaacgtggccagcattttgtgacaggatcccgagagctcagggaccgatacaccctgctgcctccacgacctgaaacttcacatccgtgtttttcactccagagatcaccccagggatcccctgccaacagcttttaaccccagagatcccccaccaacagcttcacccgagggatcccccaccccacggcttcaccccagggatctcccgccaacaggttcaccccagggatcccccaccaacagcttcaccccagagatcccccaccaacagcttcacc

SEQ ID NO: 153915 - DNA, 274 bp, Homo sapiens
tctggattctgtaatggtagataaagggctataaacacacatacgcacatatatatatgtctctatatgtctctatatatatgtctatatatgtgtatatatatctgtatatatctatatagacatatatacttttttttttttcccctccttgagacagcctcactgtgtcgcccaagctggagtgcagtggtgtgatctcggctcactgcaacctccgcctcccaggttcaagtgattctcctgcctcagcctcccaagtagctggaactac

SEQ ID NO: 153916 - DNA, 448 bp, Homo sapiens
tttcccagatcctgtaggacgagtcttggttttggggtgtgtgagtgtggtgtgtgcgcgcgcgcctggagggaaggatcaggcaacttggcgagagaaggaaggaccgggcgctgcttataacccaccgaaaggcacgctttgcccgcgtgaaactgacaagaaacattgccgcagtggcttgacttcatcatctaagtatctatttacttggcccccacccacccactccttttcctctgccagtctctcccctacctccttgacgcctcccactctccctccctggctctggcagagggaggaagatgaaagagaaagccgctgccgctgtgatggacaccacattgatagatgctctgacagtggggagaggcgggaatctgggactgagaaaaaaaggaaaaggggaaaatataacagacattgctcaactattaagagagaa

SEQ ID NO: 153917 - DNA, 350 bp, Homo sapiens
aacgggtgatgcggttgtaagtaagagctaagtcccctccagcccctgggttgtcttttctatgacaacatacttcgcccacaccactccccgcacccatggcagccccataaggtcacgtttttcctaagtcagcagccagctggagtgtaagcactgaagagcgtttaagcgacttctctaacctccattcataaatatgagccaagcacgagagcagctcgacttccagtccagagggatggcagagttcaagagcatccaggaaacaagcccttcacgttccccaattttcatggctaaaactgcacttgtctacttttccaaccgcatcacccgttcgggtacct

SEQ ID NO: 153918 - DNA, 250 bp, Homo sapiens
gatggaacatccctccttggtacatccctcccaagcccctggtctccagcatgcattccctgaaaggcctgacccaggcggggaacaaagccaatctttctttctttctttgaatgaagctaaacttggcctggcagggtgtctcatgcccataatcccagcactttgggaggccgaagcggcaggatcacttgaggtcaggagttcgagaccagcctagccaacatggtgaaaccctgtctgtgctaaa

SEQ ID NO: 153919 - DNA, 363 bp, Homo sapiens
gaaggtgctgaattcccgcgtgtgtttaaaatacacgagcgcagactccagtctacaccctgtagtccgcattaagcaggcataggtagctgtaggagtggaacaaaagcagcctgtgtttaatctgttcacaaatcttttgttcctaaatacttggaaaggtggttagaccaagtaagggagagattcaggactgggtggaagctttgatttagactgatggctgacaatgcagataggaggctggtctctctaaacacataaattcgttatctaaacagagtgggtaatgtcacaaatgcctgggaacctaactgaaacagttcatgatttgactgtagtcagtccctgtttgggcactcc

SEQ ID NO: 153920 - DNA, 500 bp, Homo sapiens
aatatctctattcttggagatagatttaatgagctttttctccctctctattcacttattccttgtgcatgttatcaatattttgaaacataatgtcatgtcctttgatcagttgaaggctgacattgaaaaggcttatggggattgggtgttgtggctcacgcctgtaaatcccaatgctttgggaggcagagtcgggaggatcacttgaacccaggagtttgagaccagcctgggcaacaaagtgagatcccatccctacaaaaatttaaaaaactagacatgtgccattacacttcagcctgggtgacagagtgagactccatctcaaaaaactaaactaaactaaacaggcatggtggcacacacctatagttctagctactcaggaagctgaggtaggaggatcactcatgtccaggagttggaggaggcagtgagctatgatcatgccattgcactgcactaggccacagagtgggaccctgtctcaaaaaaaa

SEQ ID NO: 153921 - DNA, 426 bp, Homo sapiens
gctctcctgaagagtcagcaactctctcccatgtgatgtatgctgcaacctcatgatcgacttgcaaatcctcagacacatcatgctttcactcaggatccttctttgcttcctccatttggcaaacaaatcaatattatttatgctttagtctaaatgtcacctctcccaggaagtcttccctgactctctactttaagtgtaatcacttattttctctctagattctcactgcacatgggacattcttctatcatggcactatccaatgatattatatcaatagaaattagggattttttttactctactcctcccaagaccataagcacattgaaggcaaattttattccttgccatttctatttttttcttttttttttgagacggagtcccgctctgtcgcccaggctggagtgcagtggc

SEQ ID NO: 153922 - DNA, 517 bp, Homo sapiens
aataggaatttaactttatgtttactcttttttctttgagacttagtcttactctgttgcccaggctggagtgtagtggcgcgatctcggctcattgcagccttcggctcccaggttcaagcgttctcctgccttggtgtcccaagtagctgagactacaggtgcctgccatcatgcctagctgatttttttgtatttttagtagagacagggtttcaccatgttggccaggctggtctcgaactcctgacctcaggtgattgcctgcctcggcctcccaaagtgttgggattacaggcatgagccactgtgtccggcctatgtttacattttttaaagaaaaatttcagacatatacaaaatggacagatagtctattagtcactcatggaaccatcagtcacctctcaccttcaacagatatttcctgccagtttttaggaatttaatatcattaagttatttgctaagatttgccaagataagtatctgtaaggtcaaggtactgacatcagaa

SEQ ID NO: 153923 - DNA, 181 bp, Homo sapiens
gggaggcagaggtttcagctagccaaaattgtgccactgtactccatcctgggggacagagtgagaccctgtctcaaaagaaagaaagaaaaaaaagagactagaagccttataaaaggaagagagatccctggccccttccgcaatgaggacatagttaaaagacctcaccagacactac

SEQ ID NO: 153924 - DNA, 484 bp, Homo sapiens
ctggcgctgaaggtcgggactgccccttggaagactggctggatatgcagtcgcttccagaaggggaattcttcactatttccttgagattcatgcactgattcactgctcacctgtttatccagtggcaggaattgtcctaggcaatgggattccaaggtgaaaaagagaagccacaagtgtcaattgtgtattgagtgtttaaaaagtcattcccacggacacttcttccagaaccaaatattgtttcaagtgctcatgttgggtagtatggatgctgcatatgtgagtgtgtgattttgttttctttcttcatttatatttcaagttgaaccagtgagaggagcttctcttgagtgtctgctgtggctggcttctggcacgtggtgttccttttccagctcgccagccttggttctgatgctctgggatatacaccctatctgcacagcccttccacaccctcggagtgtgccctgaccta

SEQ ID NO: 153925 - DNA, 515 bp, Homo sapiens
atgtgtcagttcactgctccaaatgcaaacacggatagaaggaacctgaccagaaacagtacattccgagggtgaaaagcttcaaccaacacagcttcataaagtcaaactcgagcaaaatgcctagggtcagcggtgatctctggatagaaaaagctctagaatttgctaacccccttctgatagctagttttcaactatagagcaaaagaggtcatccctctggccatgaatggccattccacggtgcatgctcaagttgaatgcaggtagttggactgaacattcggactccaaggcgtttgtctaaaacccagctcggccgtttttctccactaaaggagaggcaaaaatctggtttatcaagattgttactattttcgctgagtttttgggtagatagaaaacatttttaacatacctagttgtatgcctgagcatgtttaaaaccagttgttgggatgagctattcctggggtgttagcccacacaaaatatagcaagtgctgtaaatg

SEQ ID NO: 153926 - DNA, 539 bp, Homo sapiens
caggaggatcccttaaacccaggagttcaagaccaaactgggcaacgtagtgagactcatctctacaaaaaatttaaaaataagctgagcgtggtggctcatgcctgtagtcccagctacttgggactaaaatgtaggagggaagtcgaggctatagcaaactgtgatcacatcactgcactccaacatgagcaacagagggagactttgtctcaaaaaaaaaaaaaaaggaaagaaaagaaaagacaacattctgaccacacaacaaaaatcacagttgttagataagcccgttgccaacagggtattcaatccctggcctaaattaagaaactgcagcagtccttggtacaggtttcacttagctcactggggcttcccaatgagtcttgaaatgttgggtgacacagaggctttagatacaataggctttcagtgacctttagcaacacagggcactaaggataaacttcaggggtggggtttggtgttggctaaagcaaaacaaataagaatctgtggacatagagattatccta

SEQ ID NO: 153927 - DNA, 581 bp, Homo sapiens
aaaagaatttattctttcatgtcataaatgcattgcatgaagattcaaaatttgatgtcattgttataagaagtacaacatttctggctatgtagtgaacattaaagaattactagatgaggtgaaatctgaagtgctcattacttgttagaaagctctaggaagaagtcagagaatgacttcaagataattctttccactgataataaagtgaagtgcattatgaatgatgcttgggaagtgggtgatgatgggtttgagcatatggttgaggtaatagggagagctcgttgaaggtcagtgggacctagaaaagttcatgaaagagtggtggtgaaaacagtgttgatgcattaaaacaggtagctgagattgtggtcctttacatgaaaaactaatcagcacctttgctattttggagcagacctttaagattacctgtataataaatgtgtgcagacaccatccaaaaaggtgtaaaaaattgcaaaggaaaaataaatactggccaacacagtgttcttaaaagtacccatgcctagtgagtcccctcccttgctgttctttcacattctgttcca

SEQ ID NO: 153928 - DNA, 586 bp, Homo sapiens
ccctttgcttcccaaattagaatatatgctcttgatgggcagagatcctgcctgctttgacacctatgatatcttagctcctaagacagtgtccagtaccttgcaatctgtcaacaatcacttgtggcatcgatgtgcagttaacaaagtggccagattatatcttcagaagttaaaatcttttgctcaatgtagttaactatattcccccacaaagttgcaaagtaaaacctaagaatctgccttaaaactcataagaattcaataatttgttgcctgatgcccctcccaagttaggggtctgccttcatgtcttcccccatgagagggaagtctccctgtggggcagtgactcgcacctgtgacagggatgttctagcctttccttgccaacctccccatccccacccacaacccatgtctccaccataataaaatgaataggctcgaagggataggccgatggcaggaaagcataaagatcagtttgaatgatgaggcttagcgataaaggctcaaggagaaggaagccagtgtgtgttgatcagaaccctgccaggtacgtcacagcaggttgatgccctgt

SEQ ID NO: 153929 - DNA, 593 bp, Homo sapiens
gctccaaggcggacggctaagcatcaaaaactgcggctctgatttacattccccagctcccaaaccaagcatcttctttatatattttacatgataacttcctattaaggtttgacgaaagaaggttttgctactgaaaccaagtctgaaaactaatgttaatacccacggcctctagtacccagttacaagactataatcagtgggaaagcagtgcctccaacaacaacaccctagggtcacttactggtctatgcttctaattctgttccccctcaggaacgctcatgttcagaaatagtccagtttctacttctaatcctcctcaaaatggtgcaaactctgggtaacactggtagagccaccagaatgctaacaaggaaaaaggaagggagaaatggagggaaaggtaagagaaggaaaaaaatatatacaataccaaattgaaaagaacctggagcatacacagttggtggaagtatagagtggtacattcactttggaaaactgacaatacccactaaaactcagcaactgcactcctaggaatatattaaacaaatgcatgcaagcttcattaaccaaaagacatg

SEQ ID NO: 153930 - DNA, 431 bp, Homo sapiens
gagaggctgagccagacagctgcacctgcccaggcacggcagttccccagaggctgccaggcacctcggtcagagtgaccacaaagtcactttgtggagagttcacgcgtatcaactgtctgagtattaattttccccttaaaccagaaaagccccagagctttgcttccagccctggcccaggctcatctaggtacaactggatgttaattgtatttgtgccgaaacagacatcaatgagaagcattaacaatgatcagaagcctgcaggtgtgctcagggtccccttggccacctctgtacgtctgcatttctctcacagagaaaactctcacagggcatttcaagatatttctggaactgaaacgggcttttacactttgctcataaataacaatcacaaaccttcatcttcaacagaatatccgggt

SEQ ID NO: 153931 - DNA, 322 bp, Homo sapiens
caatggaagggacatagccggttcttcaaaacatatagtaagttaacataaaattacagaaatgtggtctttgcagaatgggaaaccctaaacaacttacattttactcaggatttagattccatgacaatgtggcctttttgcttcctaatctgttacttgcatacacgatgcttaatggcacgactcaaagtgttggtaagtgtggtgtacccccgtcccgaatcctgaattttctgtggacaggaacacattttaataaacgcttgcctagtaaaggaagttactgggaaaattctctgtgggagccaagcaatgaaga

SEQ ID NO: 153932 - DNA, 695 bp, Homo sapiens
gggcaggcattagagttggtcttggtccagtcctaactcccttttcttgtttgagtctgcacagttgctagtgttacttgtgggttgaaaagcacatgtaggctacagtgtatgtcttttggagctgactgggataagagtgaacaggaaggtgatgattgacctgtgcagagcatgcactgtcgtctttggggctgcattcagtttagtagttagaacataaatgcatgtcaccattcctgatggctttgctcctgacagccttatgacagggaaattaccagcgagatccactgatccagcagtagtttgagaattaaacatctcaacctgagtctttagctgtcactttgcattatttcttccacttataaaatggggccaggcacagtggctcatgcctgtaacttcaacactttgggaggccgagaggggcagatcgcttgagctcagggaccagcctgaggaacatggcaaaacactcgtctctaccagagatacaaaactagctgggcatggtgatgtgctcctgtagtcccagctacttgggggtgctgaggcaggaggagtcccagctacttgggggcacttaggtgggaggatcacttgagcccgggagatagaggctgcagtgagccatgtttgtgccactgcactccagcctgggcaatagagcaagaccctgtctcaaaaaa

SEQ ID NO: 153933 - DNA, 664 bp, Homo sapiens
tctcttggccttgtggagagaagtaggggccagggaagctttctgggacagggatgcagccacatttcccctcggcaaaagccggctcaaggaatgcagcaccactggatctccaaggagctgcaatgagaccaagaatggggctggggtgaatccagggaatgggacgcccaggacaggcctaagagagtccttatcccggtgtcattttctgggtgaaaggaatcaagggtagtcctaactcttaggctttccgggaagataagagcgtctggtttggccagcaagagggtggggctgcccaaagatatgggtggtcaggaccaagggttgaagatcaggctactctctgtgtttctgagaatcccacctgtgcagcgcagggactggacacttaagaagcccagaaaacagcagcagagtctcctggccaactctctctctgtttatacatggggaagtggaagcctagagctgcctcttggaggaaacaaatacaggcaactgcaagaaattgctcagtgagccttctctgttccattcaagctccactttgtgtcccacgctcctgcattccagtgctttgttatcagctgggccacatccaattgctcaggggtggctggaggagtcccttgcagcctgtgccacaacacacaatgcc

SEQ ID NO: 153934 - DNA, 175 bp, Homo sapiens
tgcaaagggtgaggttgaaagactgaccatcttagaggctggagcacagaaactgagtgcctggccaagatgaggtctgatatactgagatgtgccagcgatatcctatgagcctgctacactgagaggtgctaggtgctaatcaggatcgaatagacaatgatgaggaaatgaa

SEQ ID NO: 153935 - DNA, 435 bp, Homo sapiens
ctcataatcttggcttcagatacacacacataaaaataatcacattcttaagtcctatgatcaggtactgtgtctccatgatctccaatgaatagtcccaaatgttagcttatgaaaaatgcacagactctgtggttaaatacggacattgtagagagtttataaacaggtggaagacccatcgctgggttaccctggggagaaacggtctttatcctgagatcatgtccttcctgctgtgtgatggaatgacagtgacagtagagggtgatgtatttgttggggttagtctttaaaatgtgggaataaaaaatgattttgttaaaaaaactcaaaattttactgctatttggacatctggttctgactaatatggggtaacaggaacggggatttaccctcctgctgctgtaaactactagaaaactggatgaa

SEQ ID NO: 153936 - DNA, 291 bp, Homo sapiens
cacttaacaaatacttaactcttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccatttatttatggaaaaaaacttgagatgt

SEQ ID NO: 153937 - DNA, 725 bp, Homo sapiens
cagactgttttaggaagtatttgtgtatctcctccccctagtagtttggtttggtcagctctgtgcccagcatctctgctcagaaggcaaggacaagggagggaaggagggactgaaatttctttggctgactgaccagatgcagtggctcatgcctgtaatcccagcactttggagggccaaggcgggttgatcacttgaggtcaggagtttgagactagcctggccaacatggtgaagccccgtctctactaaaaatacaaaaattagctgggcgtgctggcacatgcctgtaattccagctacttgggaggctgaggcaggagaattgcttgaaccagagaggtggaggttgcagtgagctgagatcacgccattgcactccagcctgggcgaagaagcgagactccatcaaaggaaagaaagaaaagaaaagaaaggaaagaaaaagaaaaagaagataaaaagaaagagaaagaaaagaagaaaagattcctttgtctattctcattagcagctcattcagttccattcagtgaacactctgagcatctgcctcacttcagaccttgctccagatgcggaattcgccaagatgagtgagagggtctactttgggcaaagctctctgagccttgaggtctgtcttcatcccaaagaatttgcactctagcaggggagaggggaaatgaatggacgaatatttatgtattacttgggttgag

SEQ ID NO: 153938 - DNA, 728 bp, Homo sapiens
acatgataccagcctctgttgagtcatagcaactgctatgaacaaacatgtaaatccatctaggggaagaaaagagtgttgcaaatgcctttcatcaaaatggaagactacttcaacttctatttgctcttcttgttataaccaagctttttcttttttcattttcctctgcctttctttccctccttttttccgtccccactatcctccatctttcagaaatatcaaaagctgaatcttcccaccgaacactgcaatcatttgaaatttgtgtataggccagcttcacatcatcagaaattgtgtaaccccatgattcccaggcctcagctggtagtgtagttatttcaaataatatttaatacaataaattctatggcaataaaagaatttggacagtcccttcgaacttattgcaatgagatttgacttgaatttaatacaatgaagtttcagaatagccaagtaattttgttgtggcatgatttaaagggtatttaagtacaggtataggtgattgagtttgtaaaacctaatcagaggtaaattgcagttttactcttatcacgtgaatgagcattcaaaaatacagaaattctttacttagcataaggtgatttttaacagtgtggcaaagagtgtaagtgaacatccttaactttttgttctgtcaaggggagaataaagataccacctggctgtatgtataaatttgcttactaagatgg

SEQ ID NO: 153939 - DNA, 497 bp, Homo sapiens
tgccaggctgaggggacaccttacgtccctccctcctgagagccggttcctcatggctcctcacacttcctgaaggtttaattgtggattctccacgttgtgtctcagcctacaaagacctgcagtggttgtaccttggtttgaatggatcctcatgtcaccctaagagtctctttccccatttggcacagtttgccgtgggtgtcatttgacatcacaccaggtggctccggcttttctgcgcgtcggtttctgccgcgctgagttgccgccgcttgctctctgcccctcaggtttcctctgtggtttgggctctggctgcctctgcagcagctcaggatatcggcgtgattgacacccacagcgcaggggccgaaccccaccgacagcacaggtgcctccagagccggctccaggccccagaccaggaacctcacccacattaacgcgtgacacccctgcggttcctctgagttgtgatatgatatggataaaca

SEQ ID NO: 153940 - DNA, 729 bp, Homo sapiens
ctgactgcagtgcatgtctgttgctgtcctgatgttaccctctttcccccggacacagagatgctgaagtgagctggttcatagccctttgagaggagcatcgatgatacgtttgcattaacatctgtccatttgtctccagatacagtctgggtggcctcatttaagtagatgctgcacacttgtggcctcctaattatgttctgcacctgtgtgtagtctttgcagctgctctggagactccggggtccccaccaggccctcacaggttcccagcccatctgtcagcctctccatccatttgctgacatgtgactcagctgcagacagagcacaggggtcaggcctccagctgcctttacctgctccatcattatagccagaaacggggaatgagtcttggggaatgtgcttctgcctggctttgctgaggctcatggaggccacccacctgggaatcttgagaccttttccttgggaagaagagaggggacagcaaagagagctggtgagctccttataactgagtaataaatgaaagccctggggtatggctcctcgggccagagacaatgagagctcagaccagacttggtagttttggcaaaggagacattaacatttgtttcaaggctgtttcttgtctttactttgtatcacctcctttaagctgaagtggggaatggttttcatcttgagacagtcccttggagcacatcctgcactggc

SEQ ID NO: 153941 - DNA, 387 bp, Homo sapiens
cccaaggtcacacagctaataagtagtgccaaagtcagggttgaacccagctccaggcccatgtggttggccacatctccacaaggtcgggccctccagagtatctcagagacctggagcttcagatacatcccctgagaaatttccagaaaagagctgcagtcagaaggttcaaggacaggctgggcgcggtggctcacgcctgtaatcccagcaccttgggaggctgaggcgggtggatcacctgaggtcaggaggtcgagaccagcctgaacaacatggtgaaaccccgtctctactaaaaaatacaaacaattagccaggcatggtagtgaatgcctgtaatcctagctcctcaggaggctgaagtaggagaatcgattgaac

SEQ ID NO: 153942 - DNA, 362 bp, Homo sapiens
  misc_feature (347)..(347): n is a, c, g, or t
gcgccgcgcctccgggtgttggggagtccgggatgatggggaatccggggctcgccctagtcgcggggacaccgccttccaggagctgtccccaggcaaactcacagacatcttcaaagaggcttcttggacattctgctttttgctcctcataacaggcttcgatggagtttctctcttattttccaggttgcagtgagccgagattgtgccactgcactccagcctggccacacagcgagactctgtctcaagaataaaataagaacacttgagctgaggaccatcgttgagctgaggaccatcgttgagctgaggaccatcgttgagctgagcatcgttgagcntgaggaccatcgttg

SEQ ID NO: 153943 - DNA, 205 bp, Homo sapiens
gcttcttcaggtacttgaagggttgcatatgttatatatgatgggaaagactaaggaagtccagtgggtcaagagtcccaggacaaatattgtggcttcctatgaggaagactgttcttgtgctaaccaagaggtgtcccctacgtaagatgatgagttggcatctcaccagtgggcatactggaaaaccctgtggtcacttcct

SEQ ID NO: 153944 - DNA, 579 bp, Homo sapiens
tgcaaacacacacgcgtgtgtgtacacacacacaagcatctgcatatttgtacatatcagtgctttgtaaatccttaagtgctatgtaatacagatgtagagtattactatttctccctcagcagccaacttctaaaacccacatctgcttagagttatcttaggggtggcataagttgttactctggttctcctgttgaatgtctcacaaattgttgtctagaactctacgatgctccacctaacaatggcctgcttcctcaatcctgcaagcttgtacagtgcctaggtgttcatgcccatggctttatttaaccttcataacatccctaagagagaaatctgaaaatctcctcttaaccagattactagattcagtccttggaactagccttgataagagctgcactagcaaaaagaaagaacattatgcagtataaaatgtgtcataagtatgcttatttggatgattagcttcagtttatgttgacattatttgatctgattagtttcagtttatgaagacattgtttgatttagaccacacgtaggctgtgtatccacacttaagctaactag

SEQ ID NO: 153945 - DNA, 284 bp, Homo sapiens
tgaacagattttgaagccacatggcccattcaaatcattatggctaggatctgtcaaccatttaatgtgttgtaagcattatgttcagttctttaccttgggcatctcatacagtcctcttaattgctctagtaagcattatctgcagcacagagaagtcgagctctctgccacaggtctcatggctaataaatgatgaagctggggtttgatccaggtctggggctcccacacttgaccactatcctctgctgtctggcccaaaatttacaaactctaggaaa

SEQ ID NO: 153946 - DNA, 236 bp, Homo sapiens
tcttccaagtatgatggttgtcttgatgaaaagcacttgtgacattgagatgcaagctgacttagccacttttccatgcaacattatgtctacttaaatgacaaactacagttagtctaactttgatttttgggagatcttttcttgcaaatgaacaaaatgagtctgtcacttcaagaaaagcaattaacgccaggcgcggtggctcacgcctgtaatcccagcactttgggagg

SEQ ID NO: 153947 - DNA, 617 bp, Homo sapiens
ggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaaca

SEQ ID NO: 153948 - DNA, 333 bp, Homo sapiens
atccaagccttttacctgctactggcttcatttcatcccctgtccagcctaaacctacttcataatcctttacttcagccagctacctgcactagcaacttgataatcatccttgattctgtcttcttccttacccactacagtgtcaatcactatgatgttctcatttttaatatctctcacatctcaccatatgcctccatatccattgccgtttagttcacgccctcatcgtttgtaatctgaattactatagtagctactgattggttttcctgttctctttcaagccatccactaaagcctgagtggatctcttcatacttcattctt

SEQ ID NO: 153949 - DNA, 484 bp, Homo sapiens
gtgcgtgaggggaagctgatgttcgtgcgctcggaacagcggaatgagttctgggccccactcctggagaaggcctacgccaagctccacggctcctatgaggtgatgcggggcggccacatgaatgaggcttttgtggatttcacaggcggcgtgggcgaggtgctctatctgagacaaaacagcatggggctgttctctgccctgcgccatgccctggccaaggagtccctcgtgggcgccactgccctgagtgatcggggtgagtaccgcacagaagagggcctggtaaagggacacgcgtattccatcacgggcacacacaaggtaagtgtcccccatgggtggggtggcaggccatgtccaggcatcacccccactgacgatgctgccccaggtgttcctgggcttcaccaaggtgcggctgctgcggctgcggaacccatggggctgcgtggagtggacgggggcctggagcggcagg

SEQ ID NO: 153950 - DNA, 665 bp, Homo sapiens
tgtagttttgaggaatatgctattttataatatatagtaaaactgtttgaattattactttaagctagaaaaggagatttcctacatcccaagctgctaattcttaaaacaattcaattattacggtagtaaagtaagaaatttgttatccttctgtccttaaaaccacattttaaattaaattattggtagcagtttactgtgtatcttttcaaatgtagtaacctttttaggatgtcattggtgactataaagtagttctaaatcaagcataaatagccattgaaactgtttattatagaaaacatgaaacatacaggtagtgtgctataatgagtcccctgaacttaacactcagcttccaaaactagtgactcatggtcatattatttcatctttactgtttttactaccttgattttccaaagtattttgaagcaaattatagacatatttttaactagaaatatttcaaagtatagacttctttaaaaacgtagccacaaagtcattatcacacctaataattatttactatcaaatatatagcttcagacttcctcaatttctcataattttttgcagttcaaagcagaaccaaataaggtctatacattgacacaaatgattgttttcaagttatcttgctctgctaactgagatta

SEQ ID NO: 153951 - DNA, 295 bp, Homo sapiens
aacagtgaggggtggaagtgtgttggggggtggatctttcaccaatggttaagcaccatcttcttgatgctgaccttgtgatactgagttctcatgagatctggttgtataacaggctgtgacacctctttcctctctctgtcttgctcctactctggccatatgcaacattttattgctgcttgtccttctggtataattgagaggcttcctgagtcctcccagaagcagaagttactatgctttctttacagcctactgcagaactataagccaattaaacccctttttgtta

SEQ ID NO: 153952 - DNA, 172 bp, Homo sapiens
ttctaaatggtagcctccaatagtgaactcccagttggcaggagcatcaaaatatagctcactaagtcaaaattcttctgatagggagaggagagagaattaataatcaaaacccaaggcgggcagggccagggccaggcacggtggttcacacctataataccagcactat

SEQ ID NO: 153953 - DNA, 421 bp, Homo sapiens
agatgtgacataaagctataaaactcatttaagtatactttatactttaaatggcatctccttagcattattatacaaattcgtgtcatattgtcctatgtttccattttaagactgatctaggcttggaatttagtattttactatgtgtgtatatatatatgtttatgtatgtagatatatgtgtatgtgtgtgtatatatatatatttatgtatgtagatatatatgggtgtgtacacccccccactctgcttctttaggtatcacttaagctagaaatcagagttttccccacttctttacaattcctagtcttgtgaacatagtacatactcattaaattaactgtattatccagttgataaactgttcaagttatacaatcactcagtgtcaaagccaaggagattcatgcattt

SEQ ID NO: 153954 - DNA, 914 bp, Homo sapiens
cagaatacgagctcgagcctgagttaaaggtcaagcagtttgtctcagtttaaattcacagagtagggaaaaagcctaccctttgataagaagagctgcaaagtcccattgcaaaggttatgaatacagggaagggtaaaaaaatggactcattttgtctcaagtctatcaaagactaccatccctggtctcagttatacatgtctctcctaaaggaaaaaatatgcccaatccaaacccagaaattgaatccagttctaacatcatgttaattccagggtctcctatactacatgaagttctgatgtggcttctcagatgtaactccaaaaaggggaaaaacaggagctacctagcaatcaccgatcagtagtaattctgaaatcatgctagaaaaatgttaccaagtccctcatctacagaataggaaatgtttcttaaatcctgcctttgctccttgggagtaacttccctgtttattttttcacatggtacccttttgctctaccctctatgatgaccttcgtagtctatcactttcctgggccacttctgaagaaatgttctatttggcacctgattagttttcttagacttattctttcctatagaaagttgcagacaatttagttgatggctattttacctatgaaacttactgtaaaactttgtgtgttttctttaagtctggttatactctactctctgctgcaaaatccatactacaattattttcaagaatgcttctttgtacacacttaactactgctatttagggatttgacatttgtgggaccactctttaagatttctagaagcacccttcccctttcctttcccctgttgggcaccacttaattctttcagaggtgttaacaaagggttttacggccacagccttaatttgatcatag

SEQ ID NO: 153955 - DNA, 427 bp, Homo sapiens
gactccatgagaaatctgaaggccagcttggagaacagcctgagggaggtggaggcccgttacaccctacagatgaaacagctcaacgggatcttgctgcacctggagtcagagctggcacagacctgggcagagggacagcgccaggcccaggagtaagaggccctgctgaacatcaagggcaagctagaggctgagatcaccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattgga

SEQ ID NO: 153956 - DNA, 436 bp, Homo sapiens
accgtgcttcactccaagcctcagaggtggacacctttgataccagggtgaccaatccctggtcctggtcctacctacatgagagtgatagagctctgggctggggtacaattgagtgacacactcttccaagtcctcttcctccaccacagagcacaatttcataaaggttttggcttgcattataggtaagacagcactgtgaggtggggtggggtggtgggggtgatgagagatgatgtttgagcagggaggaagagtagaggtgggccagcagacagatgggggttggaaagcccagggcacatctacttgggcaaagcagaatcttatagttaacccatcctcctaggcagtttgtcttactcaaaccagtgtcgcaaagtagttgtccagccccagaagtgagatgtattgtggtaaataaaacagtctc

SEQ ID NO: 153957 - DNA, 629 bp, Homo sapiens
gttgctgtgtagagacaatgaggaccgcactgaaagcagtggcaacaaagcttccccaatgtcatacatgatgcgttgatatactacacatgtatacatacaacatgcattctacatacagcatagcggcatgccgcaagcatacgcagtgcttttcataaacaaaaccactgaagtctcacaatggcccctgaagggggtcagtcatatgatcctcaccccatttcacagatgacaaactgaggcacagaagggctgagggtggcaatgggacggaagccccagtggcctggctctggccccctcccaatccatctgcactggccacacaagggtgctggacacagggcagtggtgtgtgggcagcgtgtgagtcacaaggcaggttccgcggtttcagggcccatcgggattcaccagcagcagcaccaggctctacagtcaggaccagatgggccttggtcaggcagcctggggcagggccaggggcctgcagcagccctccgaggatgggaggctctgagaatcctcagtgaagggcagggcttgagcctgggatggcgctttttaacagggccacgtgtctttctacataaaaaaagccccctgtcatgccaaatcttaaagta

SEQ ID NO: 153958 - DNA, 543 bp, Homo sapiens
aaaaagcacaaaaaattacagcatatatcaggaattttccagctaacgatgtgcggatgtggtagcgcgagggaaaaagagccaaactgagcttgctttgttcgctaagagaggcccccctgtaacattccttttagctgtgcatattttggcttcatttgtacagttttaactttatactgtgtgtggaggagttcagttgtaactggtggtgcctaataattctattgcaataattaaagttcatggagagctgttaggttattagttcatagaagctgcttcagaaaacggagtctaagctgaaaactttttaagtgacatgtcattactgtaaaagatggcaacaattattttctttgatttcacagcagttttttttttaagacaagattcatttatggagacaaataagaaacaacatcttaaaagctttgggtaggagtgaggggcccagactgggaatgatgagaatatggatcctgtagcctgtgaataaaacattttccaactggcttgtaaaacatgaaaatttgtgatagc

SEQ ID NO: 153959 - DNA, 343 bp, Homo sapiens
gcacttgtcattatcctgttagtcaggaagctcttcccctagaataccctacactgcttcttcccatctccaggcataagctaaattcctctattcccatgtcctagactcctggagaaaacaagaaaacaaatttcttcctgtctgagctctgggttctgacttcaacttcaagctgccttattagcggtcacctgcctctttagctgggcaggaaacctaccccactctgtccgcggcactcctctgactgcctttctgggggcttctggcacttgttccttgaacacccatctcacactttgaattccagtctcccacacctgtctaacctggccttttc

SEQ ID NO: 153960 - DNA, 403 bp, Homo sapiens
tactctgacctctaacaagtatactactaagctagttattgaacttaaaacagtcaaaactacagactacacaaattcaatgtagaaactgcatttcacaataaagaacagatacaagctactttgagattaggaaaataaacttttccaatcaaaaacaactgtgttggcagggtgcggtggctcatgcctgtaatcctcacaggccgaggcaggtggatcacatgaggtccggccgccatcccatctaggaagtgaggagcgccttttcccggccgccatccccatctaggaagtgaggagcgtctctgcccggccgctcatcgtctgagatgtggggagcgcctctgccccgccgccccgtctgggatgtgaggagcgcctctgcccggcttgcgacccg

SEQ ID NO: 153961 - DNA, 558 bp, Homo sapiens
aacccatactctcaccccacctgagccaccactacccctcatctataccccataacccctcaaccctcccacatacaaacacagcatatgctaatctctgtaccttgggtcccacagtctcctcggcctcgaatggtcctaccagcctcctccttcccaaatcccattcatcaagtcccagctcagaatccctgccatccccctggtgctaccctagagtctcccagctggaattcacttcttcctccttccttctcctaccatactttgactgaataccaatggtaggcgtgccttattttacggagagttatgcactgtctttctctacagccctcaccagacagggagttcctggagggtaagaactatgacccacaccatcccttcaaattgagtctctcacagtaaacactcaaaatatttgccaaactgggtggaacttaacaaccttttttccttttcccaccatcacctgataaaaccaaacagctccaccctaggatgccaagcaggggtccaagctcctaaacctggaaggagctggctctttttcag

SEQ ID NO: 153962 - DNA, 580 bp, Homo sapiens
attccctagtccactggaccctccttccttctgcaaggctcgtgcctcacttgatattcttgtctatagtcccctcagcctccaaaaagaagacctccgcctgccaaagaccctcttttaccttcttcagctctagatccacgggggcggccatcttggtgcactgtaagcgcctgcgcagtgggagttggactgaaatagggtggggaagggcgcgtcttactttgtgcgccggtctttcttctgcgcctgcgcatgagttggactaaccgggcttcttatctttctctgagaattgactcctgaaatatttgggtttcggattccgtgtcttcactacctgaccggtcaggtctggcttgctcctccgtatcttccagacatagcccaacgcgcagatttcccatgtggctttaagcagtttgccagctagcttaatatgtgctgctaaattgagatgtatgtagatgaggtcaaaccctcatcagtcgatcagtccttcagctagtcgctgtgctctcaggaatgagtaagagtaagtccagaacctcaggcatgacagtttgggaaagactattgg

SEQ ID NO: 153963 - DNA, 352 bp, Homo sapiens
cacttgggcagataatacttttgccacagggtatgcaataagcgtaccatggtatacttttgtcaggtggtatacttttgctacattgtatgcaataagtatattacatacaatatgattgttaatcaaattaaagagcatgatttggagtactgccagagctttctaactgaatccttgctcctctcaaatcttctagacacagttaccagagtgtctatctaaagtgaacatctggccctttctctcttttgcttggaactccacagaagctccctgtgggcctgactgaagtgctggtcctgcagagtccctggcttcctctggggcaccactgtgaaggtgttgctgc

SEQ ID NO: 153964 - DNA, 482 bp, Homo sapiens
ctcaaccctccagattcccttctttcctccttggccccaactctcccttcctgtttttctcaatactcctcacctctagaaactcttcttaaactaactgctatctagacgtctatgccatagattcccttatcctcatcatccacatttcaggaagctatcttgtaattctaagattagataccagtcctcttccaccttcccttcatacctctcaccagctccgacatcagattttgttttcaacataggggaagtgctccaggacactggtctaggaaaaattttacagctaagacctcaaaagcacaggcaataaaaccaaaagttggcggggtacggtggctcacgcctgtaatcccatcactttgggagtccaaggcaggcagatcacctgagatcaggagttccagaccagcctgaccaacatggtgaaacccagtctctactaaaaatacaaaaattagccaggcatggtggcg

SEQ ID NO: 153965 - DNA, 770 bp, Homo sapiens
gcctttaacctgtatttttacttttgtattttagagccctacctcattcttttgacctttgtgtcagagacacctccagcaatagtagagttgaccattttgagtcagcatctgatttgttttgaatttattggtttctatgcatcaaattcatttatactatttttacttacagtatttggtgtgacttgatagctcaaaagggttattttatgctttctgttccacttctgtctataaattttgctttcacagcgcagtcagcaaaactaatgggaaccatgaagccacttttctttttaagacgatcatttctgacgtttgtagttgggccaaacttgatcccacctcccagcacctcagagccactgcaaggtttatctggagaggggccaccctggctttctcctgcaaaagaagatttgggctttcaggtcaccaagtgtttgctgcagattggttctcattaaaataaactctggacagtggtccataattttattatcgacctttgattttcttgaggttggagaggcatccctttagaatgacagattttttcttggaatttcataattatataaaaaagcagtgattaaaaaaaagcaagttactggttaagaaagctggattatgtccttgatactccagtgacatatgacatttacttttcttaaactaaaatttaagcttctctcatttcctcacatcttcatctagaatttcatcctcaactagagttgcttcatgtataggtcatgtgataaata

SEQ ID NO: 153966 - DNA, 902 bp, Homo sapiens
  misc_feature (1)..(1): n is a, c, g, or t
ntttgacaggaccttccttgaattttgagtttttccactctggctgatggaactgttctcaatcctgtgttagtgccagtgaactcagtggatcaatgtgaacatcaatagctgctattatcagaaaaaggactaaccagatatgatgtcttctgataaaagaacacaccactatctacaaagaagacttgacaaaataaatcaaatctaaatttgatcatcaattcaacaccaatctatagggaacatagacaaaggaagcgcaaaagaaaggcaccacaaaagtgtaaccagcaaaattgagagtgtgaactctacaaaacaaatgatctggtttcttcaacaagctgttgaaagggaagagagaagatatagagatgaagtccattgattagaagacacaccaaccaatcacaaagtgtgggcattatttaaatcttgattcaaataaacaaactgaaatatataaatgacacttatgaaacaaaaatgtggccactgattgggtatttgactaaatcactgctcaattttattttgtgcgtgataatagcaatgtgcttatgtgttttatcttctagtgatacatactgaaatatttacagatgaaataatataatgccaattattttcttgaaattaatgtggatgtggaaagtagacagagatagagatttaacaagatggattatgagctgataattgttgaagttgagtgacaggcacataggggtttattataatatcccgtcttcttttgcatatgtttaattttccataataattttttaatggtctaaaaatttaaactttattttccaatcaaatggaagtctttagagattttattttgcaagtggcaatatgattaaaagggaaataggaaagataaattaagcaat

SEQ ID NO: 153967 - DNA, 555 bp, Homo sapiens
gcccctcaccacatttatttcctgccattttcttttttttattccgactgcagagtgatcaaggagagaaactggaagctgggcccagggataagttgtctgcccgtgcagggggaaaccataacattttacatgatatcttgtagtgatattaatcacaaagcccaaataaactgaagcccaaatgagtgagcaataggaatctaatcctgatagtattatactacctggtattaacttatactcacctgctttatctgccatgattcttatgatatctgcctctgcccaaggtggactgggttaaatgtgattagctccatttaacagatttaacagatgagaagacaatatttcaaatgagggctcttactgaatgtcaaaatggaagcttgcattactgtcattcttaacaaagtcagcaacaccaaccatagtgagtcttttatagatggacatagagatgtatgtttcccaagccctgttctgtttcctgcactgcagacatggggtggctgcccatgatggcctgcagtgagttggagctattggctc

SEQ ID NO: 153968 - DNA, 479 bp, Homo sapiens
gtgtccatcccccttcgtgtgtccatcccccttcgtgtgtccatcccccttcgggtgtccatcccccttcgtgtgtccatcccccttcgtagttgagggctggggcacatcacttattttctctgagcctccgttttctcccctgtaatataacaatactcacaaaggtaagtgtgcctatggaaggagttcatttattcacgcaacagctatttattgagcatctactttgtgccagaccctgctctagacaccagagatgccgcagcaaacaaaatggagaaaagtcctttccctcgtggagcttacattctagtaaagggaagcaggcagtaaattaatcaaaaactacaatatgcaggatgtccacgcgtgaatgctatgggaaaagaacacagaggagaagacaaatcgtgctagacaaagcacacatgaagttggctgtttagacttttctacaggacccattgctcatgtcc

SEQ ID NO: 153969 - DNA, 181 bp, Homo sapiens
tctaggtagctattggatggatgttagttacccagaaacaggcaggattagagggttgggatttacagtcctgcctgttaatctctggggaggagagagggcgtgaaggttaagttgataccaacagccagtgatttaatcaatcattgcctacttaacaaagcttccataaaaatccaaa

SEQ ID NO: 153970 - DNA, 152 bp, Homo sapiens
tgcaacctctgcctcccggactcaagcagtcctcccacctttgcctcttgagtagttgggaccacaggcatgcgccactgctcttggctaatttttgtatttttttgtagagatggggttttgccatgttacccaggctggtctcaaacttc

SEQ ID NO: 153971 - DNA, 182 bp, Homo sapiens
atagctcccaggtaggaagggagccccagagagtggtctgaacagtgactcataaactcagtgtcctttcctccagcctttaccagctgctgacttggccccttaggaatctgtcttcattccgcaagctattctccagtgtctggttcaggctctagagcagagcattccaggctttctgt

SEQ ID NO: 153972 - DNA, 281 bp, Homo sapiens
aggcatgagccaccatgcctggccaaggcaattcttatagggaattttgctgcaaaggggagcaaagaaaaaagatggtaatcgtttgaggaagtgagattaaaagagggatgttttgattttttttaataggaaaaatatatcttgtttgtatcctgatatgaatgatccagtacagaataaaaaattgatataggagtaggaggggtgaacagcttcctttcagtagacaagaaaataattatctaacatatacatgaagggatttgttttacaaagga

SEQ ID NO: 153973 - DNA, 117 bp, Homo sapiens
caaaagtgactactcatagaggcactcaataaatataattgagatggtcctctgtgctatgaaggaaaacatggtgacacagagatttgaaacctatatcactttaatttttcttgg

SEQ ID NO: 153974 - DNA, 231 bp, Homo sapiens
ctagcacccctgggtcatcttctgcaggatcccgaggcacaaagttgtatcccgggtcagagtttgtagggggtcatcgagaggtgtcatgtttccattcagagcggttccaaagcgtctaggaaggggctgagtgggacctgctgccttgcctttgttggaaggaggacccctgagctctgatcccagacaggctgtcaggacgcccccttagcatttatgtttgcaaac

SEQ ID NO: 153975 - DNA, 362 bp, Homo sapiens
gcaatctcaacgcactgcacccctctgcctcctgggttcaagcaattctcctgcctcggcccccagtagctgggattacaggcgggcaccaccacgcccagctagtttttgtactttcagtagagatggggtttctccatgttgggcaggctggtctcaaactcctgaccttaggcgatctgcccgccttggcgtcccaaagtgctgggattacaggcgtgagccaccgtgcccggcctgcttgaactgttttctcccctgagtttcccatcagcgcgctccctcccgtgccactgtgttcttccatttgcattcagtctgtctgcagctacgcgttgaagatgttactgccgtacacgctg

SEQ ID NO: 153976 - DNA, 220 bp, Homo sapiens
gaaaagagatggtagcaatgtaaaacatgatggtgaggcgaaagattacatagaaaagttttattgcatagaatgtaaattataacaatatctcatctataagctaatttccaaattactaattaatccctgaagaaaaaaatgtactttcaactaaacatctgagaatctactttgtatcaggaactgttctaagtatttggaacacaacacacacctt

SEQ ID NO: 153977 - DNA, 475 bp, Homo sapiens
ctggtgcctggcatatcacaggtgctcaacaaatagttgctgaatgaattttaggagggagaaaatagtcatgtattgaccttctatgccataagagcaggtagcaggttttaagtactttctgtgtaaagattcctttacatactttatttaaataaatgttgcaccaaagatggcttgaaactcccagaattacctaccccaactatctaacaaaatagtaaatagtttttttttttttaagcaaaaacttgcccaataaacctgagaggaaaaggaacataacctaatgcaataaactttaaaaagtgacagctaacaaaagaagcagacagtggtagagcagagaggcctgccagggcttggcttctaaccttgactatctatcccatttccaggctgtgtaagtcagcaaaatcccaggagaattcatttatatctcacatgtggagagaaggaaaatgagtatgtaatc

SEQ ID NO: 153978 - DNA, 255 bp, Homo sapiens
agcggagaagaggcaggacccaaaagaaggaggtgtgttcaccctgtaggacttgctttgtaggtgcaggtgcccagaggccaggcccgtcagtgctacctggggtggggctggagaagggaaggcctgccaggccccataggtgatgggagggccaggacctcaggttggagggaaccactgaatcctcggccctgtggtgcaggcccacacagggcatagcccctgggcactggcactgcccactgcccactg

SEQ ID NO: 153979 - DNA, 174 bp, Homo sapiens
acgtgcatggtgtgtgtgtgtgtgtgtgtgtggtgcatgcctgtgagtgtgcggtgtgtgtgtgaggtgtaattgtgcttagtgtgtgatgtgaggtgtttgtgatgtgaggctgtgtttgtatgtagcttggtatgtgtgtgcatctgtgtgtgtgtctatatgtgtgatgtg

SEQ ID NO: 153980 - DNA, 253 bp, Homo sapiens
acatgcatccacacatgcatacacagacatgcatccacacatgcatacacatgcattcacacattccacacgtgcacacacatgcattcatgcatacattcacacacatgcacacaccccatgcattcatatgcacacccacacacatgcacacatgcatttacacatgcacacacatgcctttacacatatatgcacatgcacacacacatgcattgatagtcacatacatgcacacacatgcattcacaca

SEQ ID NO: 153981 - DNA, 541 bp, Homo sapiens
ccgagattataccactgcactccagcctgggcaacagagcaagactgtctccaaaaaaaataaaaaataaaacagcttcatgggtaaatctgatacccagcaagtgtggaggctacacaggcagtcaaaggagcacccatcttagtcaggaaactgggttaacttctcagcctcaccacgcagtggctccgagattcagcttcctcgtctgtgaaatgagattgacacttaccctgcctagctcatggaggtttgtgaggattaaatcacatgaaagcaaaggggaaggcgtcatgtgctatagaaatgcaaggtgttactcattcctgtgtttgccactcccgtgccttcacccttgcttataacctgtcacctccaggactagctcactggccagctggtttgtctgtggctcttgggccttgccaccacattaatcattccgtactccccaccgtggggagtacggaatagtgtatattaagatttgacgccatcttctaagggggtacgatatttgggtaacatgtcactccttatc

SEQ ID NO: 153982 - DNA, 584 bp, Homo sapiens
tgggagggtgactgcaccaggaagctctgaggagccatcaggtattctggtccccagggcagacagggccagcaattccttacctattccacataggaggagaagccctactgaccagtcagttgcaggcaggcaacagtgctatggttagccagccttatggcgtcctgctgcagctgggtaggcactggaggcagagatgtggggatgatggtggagggggtgggagggagatgtgggtgtagtccccagctctgacacagcacagtgcccactggctgactgctgctgtcactcctggagcatccctcactctgtcatgccctgctgagcctgcacaacctcgaggccaggcagactgtgagaacttggagacaggagacccaggttctaatcctggcatcacctactcatacagtcactaagtgggccgggtacagtggctcatgcctataatcccaacactttggtaggccgaggtgggcagatcacttgaggtcaagaattcgagaccagcctggccaccatggagaaaacctgtctctaccaaaaatacaaaaattacctggacgtggtagtgggcg

SEQ ID NO: 153983 - DNA, 502 bp, Homo sapiens
agaacaatgattcctaacgaagaggcaggtccaagttagaggaccgtgtcgaagtgtcaccttcatcccccaagctctttcccagttggagtgctgttacatcctttaatcccatttgacctgtgcataatcagtggtggaaaggagcaaatcagaagcaaggcctggctttctggaaggcaaaattaaacagtggacctgtgacatgggaaacacggaggacggggaatgcctgggctgttactgacttcaagcttcctcagaaggaagatgacatagatgggctcgtccctattagtgagcgccactccctggtttcctcctctttacacttatccttggcaaggaactccaggcagcacagcaaagccagtgggccacagcttttggagccacgaggatgaccacatagtagtgctgtcaccctggacatgctcttcatcctctggggctcagtttcctcatttgtacaatggggataatacctacctaatacgcagag

SEQ ID NO: 153984 - DNA, 335 bp, Homo sapiens
caattaaaatacagcttttcaggaacaaacacttaaataaacctcatggcagataaaggcagtctactgaattcagacccagtaaaataaataagtgctacatgtcctgctcagggaagaaactgccacgccctccccaatccacttccagagccatctcccctctgcaccccactccccaactcaacacacgtacctcagcaaggcgcacagccctgaggtgctgacctggggcactcccgcctgccttctgcctgctgtgtgcgggaggtgctgccagcccgtggaccacttcctcctcctcctctgcttctccccaacgagaagcggcgaag

SEQ ID NO: 153985 - DNA, 272 bp, Homo sapiens
tagagtatccaacatcagctaagtgctcagtaaggcttaggtgccatgagataattctttgccaacaaaatccctatgttgttgaggatggcgatactcccggttcatttcctagccttctttgcagttgcggcagctcctgagatgtaagaggaagttattgttgggggggcttcaggaaatctttttaaaagggtctgactcctctggcaagctcttcctttcttttcttcttcaagacaggaaggtgggcatgatgactgtagcggcag

SEQ ID NO: 153986 - DNA, 540 bp, Homo sapiens
taatggttacatctttatgagacaagagagtatgctgatgttcaggaaaaaaaatatattctttaccaaatgaacactctaattaaccaaatgttttcattgctgtgtactttatttggcatagatgactaagctaaaccaataaatctgtgactgttttcaaaactgtatttcaaatagattttttgggtgtaccattatgtctagtgtttagttttatttgtttaatttaccacaataccaaaatgtttcttaaaatgttagaccacacccacccacctccacacttcacctagcagaaaatccaggtcatctgtagaagttgaaaagcaacacaaaaaagctcatgcaccttcatctaatcctccaaccctgggcaaggtaaaagctctttccagagcattgcatcccagtttttggaaccgtacctgctcccaaccccaggtgtgaccctgtagcaggtaggcaaaattactgtgacaatctcacaatccatcagctacagagcaaaggatcctctgaggagaagttaggattgct

SEQ ID NO: 153987 - DNA, 523 bp, Homo sapiens
caaagtaataatttactaattcatcagtcctaaaagagtatacaaataataatcaatttataattataatcttaatggtagaaaatttacacaggcggtacggcagtctcatacagcaaataaaatatggttttccaaattttaaaaaatgcatatttcctcatataattctattccattaaagatatattgattttagacctcctaaaagattagcagtataacagggccaacaagaaacaaaaatataaaaatgcacagccctcaggagctctcagtctgctaaaggaggaaaatttgcaaatggataaattaaaagaactagtatttgcagtatctctcatatctttgttctactgtgtcccatacttgtctaaaagctccttgcttttagtggaaaaacctcaaaaaaaacacacacacactcacacacacacacacacacacacacacacactcacacttcaatgaacttcaatttcaagcccagggagtatcacagaaaccccaacattgccatgaa

SEQ ID NO: 153988 - DNA, 366 bp, Homo sapiens
ggacgggaatattctaggtagggagaatccttggatgaaaagtccttaaagtgacaaaaagcttggcagcttcctggatctgcaagatggccaatgttccttgaacacagtgcttttttgggagaaatgcacaggcaatgttaagaggtaggctgaggcagatcatgcagggccttcttggccatgtttaggaatttggattgaacagctagatggatggaggtgccattatctggaatgggaaaactagaaaaacaacagttttgagagagtatctcaagaatttaatacgttaagtttgagatgcttacaagacaaccactaaatacacaattgggtatgtgtaaatctggattgaaaacaggt

SEQ ID NO: 153989 - DNA, 229 bp, Homo sapiens
cttgtcttgtgtgggtctgtccgtcttcaggcccttattcccccgccatgctaggaatttggattgaacagctagatggatggaggtgccattatctggaatgggaaaactagaaaaacaacagttttgagagagtatctcaagaatttaatacgttaagtttgagatgcttacaagacaaccactaaatacacaattgggtatgtgtaaatctggattgaaaacaggt

SEQ ID NO: 153990 - DNA, 479 bp, Homo sapiens
ggtgactggatcatgggggtggtttctctggaataatttggcaccatcctcctagtcctgttctcatgatagagttctcacgagatctggtcgtttacaagcgtgtggggccctcccctctctctcttcctcctgctccagccatgtaagatatatttgcttccccttcgccttccgccatgattgtaagtttccaattaaacctcttttctttataagttacccagcctcaggcattattattattaattttttttttgagaccgagttttgctcttgtcgcccaggctggagttcaatggtgcaatctcggctcattgcaacctccatctcccaagttcaagcgattctcctgcctcggcctcccaggtagctgggattacaggcacccatcaccatgcctggctaattttttgtatttgtagtagagatggggtttcgccatgttgggcaggctggtctccaactcctgacctcaa

SEQ ID NO: 153991 - DNA, 627 bp, Homo sapiens
tccccttcttgaggatcctgacacaggtttgctgcagcaagtcagatatgattcttccctattcggggccccccacggctcttctgggctagggcaggtttgccgcagtaggtacttgccgctgaatggaaggcccacctcagccccccacatctcagtataaataatgcgtgcgctggagaggaatagcaaccagactgcttgggttttgccatgtcttctcttgcataagattggtcgtggaggaaaggcaccctctgaagatgagagtgctggagagagcgttgtgcgctgtggttgagaagagtgcgctggtggggagaggagactgatgggcaagaacgctgcagcaggctcgtcctgcagctgtaaatggcacaggactggagctcttgaattccagttctaggcaggggagcgtgggtgttggatgaaaggtttagtcctgtgttacatacaggactaaagtatagtcctgagtaaagtgtctgaaacaagaagcatgtgaccacctgggcacatcatttttctacctgagtggtacttggtgtactaaagagattatgggatgcagcacacttagacaaggtggaagaatctgagtgggtctcatcacgttggagttgg

SEQ ID NO: 153992 - DNA, 381 bp, Homo sapiens
ttgtaccttctagccttacctttcttctgaacgtcagtgtagaatttccagttgctagctaaacttctctattgggccacctcctgggcacctgagaattaaccaggccacacatccacactgggggaaacatctccactaagggggtgaaattgattcttgggaggagggtaaagaacattttagatattattctgcttgtggtcctccaaagcacacgctaccccacaaattcttattccttagcattaaatttctcttcttaattaaagtgaatttacttctctccttaggagggtcataatgggaaaaaaaataaacagggttgagaaacactgcgctaggccaaaacagagctcgggaacactcccacctcacaag

SEQ ID NO: 153993 - DNA, 478 bp, Homo sapiens
ccgtattccccaacctaaattctgactgcttaatgtagaatcctactacatttattggacaacatccttcttgttgggctgcctcatgggttgaatcccagtctatgattgagctaccttgggtcagatgcatattccagtctaatcagtaaccactcctgcctgaaaagactgcctggccttgctactttgaaggatgggggttggcggggagctgtgggaaatgcagttagagggatcaatagatgatgcaagagcattataattcatggcagagtgtccctgaaaaaaacggtgctagtacactgtagcaaagaaacaaaagggctactaactactgggtgattgttaccaagcccttcacatatgttaactaatttaacctttttttttttttttttggtggggggcagcgggggaggtatgcggagtctcactctgtcgcccaggctggagtgcaatggcgcgatctcggctc

SEQ ID NO: 153994 - DNA, 544 bp, Homo sapiens
agcccactcacattgtagggagtattactcagtgtactgatttaaatgttaatcacatctaaaaaatagccttcagagcaacatctaggcaggtgtttgaccaagtctggttggcatatcctagttagcacacaaagaacagatggtggattaccgtagggaaaaacatacgcttactcaaccttacctacaacagtttcaacaccaaaaaagatttacctgggctgaaagtcctgaaacagctgagacacagaaccaggaagctataacttatacatgacaatgtggatacatacttaacagctaccgcagctgtagctatactaaaatacagactttcttcagggtttacttacccggaaaggcaagaatacaagcataacaataatatcacggtgtttatatgcaccaatcactctctttaatatatacagctctaaaacaaatacctctaataatttaacaattacattaagtccatatttctatactacttgggtctcaacatttgtcaaaacatcaattacttttgaaacattacaat

SEQ ID NO: 153995 - DNA, 368 bp, Homo sapiens
ttatctcagtattaaaacaacactcaggtatcactctaaaaatggtgggggggaaggatagttgaagctacagacataatactgtcctctctaataatatgtatgagtagaattttagaagatatgtaagtaaaaactgtaggatacgaaatggagagatgagagcacacacggcccaagtaggtattgatttacacctacaggtttgtgattaaaggatgagccaagaaagggataaaaggaagatcttgagcctgcacaaggcagacttctgcctattccttaaaatctgagaaaagaaactttggaacaaaagagagagccaattttattctgattgtctttcaggaatatacttgaatgccaga

SEQ ID NO: 153996 - DNA, 370 bp, Homo sapiens
gtttcaatatatgattgttgggaggacacaaaccttcatttatagcactgacatttctctgtaagcttcagccaacctggtatctaagctctttctttcttcctccctacctaccttttttcctctcagggtcttaaattcttgttcacttattatgttaaatagtttaatgatctttttgttttactgtgtccttagaaataatgagattttagtctacctttaatactcaaagctactcatcaagttactttgtaaaaggaaagggcaaaatgcatagtagagtaattcctagttcctttgctgagcagaacttactgtgattataaactttcattttaaatggaagtcttttatcatcatcatcatc

SEQ ID NO: 153997 - DNA, 104 bp, Homo sapiens
tatatcccctacttctacgctaacatcctgcatgaactgaaatgcccctaagatctctctgaaaccacactctctgactagggcctttgctcttctttcctccc

SEQ ID NO: 153998 - DNA, 580 bp, Homo sapiens
cccatttctcactcatgctttgccatctctacatctcaagggtgtgcttggcaggttggtgccctcttcagtgccggctcttcctcatgtgttttctaggccgtactacttccttgatttgagtagtcagccctatcccatttacgttctgtcttccagaaatgtatagagctctttctttcaccactggttctttttcagttctcttcattgttacagagctatggctcttttatgcctcttgtcctctcttgtgttagatcatatcttttccagagtaaatccagtctaatgtcccttattcctttcatctacacaaatatatcatacagaaatcttatagacaccttagtgcgtgagataggaaaaaagaaccgactgtcttttcctattccactctcctcacccgcaatgcttcacttctgataccaggtgtgaatgattttccttgctcatcagttctctggcggataccaattagatgtcctgtaatttaatgcaatggacactatctacctggaattagagttaaatctcacagggcccctaagactgtcccctacttcaaatgtcaatcaca

SEQ ID NO: 153999 - DNA, 340 bp, Homo sapiens
tctattcttccaggcacttatgttcttttgcaactccccaaactgcctattgctgtccactgcagacttactagcctggcaattgccctttctttctctctccccacagacctcccatgtcttgtttcctacaagtcttatacaagttggtaacctgattcatatttacatattaatgactgacagctgccaggggaattagaagaggtttgggaaaggcctctccctgcagctttgaaattcccacctgggcaacaacttaattagctgatctccaagagtgttcctaatcaaattaattgacaagtactgtacagtgaaaaagattagattgcttaaa

SEQ ID NO: 154000 - DNA, 605 bp, Homo sapiens
tctgcagatggcaaagctaaaagagtgcactgtaacacacaccgtctggggctctgggggttgcgggtaccccattagatgctaccatggggcagcacagagttctgctcctgacagcgctaagaagcatttgtcctagctgctgcacccaattacctgcgtgctccccctcctgtgaggggctgagagctgtgggctaagtaaacgagccacccacttcatgagtcccatgaaggggtcaaggaaaattttctacttcaccaccaaacatattagctgtggttccagtttgcctaggtcaaagtaatcctgagctctaggtaatattggctcctctccttatccttgcatactgctgttactaaccaccaacttacctaattgttccctctttggcttctcatctttttcatcacatttgtaatatattctctgtgttcatttccctgtaaaatacactcgtggtgttcataccctatgcagtggtttcatttttcggtttaaatcctaatgatacaaaaagcactttacatcttatttagtccttacaagttccctacaaggcagtaatcattacctcttttacagatgagaaaacccaaaag

SEQ ID NO: 154001 - DNA, 382 bp, Homo sapiens
tcattgtttaaaaaacagtactgccgtatcttatcttaaatatatatatatggctacatatttttagcacagtgctacaaagagtttgtgaaaattacacgtaacattatttctatctgcaggcagtatatgttattatgtatatattactatggcgattttataccatacagtcatgtgctgcttaaagacaaggatacgttctgagcaatatgttgtcgagcatgtagctacatgctcgaaaaacagccccagtgagagcacaagaggaaagaaagagaccttcagcttctgggcatgtcctgccatgctcagtcccccaacaaactggggaatctcccctcttcacagtttccatgcagaccccaaaaagagctctatc

SEQ ID NO: 154002 - DNA, 597 bp, Homo sapiens
gaaaaagccagacaccatattttaaggacatacaagcaaccctgtggggacacccagcagggaggagctaaggcctcctgccaccaaccaacatcatcaactagtcaattctgagtcaaccacctttgatgcaaatccttcacctagtcaagccagtttcgataactgtagttttggctgacatcttaactcaaatctcataagagtttttacggttttttttaagggtgtttcccaagctaaaaccacaaattattgacccacataaactgtaagggctaatacatgcttattgttgttttgagcctctaagctttggggtaatttgtcatgctgaagtagataaggaatgcaattcccttcaagaattatttatcataatgttctttatattagtgtaataaataaggaatatatcaagaagaaacagtatgttcatggagaaaacatttgagaccaaaaaaacttttaatattattattttcaaaggtacataaaatgagagaaaattctcacagattcctaagtactcatcacctatctttaacaaccattcaatgtcttactgctctaccactgctgatcttactatttttt

SEQ ID NO: 154003 - DNA, 167 bp, Homo sapiens
ggtagttccccccgtcagtcctgccctgctgtaatgattcatgactggcccaacaggaagacctcaaaacattttcctgagcacagccagccatctctagggagcgtgggagcccaaactccctgcccctccaatcctttactccagttacacttgccaggaaagaa

SEQ ID NO: 154004 - DNA, 246 bp, Homo sapiens
gtatgacacagttgccagcagtcagaaccaggatctgtatgtgatcatgtggcactgctgccttgcaggtggagggctggagtcccgcagaatggcctcagttattcaggttcccttcctgaccacgcagccttgattggacagttgaatcagccacattccttcagctatcctccctgctccctcccactccagtgcatagctggtgcctggaacctagagggccttagtgggtatccattaacg

SEQ ID NO: 154005 - DNA, 226 bp, Homo sapiens
gattctccaaccgaccccctctccaatctctgatctgcagtgccctccccttctcaccttcgaactgagccccgccccagtctctggtttccagtgcccttgcccactccttctccatctgggctcccctttccattttttctcgcttacctcctctccttcatctgtcttctgtactttctccctttcccctctccccgctgcactccctagactggccgtcgac

SEQ ID NO: 154006 - DNA, 371 bp, Homo sapiens
cctccctgtgtgacagccgcaaatgctgtgtcaggtggcacaaccatcacggcctctagtgatgtggttttctgaaatgggaacaacgcttgatagcactttgatcaaacccaagagcagtcttccatccacttacacaaagggtgcagctctagagaagtcagtatgtttgttaaaactgcaaaatcttccttgtgtttgtgtgttgattggagtgacagtctgagctcaggtcatgccaagcaggttttttactgctgtagatattaggaggacatgagaaaatcgtgtgggatgtgggcaaattctgcatttgtggactatccaccccagggtggaatgcgagcacccatccctctcactccacctag

SEQ ID NO: 154007 - DNA, 595 bp, Homo sapiens
aatcatgagctgaataaagttattttctttatgaattgctcagtctgtggcatctgtcatagcagcagaaaatggacagagacacaatctgaacagagaaaatgagcagaaaaaagatgaagaaagtctttggcagctctggcaataataataataaaaaaaatcaacattcatgttacaggatgtcagaagaaatgagtagagctgagatgacagaatatttgaagaaataatagctgaaaactccctaaagtgatgaaagatacaaacctatagattcaagaagctcagaaaattgggaacaagataaacccctcaaattcaccctaagacacatattaattaaatgcctgaaaactaaaaacatagaaaataatcctgaaagtgctctgagaaaaacaaaacactgcctgtagaagaacttcagctttaaaaactgtatattttttgtctgaaactgtggagaccagaaagcagtgatacaatctattttaaatgctaaaaagaaacccgtggaaattgtgcatcctgtatacagaaaaaagtttctcttgaataaagcttaaaggcattattagctgaagaaaaaaataaa

SEQ ID NO: 154008 - DNA, 273 bp, Homo sapiens
ctcatattggaggagtccaagctgggctgactatgtaatatacatgtacaaatcccattacttctctttctttgagttgcacaacactttttatcataagcccttcagaacaaagggcagggacagggagagtctatactagatgtgcatgcacatttcatataggctgacaggagccatagaaagggactagaagagaatacttcttttggtcattctgtgaaatttctgtgtatttagaaagatcatgaaaggattttagaagtattattt

SEQ ID NO: 154009 - DNA, 358 bp, Homo sapiens
atgattcttgaggaaaaacgacggctagggaagccctcctcataactatacgagtatagtcctgattctagaacaagcatgggagccagttcacggcatgccatctgccacaccggccctaagctctgtcagttgaggactcacctttgaagccactctggtgcttctgtcttcccactgaggagcaggagggatttcctgagggtggaaatggcagatgctgggtggggagagcccaagatgagggggacctaggggcagcgcaacaaggattcacttgggtgacgacgacgatcagtgattctccagggtcatacgggaagaccagctaatctcaggcacgatcccatgagctcat

SEQ ID NO: 154010 - DNA, 407 bp, Homo sapiens
caccaagttggaaaatgttcagaaaagagaaaccagtaaaatgaggagactcaaaacttggtcttgaggggctcaaactaggcctgtgctccacagaactccacagatagcggccattctgggaagcatgggagccagttcacggcatgccatctgccacaccggccctaagctctgtcagttgaggactcacctttgaagccactctggtgcttctgtcttcccactgaggagcaggagggatttcctgagggtggaaatggcagatgctgggtggggagagcccaagatgagggggacctaggggcagcgcaacaaggattcacttgggtgacgacgacgatcagtgattctccagggtcatacgggaagaccagctaatctcaggcacgatcccatgagctcat

SEQ ID NO: 154011 - DNA, 136 bp, Homo sapiens
atgttggcttctggcatagctgtgactcagggcagagttgggactctagggctatgctcttagtctctgctcttactggctgaagctcacagcatctccaagtcctcggcatacagtctagcccttgattctccct

SEQ ID NO: 154012 - DNA, 209 bp, Homo sapiens
gaaacagagagagaagatgctgccaaactcccaagattagattattactaaaatttggctcttaattttctggcagttatggcagaaaagaaaacatattgttgcatactttccattttctgacaaaaacagtgaaagaaattctcaaagatggaattttttcctggaactaacaaagtaggaatttaccaagtgaaatatgactatgg

SEQ ID NO: 154013 - DNA, 268 bp, Homo sapiens
aggtgtagcccccatcccctcctagttgtattgcttggttgtctccatggcatgctttcttgcagtggtgatgtgggtcttcctgcctgtggggtcttgcccactctagttcatgtagtttaagctgcaagaaaaagatcttcctaagtgacagtctgagcctgtcacttaaaaaaaaaaagaaaacaatttggttgtcctttacctatcagggacaggaaattactttactcaacatttgatgctattgaaggatgggacccacatc

SEQ ID NO: 154014 - DNA, 631 bp, Homo sapiens
atgagccactatgtctggcctagagctattttctatgctacaagaagtttcctttttctcctctttaacaatttctcaatggtttaatcaacacaacattaatcattgattgctttcctatccttctattgtactttaccttattttatttgttaatcagattttgtttccaaaaagagataatgctgttgacactggattttgattaatagatttaactatttttggagtagtataggaaaactctaaggcatttgtatattactactttttggattttggttttaaaactcctcgtttacttttgggaattgcatttttttttttattggctgcttgaataacttaacatcttttcactttcctggatagatttatccagaacctgtttcagtcctcatactaataattcgatatacagattacatccttgctacctgtgtctggtttctgagctgagattgtgagggatattatgtttttctaatacatttgagacctggagatcatgtaacaagtagtaagagcttggacagtgagagttaccttttctccaaacggtgctatcaaagaatttatccacatggattaaggttctgataatagttgttaatggtagtatctcacatag

SEQ ID NO: 154015 - DNA, 440 bp, Homo sapiens
ttgtttctaaaggtgctttgagagtcaaggagtgacattttgatctgtgccggttgacaaggacttcccatggtcggtgtggttccaagttatgactagttgaaattgtccagagatttcagttttcaaaactgcaaagactggataaaaagatgggttttctgactctgactcaggctatgggtgctgctgagtgtgatggcgtaagtagcccacagagaatgacagggatgtacctgaaaatggctctgagggcacacagagctgagtaaccgactgcaagcctctgagccagggctgactgagcagttcacaaaaggcttgacctgaagatagatctaggagaaggtgttgaccttccaggaacacaggtacacaaggaagagtgaccatgttgacgtctgcagaccacacttacattctcccaccttccccaacaa

SEQ ID NO: 154016 - DNA, 966 bp, Homo sapiens
tatcctgccatgctcccctatcctgtacccatataaaccccaaacctcgggctccagaagcagatgagcagatgaggagacgcctctattccgtgtcgtttagaatgagcaaacagttgtcttcaccatcccagacaagcagatgaatggtgaaacgatacagcagagaaagagagaagaggaacatttgaacgccgagaggagttcagccgagggtggtcggagaggtttggccacccagcaggaagattatcttcccgtgccatccccgcttccagctctgcatccatccttcagagaaccacctccaccactcaataaaaccctgcattcaaccttcaagcccatgtgtggcctgattcttccaggatgctgggcaagagcttgggatacaaaaagtggtcacattggccctctgcccttgtgaaaaggcagagtgtccattgagctgattaaattcaagccatccatggacagcagggctaaaagggcacactgtaacacacccccacttaggctcctgcacctgtccatctgcatgctcccctcccctcaggggtttgagcgtgtagcaacagaacaggcgagccacaccctgtaaagccctggggcaactgaaggtgtttttttgctgcaaggccccaggactgaagtctgttggctaaaacccccagattttgcttgatgtcttctcttctctcacagtttgaaatggctctcatctcttcctttatgatgttacgggttttggttcaggctgtgcaatattaaatagaatgagcatttggctcagccatcaaaagtgcaattcaggccgggtgtggtggctcacacctgtaatcccagcactttgggaggccgaggcaggcagatcacgaggtcaagacatcgagaccagcctggccaccatggtgaaaccctgtctcttctaaaagtacaaaaattaggtgggtgtggtggcacgta

SEQ ID NO: 154017 - DNA, 469 bp, Homo sapiens
caatctcttttaaccctcacatactttctctgaagaaacttagcaaccatgggccatcttaagagtctgtttttcttgggtttaatgtgaatgtcttgtatgtgcaaaaatctataaatcaatgaacatgaattatatgggatagatgtaggagaacgaaagaaacacgttttgaaagctttctgagaagaagctcaaaagtaaggtagtgaagacccagagctacatccctacaaaattaaatctgtgatgtttagatcatgatttccagtgcaaggcagacaaggagaaaatgccaggagtgttggcatctctctctctctctcacacacacacacacgacacaggatcagggcgggctgaaaaactattaggtactatgtgtagtacctgggtgatgtgatcaatcataccccaaactcagcatcaggcaatatacccaggtgacaaacctgcacatgtaccctgt

SEQ ID NO: 154018 - DNA, 395 bp, Homo sapiens
catgcagatttatattgcatgcctctgagtcttatgcttccttggcaaaccaggcagtcgcaagctccagtgcctactgggaccaatgaggttacgtgagtaagtgggctgaatgtagtacaacagattctgctggaaagtgtggtgaactggagagcacatgtcccgtctaaaacaaaagactccaggttctcactgcaggaatatgggcccaatatggtggcagcttccagttttccaagaaaacccagatctcaatttttattttaaatgtcttatgcaggacaggccaaagaacatgcatgcaggtggatatttgccagctgcctgacagattgcagcctccacttaagtgcatgtttcttatctccctaacagcagcaataataatcgcc

SEQ ID NO: 154019 - DNA, 325 bp, Homo sapiens
tagctgggattacaggcacgtgccaccacagcccggctagtttttgtatttttagtagagatgcggtttcaccatattggtcaggctggtctcgaactcccgacctcaggtgatccgccagcttcagcctcccaaagtgctgggattagaggtgtgagccaccacacctggccagtactattaatctcaatgataaaccaggactcatgctgtctggaccacggacacctctattcaagaggagcagcctgttcctcttgatcctgtgcctcttaatttgcatgtttttcaccaaccaggtgcccttctcatcagcaccgagaaa

SEQ ID NO: 154020 - DNA, 267 bp, Homo sapiens
acagtgactcagagtaaaccgtgactcagagtatacaggtactacactctggacatcctaaagcaattaacaaataaatgtgctggtaggaaaattgttgtctattgtattaccttagtctctctctctttttttttttttttttcttttttgagacggaatgtcactctgtcacccaggctggagtgcaggggtgtgatctctgctcactacaacctctgcctctggggagttcaagtgattctcctacctcaggcccctgagtag

SEQ ID NO: 154021 - DNA, 236 bp, Homo sapiens
gtccttctatagttgaagtttcatgtatctcagcatattttagttttttctttttaaattttgaaatatatcatattcctaaaagttcaaaacacaaaaatgcatggcttagtgaattatgaattatgtgtactccccagatcaagaaagaaaaatatttctggtaccccggaagcctccttttgtgcccctcccagttgcacagttaaaaccaccttcctccccttaagtgtaac

SEQ ID NO: 154022 - DNA, 327 bp, Homo sapiens
cgggatacagcagtgcagcatatagctgggcataattttgtactggcgtacgatgactaggttttaccatgttggccaggctggtctcgaactcctgacctcaagtgatcctcccaaagtgctgggatgacaggtgtgagccaccgtacccggccccttgatctaatttttaagattgatattaataaccttcaaaattcacaagataatgcttaacctagaataactaagtttaggatcagtattcttaattgtgaggttcaagagacattgttgttttttctttttcttttctctcttttttttttttgagactgagtctcattc

SEQ ID NO: 154023 - DNA, 783 bp, Homo sapiens
ttttttgagatggagtctcgctctgtcgcccaggctggagtgcagtcgtgcgatctcggctcactgaaagctccgcctcctgggttcacgccattctcctgcctcagcctcccaagtagctgggactacaggtgcccgccacaacacccggctaattttttgtattttttagtagagacggggtttcaccgtgttagccaggatggtcttgatctcctgaccttgtgatccacccacctcggcctcccaaagtgctgggattacaggcgtgagccactgtgcccggccgcattctttttttttgaagactaaagaagttaacaaaaatgtcaggaaaacattgttttgtttttttttttcttcccctccttttcccattctcgtctgagaacgtgttgtcttcttcctccctggctagtttccctgcctgtgaactccctcagcctcactaatctgtacgtgctttgtggctcatcccatctgtgcttcagtcatgataatcgatgctgtcagtctctctgggctacacagccccacacttggtgttgctgacacattccggtggtgcacgtttgagaaaatcgcacattccagctcatgtcccctgcctcctctgctccatggggagaggtgtgaccagatctgcagggcctggggctgccacactcctgttccttcttgctctgttgctacgtgatgcccctcctcctccttccccagcaccaagccagagagtcacccagtcccaggccccaactccctcccagctgcctcattcctatg

SEQ ID NO: 154024 - DNA, 537 bp, Homo sapiens
atatgtgtggcttatgaagtgtcaggaaataaggggtcagagggagtaataaacacttgggagaaggttaggaatggaaagaatgatggaaccaaaacaaggagcatggtctgtggaagggtgaaaggagttccttaggaagtaagattaaccgaacagaatgagttaccagtcctacccttaaatgtcatgggtgacatttcccaacaattaccaaactaagaaaggatataagatggctgaaataaagaccttcttccgtgtgtccttgggagatgtcagattgaatttgcaaaggcatattaggaactctgtgaaaggacattcaaagagatgcatgcaaaatgaattttcagtttaaacaatatgatatgactatttcttatgtatttccctatgaatgaaagcagtcctgagaagaaaacagcatttattagaattgcttttaaaagagattataataattagactcttgattatgtgaacatcattcaaggcgtacttttgatttttatttttggtgtactgaatacttta

SEQ ID NO: 154025 - DNA, 538 bp, Homo sapiens
agcaactgaacatccccagcagggctgctggacatgggctggaggcactgacccactggactataagtcaaaggcaaaacccagtccagtgtgtgtcatctccccaggctctaaagcacaggcctgctgaggcaggccagacagaagctccagggataaacagtcggacaggaaccaaatcagcttcaacttggcttccccagggctttgccagtgccactgggcagagatacttatgcctcagaaaaatggaagaaattagacccaggcccagtggatctggttggtagggaggagacaggcctccgggaaaaggcactccttaccaggaggggagacagaatacaggagagaaacactgaatgagaaacactcagagaaaaggaactagagaaaagaacacagaaaaacaagagaaagatttgggaggtggcacactgccagcatgagctggggggaactccctggaggaaagaagcccattcctcttgatggccacaaagccctggctcccagaagatagcaagctggcacaagc

SEQ ID NO: 154026 - DNA, 161 bp, Homo sapiens
gtgagccaagatcacaccattgcactccaagatgtggttggggagaaatccacaaattttggtgatcagaactgaggcattctgtgctcagtggcatgagagagtaggaaaaacactttttttttttttgtatttcttttttttggcggggggtggagtct

SEQ ID NO: 154027 - DNA, 891 bp, Homo sapiens
cagtagtgaggatagaatggaatactaaaaacactcattccaaagaagacaggaaaagaaagaagagcaagtaacaacaggtgataaaaatggaaaacaacaagatggtaagtttaaactcatgtggatagttacattaaatgtaaattttgtatacaatacagttagaaggaagagattgtcagattaaaccagtagattcaatggcatgctgtttataaaagacacactttaaccataaacatacagtataggtttaaaactaaaaggatagaaggagatatgccatgctaacaatagaaaagaaagctggagcagctatgttaacaccagacaaactaggcttcaagacaagaaatattacctaagataaagaagggatgtttcataacaatagaacttcaatatacatagaatgaaaatttccagaaataaaaggaaaaataaataaatcaactgttttggttggagattacataattgatagagcaagtaaaaagaaaatcagtgagaatatagaaaactttaggtgtattaggaaacaatttgacctaacattttcggagaactcaacagaagaacagaattcacgttcaaaatgcacgtggaatatttatcagaataaaatgatggaccatgaaacctcaaatttaaaaaactgacataagaatatattctctgacaccagtggaattaaattagaaataaaacgagactttaattcgatatggaataagaattctcagagggggcagagaaccagagcactggaggttgttggaacgaaccatgggggtaacgggggaactaatggaaggacagggttcaaaaaaaggggcgagaaatgggggaagtaagccgtcagcgaagggtgatgaggctgagtgtgga

SEQ ID NO: 154028 - DNA, 460 bp, Homo sapiens
gcttggctcccacagactgttcagagaccccagccacagctgcagccccactttcaggctaccctcagaccatccccagaatgaaggattcccatcagctctctgcccacagaatccctgcatagagaagcaaaagcttgaaagagaaaccttggggtgggatggggactgctgtccaacccacccctgaattctgaaagcaaaagtgagtcaaaagaaacattcatcttgcaaacaggaaggcaaagcattgttatggaaaccctggattctcgtcttctgtcaagacctctctggtcacggattccacactggaccacgagaactgggcccatccagtttttttctttctttcgagacagggtctggctctgttacccaggctggagtgcagcggtgcgatcatagctcactgcagcctcaacctcctgggctcatgcaatcctcccacctcagcctc

SEQ ID NO: 154029 - DNA, 241 bp, Homo sapiens
gtgtattgaaacaaacgctgctgaacagaccaaagtaagaaggtaaacgttctacacttttaaacgtcactacacacagcctcttctgtgcaggaggctgcacatgcggcaggtgatagcaacgcgctcctttcagggttcagggtcaaggagggacactaagaccagaagagggttgataagcaacccttcctcccgcttcccaccatatgcgcccgctccggtgtgcatgtgttctgag

SEQ ID NO: 154030 - DNA, 487 bp, Homo sapiens
tgattataagttttcctgagacccccaagtcatgcttcctgttaagtctgcagaactgtgagtcaactaaacatttccttgataaattacctaatctcaggtagttctttatagcagtgtgaaaatggactaatacaggtggttatgaattggtacctaccaacaaggtatcaaatccattgtttggcatttctgccatcaatgcaacgatctgcctttgtacttgaaggcattttgcttctgcacagtcttctattaaggaaaatgataagccttatcacttaactcagtgctaacagttggaccccagctgatgctctgagagagtctgatgggacaccagcaaggaggacaggaaatggaacatgacagagacacactttgtctctagtttttctctaggggtaaaacaggcaaaattaacacatcttacctgtcaagtaaaattacaagaataacatgtatgtatgtaagtgaacctgtgtga

SEQ ID NO: 154031 - DNA, 1317 bp, Homo sapiens
ggcgatcgagagggtcccggatcgtggttttgctggaggctggagcttcccgacagccctgaccacggagaggtggaatgtggcgctgacgtcacggctgctcctgggaatgttttgcattcctcttcctggcagtggtcaggtggcttccagcaagaatgaaggacagcagcttccaaagaagaaaaaaagagaggaggaaaaggacagtttataatcaaagtattgcgggggaggcacttttattctgagccaaaattgaaattagaaacagatgtcttgcattccgatgcggcacgaatgttaaataaatttattaatgactgtaataactaagctatttggctttttactgaacttaagtcttgaaactctgtaagaattatggaaaaacgacttcttgtagttgacattttaactatgaaagcagctttctgactgtaaaagcaaggaccctgatgaaataaccctctagttaatctacaggctgttttaaggtctgttaatattctgaaaggtcacttctgaaacataaaatctctgtaatctattaacataatttgtgctgttcaaacaaatttaagccaatcattgagagaggtaaactctattttagcatctgctgcagaatgtcttttctcaaaatatttacacttccaatgttatttctgtacattactgctcaaaccagatattcaaaacaaaacagattcttaacaaacaggttttgcccaagtcttacaactctgcaataatatgtgtaatagaaaaatagacagtaattgaaaagtttgtgtttttcttgtcttccagccactaaagtacctctgttcaaaatcactatacgggtttagctaattacaatctatacgtctgtattttaaaataaaatgttatactttttaaaaacaaaaaaaaaaaaagaaagaaaaaaaaaaaaaaaaaaaaagaaaaaaaagaaaaaagaaaagaaaaaagaaaaaaaaaaaggaggggcgaataaacaacagaggggatcaaaacacacaccaatataaacacacggcgccatagggagcaaaaaacaagagacagcgcgaaaaagcggagagaaacagctaagcctggagaaaccacggaggggaaacgtagaccaccacaagcaaaccgagaaaaaaaggcggggaaagccaagctcgagagcgcgcgaaacaacaacacaccacgcacgaaacgatgaacgaacaaacagcagcaacagcaagtacgcaacacgccatctccccccctcccccccgcaagaagaacacgtaaaaagcaaaaaaagataagaagaaa

SEQ ID NO: 154032 - DNA, 545 bp, Homo sapiens
caggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctccc

SEQ ID NO: 154033 - DNA, 350 bp, Homo sapiens
actaccatataaaaggaatatgaaaaatctcaacagaataatacaagaatttggtggaggtaattttaagtgtgtgagagtttcttagataaatagagttctatatgtaactctgaaaagacttcaatgcagttttttgagaccatgctttctgaatttgtctgaatatttcttgtatatttattttgatagtgtagtactatttcttatgcctttattgtgaagaatactatcaatgtttgacggaagtacagatttcagaaacttatatgcctcagttcacttttcagaaataagtttcccactcaaaatgtgttcttggggaatatttttggaaagtccccccatag

SEQ ID NO: 154034 - DNA, 283 bp, Homo sapiens
tggagcctgaaggtaattcaagaggcctgtctccagccttctgcctccagaggtgtaccttactttacagaaaaggcagctgcaaagaacacagcaactttataactaattcaagtttcctgcctctggactattcatgcctcttttcttgtccagtgagtttttaattgtttgggataatcttatgtaatgtctgaactacagcttgctataaactacttaatgtcccatctggtcttgggtggttggtgtggttagtatgtcacctgcatttttctcattt

SEQ ID NO: 154035 - DNA, 465 bp, Homo sapiens
tgacagtttcacagacccctatcattgtgggttccattgatcatgtcttgattttctggcactacaagatgctccaggctttacaaagaaaggaaattctgacacatgctacatcgtggatgaaccttgaagacatcgtgcaaggtgaaataagccagtcccaaaaagacaaataatatatggctccacttataggaggtgcttagaataattaaattcatagagacagaaagtagaagggtggttgccaggggctggagagcaaggcttggggtattcgtgtttaatgaatacagagtttcagttttgccagatgagaagagttctggagatggagggtggtgatggttatgcaacatgatgtatgtatttaataccactgaatagtacacttaaaaatggttacgatgggccaggcatggtggctcatacctgcaatcccaacactttgagacgccaagagag

SEQ ID NO: 154036 - DNA, 223 bp, Homo sapiens
aaaagaaaagaaaaagattatgggcaaatagaaccctggcgtcttctgggacagagagtgactgttgaaaaaattccaatttacccataatctttttcttttcttttcgtttctctttaatatttttatatacagcccatgttaaaagcagtttctattggaagcaaactaggctatttctatttctcccatgatattattgttgtaacgtaggatacttggc

SEQ ID NO: 154037 - DNA, 916 bp, Homo sapiens
ctttgaactgaggccatgtgacaagcagcagcctgctactctaacctcatcctggggaaatccaggcttcacagttgctacacaggatgtttcatcaaaagagggattttccccctctgctctggaagactttgtttccttccccttcctcaactttaccaaagtattctgaaaatagttaacaatttttcctgtcttgggtgactttattgggggtggaatggtggtggggaaggataaggaatgggttaaggggaagttgagcactggggcatagaagggacagtaagaacaagacccgtcaatactttgtcagcccatcatgtctctgggcatattacttgctattacctaatattaaaaaaaaaaataaatcactggccctactatgcatcaagcatggttttggtgttagatcttagttcaaagtccagctttgacatttgccagctgtgtctttaagtttcccatttataaaatgaatcataatacgaacttggccaggcacagtggctcccagcacttagggagttggaggcgagtgggtcacctgaggtcaggagtttgagaccagcctagccaacatggcgaaaccctgtctctactaaaaatacaaaaattagctgggtgtggtggcaggcacctgtaatcccagctactcaggaggctgaggcaggagaattgcttgaacccggtaggtggagtttgcagtgagccgagatcacaccactgcactccagcctggggtatagagcaagactctgtgtcaaataaataaataaatacaaatacaaatacaaacttaacagggttgctgagaggttcaagtgagagaatgtatgaacatttacttcgtttatctctgcttctgtcctcccccatcttcacccttttttcccaagcctaaaaggaatca

SEQ ID NO: 154038 - DNA, 445 bp, Homo sapiens
ctttgaactgaggccatgtgacaagcagcagcctgctactctaacctcatcctggggaaatccaggcttcacagttgctacacaggatgtttcatcaaaagagggattttccccctctgctctggaagactttgtttccttccccttcctcaactttaccaaagtattctgaaaatagttaacaatttttcctgtcttgggtgactttattgggggtggaatggtggtggggaaggataaggaatgggttaaggggaagttgagcactggggcatagaagggacagtaagaacaagacccgtcaatactttgtcagcccatcatgtctctgggcatattacttgctattacctaatattaaaaaaaaaaataaatcacagggccactcaataccggtatggaggggccaggtgaaaacaccgagagcaaacactgggaagctcgc

SEQ ID NO: 154039 - DNA, 377 bp, Homo sapiens
gaaaggaaatcagtctaatctcctaggaagaggcagagatgtgtgtccctctgtagctgggatgggcttggaaggcatcagaggttccagtccactgctggaggggaaagggtgggatgttacggtgagaggagagccagattgctgggagctgcactctgtgactccttgccaatggatagaatagaacgaacccttctatgaccactgctgaggctgtgtaacattgcagagaatcaaacaaagtgtggaaaaggacttttgagatcaagaatttctgatccctgaacctggtcctcgaacaaaatcttaagcagccacccaatatacacttcggattaaagaagagctgttttgttgaagcagagtatgtgcac

SEQ ID NO: 154040 - DNA, 316 bp, Homo sapiens
gcatcagcatagggacctcccaggttcccatttcctgctggagccctctccaaggctgagacacagggcatggccatccttgtgtcggagaccctgtctccacctctaggtttggccttcccctatagggccctcactagggccagtgtattcactgccaagagtctagaatgccattttagtttctgcccaagggagtgtctattttcctcaccatagacactttttattattttattgttatgtttgtgcagggacttaattctttgaaagattattgtttgtcggcctgtgtatattaaatgatgtaaagtta

SEQ ID NO: 154041 - DNA, 304 bp, Homo sapiens
cacgctgacctcttccttttgctgcttcatcctgggaggctgtggtctgatgctttgttccctgatgtggggcagtcgggccactgttcagcgcactgcctgctcacggatcagtccccagtctgcggcggtgcctcttcctcgctggggctgtccttgggcttctgagattccgctggctttacagatgcattctccattcttcacacatcagcaattttgaggatttcttgtggggtttggttagagtcacaagtaacattctttttttcagcaaaaaaaggggcctttctaaaaaattaag

SEQ ID NO: 154042 - DNA, 531 bp, Homo sapiens
ctcaacccccctacttctagccagagcccaggcacctgccttgagcccttcttaggcaaatatatgtaaatgtaggaccctcagttctccctccctgaatttctttagggaaagcaacaaccatccctgtaagccataggtattcatggggaggaaggagagggctagttgtctgagagggaaactgccaaaggctgcagactaggaaatgggattccaggtttaagatagctcctttctggacctcagtccttcacctagtcacctagtcacagggtggattgtctctaaggatacttaggggaaaaggaaccaaattcgggagggtcctccttgctttaagccttgatgggagagggggaggccaacccttctctgcagactgggatcctcaccagacagaggagctccaaacctgcccatctcatcccatgcaccgacggtgcctggcctggctccaaactcccaaaaggaactattttacagggaccaaaaaggggacactggtgataataataataaaaaaaaaaa

SEQ ID NO: 154043 - DNA, 746 bp, Homo sapiens
ggttaatgtcatttaacttatagttctagaagatgtttttgcagtaactacaatatgcatatttttttgcttagtattttacatctttaagtaaagattgaggaggaaacgtaatgccctaaaatattacagctcaccaaacacatcatggagtcatattttaggatattcttagtcccagatagcaggagtagtggctagaaacaaacctttgatacgtagaagtcccccagattcctagatagtatctggaagcatccagggcctggtgctgaaaggatctggttttcttctcctgttgtagtggctaagaggcctgtgtagaaaaagctgtgggtctcacagacagcgatcttatcgctagagctgggttaggggtatatccaggagacattttccttctctgagccccacttgcaagagacattcgctatacccagagggaactccagtagaagtgccaggtaaatctgaaatatgtgctaccattccatataggaaaaattcaaaaaatcacgtcaaatatctggggggaaggaaaggaaagggtatcacagtcaggaaataacatttttgtggttaactttacagattttaaattgttggttttagttttgtgagactaaagggaggtgaaaagggaggagggaggtcccagtgtaaaaagcgtaggtttgggaattactcaggcctgggttttaaacacagctttgccatccaactagccaatgactttagaatactta

SEQ ID NO: 154044 - DNA, 490 bp, Homo sapiens
gtcccttacctctgagatcagtttccttatccgttacagtcaagtaattatttttgccccactgatctgatagacttgtttgaggtatcaaacaacataaaaaatataaaagatcttttcaaactttgaagccttccaaaatgtcatcacccttttacatatcttcagtgcccagaacatagttggcttaacaaacttttcttactgcctactgcagttgtaatgaattaaatggttttctgttggtctaaagaactttactcttcttgcatccacattcagcttaatattaacaactgaattaggcattcagaacaagctgaactactatcttatgaaatcagagcttttctaaagaatgtacgccccatataatgagggcagcccttctgtagccccagaagattgctagagagggcagcactagttaggtctagcagatcactgtcatggaggaacacaggaaactaggcttcagggcatcctagag

SEQ ID NO: 154045 - DNA, 220 bp, Homo sapiens
ggtgggacaagagttacaatggataaacgattcattgtgggtgaaattttctgaagatggagtaatttacacgctcatctatcaggaatgactggagatgaggatggaaacagtgactgccatgggttattcaaagctgatagttctctgattcacagacacctactgggtcaaaaagcctcatgtttttactcccatgagtctaaattttatggccatg

SEQ ID NO: 154046 - DNA, 648 bp, Homo sapiens
  misc_feature (571)..(571): n is a, c, g, or t
  misc_feature (598)..(598): n is a, c, g, or t
agacggagaccctcgaattggcaaaggactgaaaatacaccccggggcgcagggctgctgacctagtaagtacaggactaaaggccagggtgctggccaccatctggccgcttcctttccaaaaccaactcagttatgtctacttggggatacttttccagagtaaatatatccctttcctacatttcataagaaaagacagaggtgaagcaagattgactttacctgaattcacttgacaaacacttactcaacacatacgtcctcaggacataaaaaatgctgcatcctcactgaagctcttgctgcaaggagtagcagtcagactttgtgtggtgatgaacttcggtttgtacatcataaagaattagcacatttaaaaagtaaacatcttaaagagactaaaatcaattcaggattcatttatattataaataagtattatatgagagaaaggagagaagaatcaacccttgtcttgccaaaatccattgtcatcattgatgaaaatatttccttacttaagcatctttggggttacagagttcatctcagctcttatggcattggntatactagccagataggagtttttggnttgggttcttatatagagaacaagtactaattgactcagatctggttggg

SEQ ID NO: 154047 - DNA, 388 bp, Homo sapiens
gagtgagattcggtctcaaaaaacaaacaaacaataacaacaacaacaaagtatgctgaccctacactggtccgagcaacctcttggtcacagcaagaggttatttctgttaagcagcatcttacccccagtgttctcccagatattctgcctaacagctttaagtgggaggttgaatagtcagtttatctaagccatctatttttccaaactagcttgaaaggtatttccatttatgtttactccatgggcctctgatatgctgagatgtaacacagttttggttgtggtatcatctgttatagagacaaagggaaaaaaggttggccaggcccaacataaccagcgtgttaggttgccactggagatgggggagtcagtctccact

SEQ ID NO: 154048 - DNA, 364 bp, Homo sapiens
tcgacttgtagagagctgcaggttcggcgtctgtagagagccactcggtccttttgaaggacaaaacttctcccctgcgggcatcctgctcagcagtctgggaacagacagccgcgctagaagacgaacatagctccatagctacagcctggcgagaccaggttcagagaagccacttgtcagcaaatcgggctggtaatctgggaggctggtgcaggataaggaccccaggggaaagaagggaaggcggtaccaccaggggctaagagcctggggtgcaggggcaggaataatactggttttggttcctggacctttgtgaactttccagccggtcacgtccactgaatgctgcctttcaggg

SEQ ID NO: 154049 - DNA, 264 bp, Homo sapiens
aaaaagaatttagacagtacaattttcctggttgactcagcttcaggtagggaatccactgcaattatactcaataacttagaaaatttgatggcttgaagtcctcatacttttcttcagtctgtgagtcacttaactcaaaaaatgtctctgagtttgacatctaacaaaaccatggaaacaatactaacagtgcttcctccagcctccccgtagagaagtatggtgttttcagaaggagtatgcataaacaaagccacctgg

SEQ ID NO: 154050 - DNA, 278 bp, Homo sapiens
aatacaatctgcagcggggtggtttgaccaatggggagagactttcccctagaagtgatgttcaagctgcaactagaaagataaacagaagtaggttaggtaaagaagggagagaaagagcagtcaaggcagaagggctagcatatgcaaaggccctgtggcatgacagagaatggtgactgaaagagggatgattagagcccaaaggctgacaggaatacaaaagagaggatcaagacccaggaggaggaggcagattctcctgggctgtgtagatc

SEQ ID NO: 154051 - DNA, 459 bp, Homo sapiens
agctcaagaatagttctcaaactacaccccgtgggctaaatcctactcccacctgtttgttcagccttccagctaaaagtagtggttgcatttttaaatggttgaaaaaaatcaaaagaatgttatgacatgagaaagtgatacaacattcaaatttcagggttcatgaagtttatgagaacacagccacgcccattgatttttgtattccctatggtggcttttgtgctgccacagtggagttgaacagttgtgatagagaccatggggcacacaaagcctaaaatatttactgtctaacccttacagaaaaagtttactgacctccgttctagcagattgaaccatggcaaggatgaacattagcaggtgatgatatgggaccttaagagtgtgctcctctaaagcgcaaaatgaacatagatgacctgctctgacacaggaataagaaccaaaaga

SEQ ID NO: 154052 - DNA, 659 bp, Homo sapiens
gttaaataaaatggggcaagtttatgtaacaagacttaggcctaacaaaaaaagtcttcagtacttattacctaaggttaaattctagattgcaaacccctctacttatcctcaatgacaactataacaggttttaaaacctcctaaatctgctgtagatacagataataataataaggttgtgtgtttccttcaaggggctattaggaaaaaattagtaaaaaggtgtaacaggaataaattatggattactatgtagcacaaaggatagtggattttttctaactataattactagcaaagcagataaatgtaacagcgttatgggtagctgtgtctaatttgtcttgggctgtctcgctgtgtttattaatagtttggaggaataaacatgttgttaattttatactccagctataaaatgccatcttttcacattaaacattttaaaaaacagaagttaaagctcagaataaaattaaaagaagcatttgaattttgtttcctattttattcataagataaaaccaatgaaagttacccctgcttttagttataaaaattttgaaatttacattaacataatgttttctggcaagtaaatgctgaattgacaaatatatttttcttcctaagtctcattaaataaatacatattt

SEQ ID NO: 154053 - DNA, 546 bp, Homo sapiens
cacgccgcccagctaatttttgtatttttagtagagagggggtttgaccatgttggtcaggctggtctccaattcctgacctcaagtgatccacccacctcggcctccaaaagtgctggggttacaggcatgagccactgcgcccagcctcctttcctttttctttcctcccactctgtcatcttttatcaatgacaacttttaaagatcccatgactggtcacagtgagaactctcttttgcagtcatcctttgcaatgataatatatgcctgtaaactaaggctttaattttttttttttttttttgagatgaggtctcactctgttgccaacgatggtcctcagctgtgcctgacaagcgtgtgcggggtgctccaggcccgtggcgtgtgctcgggcgtttcccacgcagttgagcacaggccccatcctgcaggaatctgcagtccgctaagcggggagggcgctgcccaggtcaatctacacagaaaagcacccctagaggggcacgcctcaaaggaagcgcacgaggagggaacgcgcc

SEQ ID NO: 154054 - DNA, 405 bp, Homo sapiens
acgcaggccaggctttctagcagtgatgtgggctactataggcctggggtggggctggccagggccaatcctaagcattctggagtccagcctaactcttccaggagggaaggggctggtacaaactgaggtgcatggtgaaggccagagcagagatgcttttggaataagaatggtgtgccccggagccaagaggagactcacctaattaatgtaagaggatgtgtggggggcggtcggataacaggaagccagtgaagttctcgattgaggaaaaaggaacatatgtgtgtctgaacactaaatcaaagatggatctggggtgggcttctggggctcaggtattgtgtctgtaaaatagcctgcatttacattctttgcctgtaaccttaaagtctgtggtga

SEQ ID NO: 154055 - DNA, 334 bp, Homo sapiens
atctactatgacatcctcaatttacagtgggaaaaaaaggttcagagaagttaaagtgtccaagaggacagcaagtagcagagctgggatataaactcaggtctatccaacaactaacccatgctctattatcttaatgcctctagaaagaaggcaagtcttgagaacaggaaaactgagagaagtacacaaatgatttttttctgcttgatgttgtcccttacagaaggcccccaaagagaggacacagtgctccccaagtaactagaattgagataaaggtagaatgacagaagacagatcctctactttctccatgttacttgaggatggt

SEQ ID NO: 154056 - DNA, 323 bp, Homo sapiens
ggagggaggatgggaatcacacctaaagataactctttgatggaagtcctaatgatataaacttgaggaagaccctaaacctgccaataatacttggaaagagacagaatccttttcgactagcctacttctactataaacttcattaaatggattcatattttattgaagcagggttttggtacaattttcttagtagggactttttcccaacccaatatttcatccaagagtcgaaaagctgatcagagttggcattattccccagagggtttgcagggagagaagtttcactcgtcaacaaaggacagactcccctacag

SEQ ID NO: 154057 - DNA, 371 bp, Homo sapiens
cacaacagcaagctctccttcatttccatccttgaagcataggccagtttctctccattttagatttttcaggtgtggatcagacacccgtccaacctcttcagccctgtaagcctctcatgaggttgagtaggtgtggtaggaatcattgcatagctctctctaaaggaagaccctcccacaatccacacacattctgacccttttagacctggatgtgagtaagagccctgttaccagttttcagctgaatcctttgaaaatttgcaccatgggctaaaatgactgtggtatgtctgtgtttccagcgtaaccgtagtgctcattcattcattcatcattgattcattcaggcagtgcaaagtttcact

SEQ ID NO: 154058 - DNA, 175 bp, Homo sapiens
tcgctgctcctgtgatgggcacaggctgcgggcacgtagggctagaccagagcctctgggaggctctaagacagtgcacggatgcaggtaaagtgtagagctgttttaaaagtaaactttaccttttcaaacagctttaaatttatggaaaaaattattttaaagacagtagaga

SEQ ID NO: 154059 - DNA, 374 bp, Homo sapiens
ggcgcctgtagttactctggaggctgaggcaggagaatcgcttgaacctgggaggtggaggtttcagtgagccgagatggcaccactgcactccagcctaggtgacagagcaagactccatctcaaaaaacaaattttttttcatatattttgaaactctgttgttagacaaaaatacatttgcgaatatgtcttttaagtacatttattatgaaatgtgtccctttttatccctggtagtaatttgttgcctgatagttattagcttctttaacctctttctatgcttaatgtttgcatgataatctttttccatccatttgctttcaacttatgtgtatttttatatttaaattgtgtccctcatgtcaaca

SEQ ID NO: 154060 - DNA, 125 bp, Homo sapiens
tcctctttcagcattgtcatttcttctgaaaggtgagcagctatgaatctgagcaagagtgagaaggttcgagctaacacttgcttaggagggctggaactacatctgaaatagtttggggtctg

SEQ ID NO: 154061 - DNA, 571 bp, Homo sapiens
actggtttgtgagacagaacatttgggaatggcatgtagtttggaatgatgacagcacaggatgtagatgtgccagaggtgagagaaggtggagaggtagacaagagatagattttgaagggctttgtatgttgtgctaaaaagtcaggctctatcacatagacagtgaggagccattgtaagatcttaatgcaggaatgacatatcagatttgtgataggtgtctaagtaagaggaccttggcagaagtatggagaatggccttgaaataccagaagtagggacaagctgttgttgttgatccaaaagaaatgataaattataagagcttaaagaaatggtagtgaggagtaagaggagggcataaactcagatatttcggagatagagttgatgggacttagagactgattagctatggagggtgaaggaaaagaagtagagatgagtctgaagttttgagatgactaaatagatgtgatgccattcatagagatagagattataggaaggaaaggaggtggttggaattaggtcagtcatacagaggaaggaggtaatgagttcagtc

SEQ ID NO: 154062 - DNA, 403 bp, Homo sapiens
aggcgagacagaaatatgacatttaaaatgattagctctggctgctgtagggagaagaaactaaggaaataccagcagaagcagggatcctggccaagaggctaatgaaatcatccaagtgagagatgacaggggcttggacaagcagaggtgacctggatagactctgaagttacggttacctgaaagactggtacggggtttgacagaaaaagaagagtcaaggaagatcccaaagttattggccctgggcaagcagaaacatgaagctgggtttaactgaacaaaggaagaagtgactatatcagatctggggacaagatatgaagttcagttttttatttttatttcattattttgagagtctcactctgtcgcccaggctggagtgcggtggcatgat

SEQ ID NO: 154063 - DNA, 118 bp, Homo sapiens
ttgattctcgtttccttccgtacggtctagaaactttgttcttggggatgaagataccagatgggtaaatcccccccataccccaaattagtttaaggagagattggaaagaaatatt

SEQ ID NO: 154064 - DNA, 499 bp, Homo sapiens
tggtgtactgtctatgtctcgatcgttagaagtactaggtctttgtggataaggtaaaactatcggttgctgtaacaagggaaggtctgacaagtttagccatggaacacctaggaagcttagtcatttatcttttcagaagagtccttcctatttggtgttctggccctttagtaagtgttattcatgtttggagaagagagctgaagcttacacatggctaaaaatctgaactccggtaatctaatcttcctgcatttgttcctaaaactggaatgacttttctcactgaatatctaatgactaataagagagaattctggtccctagtccctgaggttattggttaagtggattggtacaatcagatattcttatatatatgtttatgagccatttcctattgggaggcctttcacagtatcagtttgtatgtatcaataatgccagccaatgagttttcattttccaaataatggtaaatgtaacagtcagaatg

SEQ ID NO: 154065 - DNA, 627 bp, Homo sapiens
cagggctgggatgtgaccccggctctttcttggtttctcctcgccgcttctctctctcctgcagcctcacagtctcagacaggattctttcaagaattgcaaacttggctgaagaccttcctgtcccctttcttacctcccatgtacaggatgggggtgatgatcccacttctctgactctcacccagaagttaggaactccttaaggctcctctgtctccagcctggagggagggcgcagagggagctggtgagcctggctgcctgccttctgcagctgacctccagaagtgaccagggcagcatccagcactgggcccagctgactacagttccacaggaaaaggggctgtcttagtcacttttcatccacatagctgctaagttcatgaggggacccagctacgggctttaactgctgccttctgccatgggatgatgcagtaagaaggccctcaccagatgccactgccatgctcttgtgttttccagcccccagaaccataggccaatgaatttctatgatttataaatgagctatctcaggtgttctgttatagcatcacaaacagactgagaaaaaaatgaataaataaagagatgtcgaaatcattcctcaaaatgaaa

SEQ ID NO: 154066 - DNA, 474 bp, Homo sapiens
tccttctcaccctccaaattgctcctgcctcctctgctgcgtctctaggactctcctgattcactctcctcttctgatctgcctctcctggatcatccaagataatctctttattttcaggctcctctgtctccagcctggagggagggcgcagagggagctggtgagcctggctgcctgccttctgcagctgacctccagaagtgaccagggcagcatccagcactgggcccagctgactacagttccacaggaaaaggggctgtcttagtcacttttcatccacatagctgctaagttcatgaggggacccagctacgggctttaactgctgcctcccttgcagagggactaggacttaactgagaaagatggaaaaacaagccacggaagtaacttttcacataaaagtgaatttaaggcacctgagactttaatgtgtgggcagataataaaaattctgttgaaatgttt

SEQ ID NO: 154067 - DNA, 360 bp, Homo sapiens
cagggctgggatgtgaccccggctctttcttggtttctcctcgccgcttctctctctcctgcagcctcacagtctcagacaggattctttcaagaattgcaaacttggctgaagaccttcctgtcccctttcttacctcccatgtacaggatgggggtgatgatcccacttctctgactctcacccagaagttaggaactccttaaggtttattaatcatttttcagtacaccatcttctgtcccggaggggccatgctgaagtcaaccaagccccaggccagaccaagaacagaacaactttgtatgtggtcctggggatgggatgaaagttagtaaaggaaacattctgacatccaaa

SEQ ID NO: 154068 - DNA, 442 bp, Homo sapiens
cagggctgggatgtgaccccggctctttcttggtttctcctcgccgcttctctctctcctgcagcctcacagtctcagacaggattctttcaagaattgcaaacttggctgaagaccttcctgtcccctttcttacctcccatgtacaggatgggggtgatgatcccacttctctgactctcacccagaagttaggaactccttaagcctcccttgcagagggactaggacttaactgagaaaggtgagtagaagccatatcaccacctcccagcctgacctataaaacgtctcatgggtagtcctgcatgctttgttgctgcaaatcagaagatgcttgttaaagatggagaagtcacaggatggaaaaagcctaggttcttgaattagttcttggtggatctactcacccatcaacaaaaatgaccagactggactttca

SEQ ID NO: 154069 - DNA, 370 bp, Homo sapiens
tccagcccccagaaccataggccaatgaatttctatgatttataaatgagctatctcaggtgttctgttatagcatcacaaacagactgagaaaaaaatgaataaataaagagatgtcgaaatcattcctcaaaatgaaagaaaatgagattttaaaagctgtttctctaatccagaagttggcagacatcttctgtaaagagttatatagtaaatattgtaggtctctgttgcacctaaacataacatcatgctcaatagttctgttataaggttattagattctcttataatgtgaaagtagccacagacaatatgcaaataaatgaagttggcttagttctaataaaactttatgtatagacactga

SEQ ID NO: 154070 - DNA, 454 bp, Homo sapiens
gattaatgtcatgagtgaattaatgtcctagctcaggagtgggtttctcttaaagtaagtttgtccctctcttgcactctctcactctgccctcacttgccctcagccttctgccatgggatgatgcagtaagaaggccctcaccagatgccactgccatgctcttgtgttttccagcccccagaaccataggccaatgaatttctatgatttataaatgagctatctcaggtgttctgttatagcatcacaaacagactgagaaaaaaatgaataaataaagagatgtcgaaatcattcctcaaaatgaaagaaaatgagattttaaaagctgtttctctaatccagaagttggcagacatcttctgtaaagagttatatagtaaatattgtaggtctctgttgcacctaaacataacatcatgctcaatagttctgttataaggttattaga

SEQ ID NO: 154071 - DNA, 660 bp, Homo sapiens
gacacgggagtctaggactgcatctgaggctgtcagaaaaggaagtcacgcaggactcagacccaaagaccctatcctgatccttccgggcaaatcctgccaactgcctcaaaagagggtgacattctaaaatgattccacagtccacagcaaaaaaaatgatattgtgttttttcactgttcagtgactgcttagacaactgagaacctctcttgctcacacaacaaattacccaaagcaaaaagtcgaaccactgtggtgtgatccaaggaactttctgtaaggaaaaggtcagagaacacgtacaatatcatcttatatacagatgtttatatttatataattgtctatgttcacatgcagtattttaaaatcaactaaaagacacatttaacttaagagcatatacttctgggaaggggaagcagtaaatgagagtttaaatattcaacatacacgtttttgccagcgtttgaatcttttaataatcaaactatactaatgcactacatgtctgtaactctctttttcaaaaaaaaaaaaaccttaagaaaaaacctcaaaactctagtggggggaaattaaagaactgacagagctcctagaacatgaagaaactcaactagatggcgggcagtaaaaaccaaaacacaacagag

SEQ ID NO: 154072 - DNA, 370 bp, Homo sapiens
cgggctgtgttttcaaataggatattcaggatcttacaaacacagggttcccacccaaaagaaggatcttcaactctcctggtgatggggagacacactgatctcttagctgagcaaatgtccctcaactggaccctccctatcccctggccactgccagccacttccccatgctcaccccctacagggatcttggcaagcctggctaaggtgtggtcacttccaacaggcccctgttgacagagcttaaaacaaacctccctgttcacacacaggccctggtgcatggaagagccaagttgggagactgactctctactggctgaggctaccagtgcagaaacctttcgaaaacaaaacagcacttaaa

SEQ ID NO: 154073 - DNA, 430 bp, Homo sapiens
ggaatgacaaaggataaaggcaaagacttaaagactcaaccaccgagacataagaactcaaccacatggaaaactcatagtaaaaaatagagatgtcagaaaaggataagggtaaaagtaaataaaaactgtataatgctacagaagtcatggtgaaagaatttcattaagaagaaatcaataacctcaaatgcaaaggtcaacttattttaacttttcttatctgagaataagaccaccagatatgactaaggctgagtggaagcctttaaaaaaaccattttctgagtgtgtgaagtgatgagaacagaagccacaataatgagagtaaaaaagggaaaacttccaggtgataacatcttaaggaaaatgcctggttaaaaaaagaaacaaaggccaggcatggtggcacatgcctgtaatcccagca

SEQ ID NO: 154074 - DNA, 1736 bp, Homo sapiens
gggctggagagggaataaaaagacttcactaaaataactgatcccatcactaaacaaataactatgcaaataacaataacaaatccctggtgaggggaaaccagtacccaggtactgcatggtcatccctcagtatccgtggaagattgcttccaggaccctgttgatactcaaatctgtggatgttccagtcctttataaaaaatggtgtagtatttatgaaacctatgcacaccctcctgtatactttaaatcatctctagattacctataatacctaatacaatgtaaatgctatgtagctgttatactatattgtttctgtacttgtattattttttactgttgtattattatttttgttgtctttttcctaaatatttttgatccatggttgcttgaatctgaagatgtagaagttacagagggctgtatgtatattatctaaaatgtctaatttctaacaaagacataaggaggcaggtaaagaaacaggaaaatattacccatacattagaaaaacaaacaaacaacagaaactataagagcaaccagatgtcagacttaactgaaaagtactttgaagtagccattacaaatatgttcacagaactaaagaaaaacatgattatagaagtaaaagaggctatgaggacaatattacatcaaataaagatcaataaagagatagaaattagtttttaaagagagccaaacagaaaatctggaggttaaaagtaaagtcactgaactaaaaaatgcacgagaggggttcacgtgtagatctgaactggcagaagaaagaatttgcaaatctgaaaaacgatcaatagaggttatgtgagctgaagaacaaagagaagaaacaatgaagaaaagttaacagagcttcagagaaatgtgagacattaaatacaccaacatacatataatggaagtacgagagttgggaagagagaaaagaaaagaaatattcaaagaaataatggctgaaaacttttccaaatttattgaaaagcagtaacatatgtttaagaagcttaacaaattacaaataagataaacaaagatcataaacagacacatctcagtaaaattgctgaaattcaaagacaaaaagaaaatcttgaacacagcaagagaaaaacaacatatcacttacaaggaaattgcaataaagttacgtaagagctgacttcccagtggaaacaatgaagccagcaggcagttggataacacatttgaaatgaaaaaaaaaaaaaaaaaacccaccaactaagaatcctatatccagcaaagctagctttcaaaaatgaagaaagactttaccaaataaacaaaatctgcaagagtgtgttgctagcagacccaccttacaagagacactaaaagaagttctatgaatagaaagaataaggaaaaagacagtgatgtctgctgttgacacttatattccatattataccagaggctcaagtaagagaaaatgggcaaaaaaaaaaaaaaaaaaaaaaaagcatccagattgaaacagaagaaactctaccccgtttacagatgacatgatcctttatattattttttttttaaaaaaagcatccagattgaaacagaagaaactctaccccatttgcagatgacatgatcctttatattattaaaaaaaaaaaagcatccagattgaaacagaagaaactctacccctatttgcagatgacatgatcctttatattatt

SEQ ID NO: 154075 - DNA, 603 bp, Homo sapiens
cagtacatctcaatatttggcgcccttccctggtgggcataacccaaccccctagggggccctaaatgacttcttagcccttgaacactccttctaggcctgataaatggccccagacttatgcagaccagttgcatcctcaggccagcccatgcagacactttccagccctaaaagacataccccaggcctctagatggctctgaagatactcttcaggtcttgcagaccctccttcacccctgggacatatctcaagatctcaagatggccccagaaccctctaaccagaccctagcctccggtcagcccaaaaagacaatctacagtgtctacagacacgatccaggccagctgtgtgatggagggcaggccttaggctcggtctaggcccagagacgccccaagtcctctcggagacgccccatagacgcccccaggaacccacggatgcgtcccggggccctgagaaggcccccctctcggcgccaggtttcgccgcagctgccgggcccgagaccgcccccccacagagagagcgtcgcacgctgttgcactggccctgtgactttgacctcttcctcatgaacatcttcccccaaa

SEQ ID NO: 154076 - DNA, 230 bp, Homo sapiens
gcaagagtatgttcaaaaatgaaattttaaaaaaatgaagttatgctctcctttgcttttattacagtccagtaaggagcttggagggcttttagacccccataatctccatcaccctcctcaaagctgctctaaataaacaaatttaagtaaaaagtatttgttatataaatgcaggatgaagacttattatgatggcttttcctctttcaaccagattgcggtgtttg

SEQ ID NO: 154077 - DNA, 476 bp, Homo sapiens
aaacgacccgaagactattctattctaccatgtttacagaagtctaatgcctttttttttcctgtcaaatctcctgtaagaagtgtcccactaagtcctaataagcccacatcctgacagcacagaaaagaacctctttcgggtgaaacaaacggcttaaatcagccaagcccctggcaccctctcctgaagcagcacttctccaaaactcattggcaccatttatggaggagagagtcttgagggtgggccccaccccactggatcatcaagcccaatggggccccagggaacacacaggaagggtctggaacacagttccgtaaaatgccaaacaggcgtaaaaggacaaactcccagcactcacaggtcgccaggaactgtcaaagccctctaactcaggggtcctcgggggaagactgccttctgccccgcacagagaggcaagtcaggccaccacggtcttcgggtcgttt

SEQ ID NO: 154078 - DNA, 483 bp, Homo sapiens
attacaagtgtgcgccaccatgcccagctaatttttgtaattttagtagagatggggtcccgctgtgttgcccaggctggtttcaaactcctgggctcgagtgatctgcccaccttagcctcccaaagtgctaggattacaggtgtgagccacaacacctgacctgtggctgttttcttactgtagcgatagacaaggagttgctgcattgcatagagatgctatattgcacgcaaaggctttactgacttcacaaaaaagtatttgtcccaggtgtagtgtactagatcccttccaatctgtaattttaatttaaaaatgtccaaatacccctgttttgaaggataaactctgtatgcttgtgcttattttggagaagccataaacttactttgttttgtacatgatcagatgtgggcgctatctccaactgtcttgcacttctgagtaagaatctgatgattgtgcacagtgacctggctg

SEQ ID NO: 154079 - DNA, 277 bp, Homo sapiens
ggaggcacaggaaggtaaaagctagcagatgctccgtaataatttggtgaatgaatggataaataaatgaatgaagtagccagaagtgaaattcaaacccaggttagcatggctccaaaaactttggggggaaaaggggcaaggaggggagaatttgaagagacaaaggaaaacaagacagaaaacgtacatccttctctgtctcaacatacatacacgcccttctctctctctctctcatgcacacacacacacacacacacacacacacacacac

SEQ ID NO: 154080 - DNA, 565 bp, Homo sapiens
ctttggtggatcccggtgttcccttgtctttttgcattgtggtcaagtgttgctgtctgcatgttgaagaagtagatatttattccattcttctcagtgtgactttattttaggtcatctttcaacagtaagtctgtctagggtttttgagtagaccatctggtatgggttgctgttgttggtgcagtgttagggagtgccctaagcctagaagtgctttgggtggtgcagcccaggctggaaatttttggctcccacagctggccctgcatcaggcttactttcgtggttcttaatgttgttgcagtcctgggtggttcctgaagcccatggcttctgttgcctgtttgccactgagtattttctgtaaacgaaggtcgctgcagtcatccgtcagtgatataggccagaactcgagtcttttctcaaaggaccgttagattcctgtctggtaccagtgtcagtctagatgcttagactgcagatacctgtcaggaatcagagtccatgagcattttatactggtagatttgttgttagagacaaagggaaacaccgggtaccg

SEQ ID NO: 154081 - DNA, 685 bp, Homo sapiens
ttttctaggtgctggaaagagattggagtttcaggaaacaaatattatccctgtttcatattcatggattttctctctctaactatgtaattataaattgagacaagtgctcaaaggaaaaagaacttctctctctagagtgcataatgaaggagcttgacctagacaaggtcaagaaaggtgtctctggaaggggatgtttgctctgagagctgtgggatgtgtaggagttaagcaggggcagtttgatagggaagaaggaagccaagttgtatggaatagaagagtagtgcagtcaaagtttctacatgggcccaagcgctgagcactcagaggatgttgcctagaaagctgttttaaaagtataaatgccattcaggacataggcatgggcaaggacttcatgtcgaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaacccaatcaaaaagtgggcaaaggatatgaacagacacttctcaaaagaagacatttatgcagcc

SEQ ID NO: 154082 - DNA, 337 bp, Homo sapiens
caccagtcagtgagtccagaaacttctttctcttaaaccaaatggttaagatcctggctgggtgcagtggcttacacctgtaatcccaacactttgggaggccaaggcgggcggatcacttgaggtcaggagttcgagaccagcctggccaacatggtgaaacctcgtctctactaaaaatagaaaaaattagccgggcgtggtggcacgcgcctgtggttccagctgctcaggaggctgaggcaggagaatcgcttgggcccgggaggcaaaggaggttgcagtgagctgagatggcgccactgcactccagcctggccgactgagactccatccc

SEQ ID NO: 154083 - DNA, 231 bp, Homo sapiens
gctcatgagtttgtaggtgatcctggatgtgggacgctgactccagttgaaatctggggttgtttggagagtagctgggagacagaggagactccctgagagctgggggagagctgctgggtgatggcagtaagaacatgtggtacattattgatgaacgcagtgactctgaagaataatcagaggatgacatgggagagcccaatggcttcattgattgcccatcgcggt

SEQ ID NO: 154084 - DNA, 167 bp, Homo sapiens
atatcctgtcatgattggctccctcttgtcacacaggcttcatcccacatatctcccctggcctcctgccctttccatatagccttagtttagtccccttgagttctaacattataacagaaatacctgcgctcatgaagcttgcattctaaggggaagaaacaaac

SEQ ID NO: 154085 - DNA, 185 bp, Homo sapiens
ctctatccgtatctctctatccttaatccctctatccttaatctctctatccttaatccctctatccttaatctccatctcctttatctcagccttctcatactttgccattctcttctttctggaaataaccagcacaacaattccagcaacaactgctatcatcacaaccacaataacagcac

SEQ ID NO: 154086 - DNA, 119 bp, Homo sapiens
acaccctcacatttacagtcaactaatttttgagaagggtaccaagataattcaatggggaaagaataatctcttcaataaatggagctgaacaattgaattgtcacatgcaaaggaat

SEQ ID NO: 154087 - DNA, 232 bp, Homo sapiens
tgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctct

SEQ ID NO: 154088 - DNA, 632 bp, Homo sapiens
ggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaa

SEQ ID NO: 154089 - DNA, 177 bp, Homo sapiens
ggataaggggaatttataggactgttaggaaggctgaagaccaagacctggaatggagcagaataaaagacaatttcaaagacccagaaaacagcgaaggagaggactacctcatacctggtaccatttggttaggagtgcctgtgatgcttgatgactacctcactgccatttttc

SEQ ID NO: 154090 - DNA, 584 bp, Homo sapiens
ttaagtctgataagaaacattttcttctattgattctgtctgcataatgggagacttggtctccacagctccttatcttaacccagacattcccttctactgattccaggtcttgagacaataacttaactctttaaaccaattgccaaatagaaaattgttgaattcatgtatgacctggacccccctgcttagagttgtcctgccttttgggactcaaccaatgtatagcttagatatattaattgatgtcatatgtcctcctaaaatgtttaaaattaagctgcagccaaaccaccttgggcacctgttcttgggatgtcctggggctatatcatgggccattgttcactcacatttggctcagaataaatatcttcaaatattttacagagtgaatctttttgtcaacattgtatgagcaataagttaaagaagaatatttaaaactgaaaaactaaattgtaaaatgttaagtagtaaagtgggactaagagcattaaaaatcatgtaaatactagagtaaaaaatagagtataaaaatactaaccattaaaattatgtaaataaaaagggaattatta

SEQ ID NO: 154091 - DNA, 110 bp, Homo sapiens
cgacgccgggcagtgggcggtggcctggtcttctccctggaacctctgggcggggccgggcctggagcttgggtctctgtccggagggtggtgtcacaggaagagctgga

SEQ ID NO: 154092 - DNA, 198 bp, Homo sapiens
ctggcacatttcttctgtaaaggactagataataaatataaacaaaagaacagggtcatgttccaatgtaactttacttatggactctgaaatgtgaaagttttatgaaattcaagtgccataaagtattgctgttttttttccccacctattcaactgtaaaatcttttcctacttcacaagccacaaaaatagggt

SEQ ID NO: 154093 - DNA, 378 bp, Homo sapiens
gggtagcctggggaggagataaagcaaggtggggaaatgaggatcagaaagaaggacaggaaggaaagagaagtctatccattgaacacctgctgtgctctgggccaagtgactttgctgatcactaccaactgggggaactcaaggctgctattttcagttttatagatgagaaaactaggactgagcaatgacaagcaacttgtccaaagtcccacagttgagtgagtaagtaagtaggagagtgcgactttaaactcactcctgtgtgactccaaaggctgtggaagctctttctaatgtggccccagtcaaaagtcaactaatctccgacttcagactcttgaaatccagctacccgttggctccccggaccag

SEQ ID NO: 154094 - DNA, 271 bp, Homo sapiens
ctccccatctcaggtgatcctcctgccacagcctcccaaagtgctgggattacaggcgtgagcccctgcgcctggcctgcctacttcccttttcagaaaattctgaaatggcttatagatttcagataaatcatgccagctatgttttggattttactgatgcatccatttcattattcatctaccttagtaaagcatactttttggaaatacattaaaaattattcttcaaaatgaaaatctctaccctaggtttatatttgaacatagt

SEQ ID NO: 154095 - DNA, 147 bp, Homo sapiens
ggttcagcctggcgctcgagtcctgtcgcactgtttttaatactaatccttcctggcatcttgtagacatagttttgagcactaaaccgcattcgtgctgccgtcgctacctgacactcattcttctcgcttgtgtgatccacctcc

SEQ ID NO: 154096 - DNA, 426 bp, Homo sapiens
agctcgcgaccccgagtgccgctagaggccaggactgtggtcagtgcttcaggggacaccaaggataactatctgtttaatatacagtgcctgtcctggaggaggccaccaagtcagcagggacatgagacataggcaatggaaacattagagcacagaagagaataatcaaccagcacactgtcctatacggactgtgcacatggtgccatattgactgtaaatgccacaggaactcagaataatcaaccagcacactgtgctacaccgactgtaaacactgcaggaactcagaggcagcatagttcggcacagatggaagaagtgaaaaccaaatgcttttgaaggaggtggaacttgacatcaacttttaaggcggcaaggtttcttcactattactcaacaggatgacccagttgaaataac

SEQ ID NO: 154097 - DNA, 238 bp, Homo sapiens
aaagcagactctagggacagagaagagtgggatgtgacctcccgagggactatctgaccctgaccacctcgtctactgcccacgctgcatcttcacgcccatgctacgctggggtccgtattctcccaagcccctgtgcccttccttcagctgcttcctatgccaatcctgactcctgacttctgacaccgtctgccagtcatgtcctcatgtacatgtgccaggggtaccgagctcg

SEQ ID NO: 154098 - DNA, 354 bp, Homo sapiens
aattttgaggaaagagtgggaaaatcatatctgaattagaatatttacttttagttgtcatcaatatttgtaatttgccatgcattaactatcaataaacagcagctacatcaaataagtaaatatcagtattatctttgataaaaaatgctctgtaaagactgggagtaaaaaataacatgaatgtgtgacctacgtaccatttttcttaatgtctagacgtcatacaaatattaccactgtcttatttctttgactataagtgtttctgaagaagctgatgtgattatcttaaattagaagatgcctgctataacctgagatatgtgttgctattccttagcagaactttgg

SEQ ID NO: 154099 - DNA, 649 bp, Homo sapiens
cctgtgtatgcctgtgtatatgtgtgtgcacgtgcatgcatgtgtgtgcatgtgaatgcacgtgtgtgtgtgtgtgtgtgtaggtaggtagagctgggttaaggatgagctactgtagagcaagtaaatggcacaacaggctttgatgcccggatgaagttaagagggcaccgagcaccaggtggtaggagaatgaatatgcacagagcaggaggtcaggggaagacccaagacccctaaatgctgaaggcttccgcaaagtcctgcggctcttcccctaagaaaatgcatctgagagggaggataggggactctgttccagttctgagaggcaaggagtaacaccgtgtggcttctttatttgtgttagccctacctacctcctggtacgaaggaactcagtcccagcaagccagagggaagcttccctcactcactcagtcactcactcgctcactcacccactcatcagtcacatcactcagtacaccatcagtcacatcagtcagtacaccatcagtcatatcagtcagtacaccagtacaccatcagtcacatcagtcagtacaccatcagtcacatcagtcagtacaccatcagtcagtacaccatcagtcacatcactcagtacaccatcagtcacatcagt

SEQ ID NO: 154100 - DNA, 455 bp, Homo sapiens
aacccatttctcaagaaaagtcttggagttacggccacagagctctcagcccatggaagccctgctggagtcccaggaaccaccttaaaggatgctgggtgttgtactgtggggaggaagacttctggaaccggctgctctcaccttggcagctttccaaatgagcccttgcctggggtgttgaggatgcacctgggagaatcctaggctgaggggctctgtggatttgcccccctccttcatctgaactacccgcctgccactgatgcaaaaaccagctctcagtgtccatgtcaccccacacttgcactcaccgaggtgggaaagcactttctggatcctgggtgtaagcagaacaaatggaaagtgctagaagaactgtagtgagaggcagaagcccttgaccccggcgagaggcagaagcccttgaccctggcctccctggtttctcccta

SEQ ID NO: 154101 - DNA, 437 bp, Homo sapiens
gaaggtctccttgcccctacagcctatgagagtcacttcgtttagaatcactgcaggtcagcaggtcggagcaaaagagcaggggtccctaggctggctgcttgttagagtcatcttaggatatgtaaagagtgctggtgtcccacatcccatccctagggattcgtatttgatttgttgggaaattaggcctagacattgtgttttgtaaaagcttctcaagagattctcatgtacagccagggttgagaagtatgtccctagaaaaaaggttccaactttgtcatatattataatcacttgaggaattttgaaaaataccaatacctggcctgtaatcccagcactttgggaggccgaggtgggcagatcacttgaggtcaggagtttgagaccagcctggccaacatggtgaaaccctgtctctactaaaaata

SEQ ID NO: 154102 - DNA, 568 bp, Homo sapiens
aaaagaatctaaacagatgaccctcctgagtttccccagtctattagtattagatcacccctttttgtccaatcatatttctacatgactgtccatactttgttgaacctcagcataaaaatggacaatttcccctgtatcttttgatcttcattccgaaggctcccatatatacatgataaataaatctgtatgccttttctctaattaatctgccttttatgagttgatttttcagcaaaacatcaggggaccaagggaaagctctcccttatcccctacggtatccaaaggaaagaaaatcagtgtgtcaaaaagatacctgtatttccatgtgtactgctgccctattcacaacagccaaaatatggaatcaacctaggtatccaataataaatagataaattaaatgtgatatatatatgcactacggaatactactcggtcataaaagagaatgaaatcctgccattcacagtaacatggattgaagtggaaggtaagtgaaataagctgcgaacagaaagttaaactccacatgttctcactcatgtgagagaaaaacagt

SEQ ID NO: 154103 - DNA, 409 bp, Homo sapiens
cccagggagtgaagccagtagcggtgcaaccaccatcagaatgaaaagtgaaaggagggaggaggtgatgaggatgcctcccaaggagcccacagtagggagacggaagctgctggcatccccatggttgacccatgagacttgggttcccctagaaccaagtcagcagctcctcacactgctgttccccgccagccgcccaggcctggggtcactctaggctactccctcttcctcagctttgccacctcagccaagtctcggagagttgacagcctgatggttctggaaacttctccatggccatagtgactctgagcccaggcacagatcacttcccacgtggattccctcagcagtcccttgactggcctccctgccatggtcctgcatgtggcttccagagtgg

SEQ ID NO: 154104 - DNA, 347 bp, Homo sapiens
gggggtgggaggtggctgcagacccaaagaaccagcagcagcagcctggaaagggaacagagccatgagcacagggagacggtggagggatgaagctgacatcttcacaggaaaaccagctgatctctccctgaagatctccttggtgtgtactcacctgtcctttatactggctgaactgttcattcccacatatgaataagtgaataacatgagtaagtgcccaaccctgggccaggcactgtcataggcgtttcaggacactaatgatggaatccctggcctcattaagcaaaccctctggagggtgacaacgttcaaactcataggctgctaggacttagtgt

SEQ ID NO: 154105 - DNA, 421 bp, Homo sapiens
ggtacggcaagggctcctgtgggtggagcgatgccgccaccttctgggcgctgggggcagaggcaggtagaggccaggcccggcggggcgccagagggcggctggcaggctggtgggctccctgctaaaggctggggaggaccacggtctataggtgctcctcagacttgtcggttctgttctcccctgggggaccaggcctggccatgaatcagccccaggaaggttctaatggcaaggagtcccccagaagcgctggtctgatgaatgccgtaggcacagtgcacacctaccagccctgcctggagttcagcatgtctgggccggtgcaccctgggccctggactcagtctggcctgcccagagcagctctgcaggtgtctcttcccactgcccagcacagacagggatgggacattag

SEQ ID NO: 154106 - DNA, 121 bp, Homo sapiens
ccatagtgtttaccaaagaaagccaaaaccactgtcctgcctgctcacctgttgagtaactattcttccttctaccacatgcctctaagatctgctgaaccaagactgaagtagcagtatg

SEQ ID NO: 154107 - DNA, 542 bp, Homo sapiens
gacatgaaggtataggtgggtgatagctaaaagatacagggtttcttttagaagtgattataatattctaatcattgtagagacagtcacagacacctgtgaatatactaaaaaccattgagtttgagtttaaatgtgtgaactgtatatatgtgaattatgtatcaataaacctgttcctcctcccaagaaacagacaaaaaaacagaaaatatgcaagtgtagagatcagttaaatgaataattgcacttcaaaattggcatcactttaattgcaaatatttaattataaaaagtttcaacaaacaaataaattagtaaagactactgtttgcctagcctgtactatttgccatgaacttacgtttcatttcaaactctcgtagcatacagaaaacatttccattatgcagttaagtaagaatctacgagaatgcataacttgcctgtggtcacaacagttagaaaaccaagggaatcagaagatgtatccaaggttacttggggccaaaactgtgctctttaccctacactatgacatt

SEQ ID NO: 154108 - DNA, 386 bp, Homo sapiens
ggcacacatctatatgcatttgtcaaggtttgaagaagtatacaccacaaagagtccattttactgtatgtaacataaaaaaataaaccgacaaaaatgatctgtaccctaagattatacatcggtaaaatatacataagataactggtaacaatggatgtattaggataaatgggtgtcatttccttttctctattttccaaattttgtaatatggccagattgcacttatattaaaaacaaggaaggcatatcattgatattactttcctgatctagtacttactactgaaatttcaaattaaatcaataatgccaaaataacaaactttgacaaaagaatgtaagcgcaacaagatgactcagggccattagaacatttctgc

SEQ ID NO: 154109 - DNA, 546 bp, Homo sapiens
atgccatttctagccttcaccaatgttccaaatatgtatgaatccatttctgaactctctattagtttgtcttttcctgtactaatactatacttcaagtgccataatttttttaacagaggtacttacataaagcatacaaatactgaatgtacagcttgacctttaaatacatatactcctgtgtgtgatccagctcaagccaaactattaacattcctcatgctccaggaggctccctcacgatccttaccaatcagtaccatgcttccaagatgaccacaattctcatctctatcactatagattatttctacttgtttttgagcttgctataaatgaaatcatacaatacgtaatccttgtgtctcactaatttcattcaacattaagtctgggagagagtcatcccatgttatgcataacagtttgttctttgtcattgtatatagtatttcaatctaaatagcataacttttatttctattttttgagatggagtgtcgttcttgtctcccaggttggagtgcaatggcatgatctcgg

SEQ ID NO: 154110 - DNA, 186 bp, Homo sapiens
tttgaaatcctgtcaataccttcccaaaatctctctcttccagtcccactgctattactgagttccttggcaatccaggaaacagctacatgccattgttctggtagctggaatacaccagagtacaaaattacctccttgtgaaggttacatcctagcagaaaaaaacacatcatcaatacacaa

SEQ ID NO: 154111 - DNA, 554 bp, Homo sapiens
gtagtcccagctacttgggaggctgaggcggagaatcgtttgaacctgggaggtagaagttgcagtgagccaagattgcaacattggactccagcctgggtgacaagagtgaaactccgtcttaaaaaataaaaataattaaaaagttttaaaattcactttggtatgatattttgacccctcaaagttgtttataaatagaatgaacagtggagccatctgttaaaatgccttggctgagtgactcagctagtagatgaattttgacatatttatagcaccatgcattgatcattttagttgtaatataacagctgtttattgagtaccttttatgacataggtcctggagaaccagtggtaatcaaaagagatgatacatctgacttctcacagtgtcatctgttgagggggacaaggatgaaagctgtgtcagtgaaggaggaaaattgagtggtaacagggagggcaggtgctgtggtgagcatgtatgtagcggaggccccgaactgaacacggaggtggttaggggaggcttaggaaggaaatactgg

SEQ ID NO: 154112 - DNA, 462 bp, Homo sapiens
acaggaaacctgtgccttttcctctatgtgtctgtttgccctattccagaggcctcttcccccttccctaccctctcctggctaactctgacccatccttcaggtctcaatgtgaacatctcttcctcctagaagccttccttgacccctcctgcctggattagatgcccctatgctctgctttcacagtgcccccattaccaaatgcccccttatttgcctcagtgtccaattagactgagagcccaagagagcaggggcagcatctgccatgttccatttttatatctctagcaggctcagggcttgcagataataaatattagttgatgaatgaaccaagtttgttgatttctgcactgggagctcagcatcctactctccttcaaactgagtgggcagctctggctccactggaaggttgattccagatgggtggtgagaccagaaggtctagggatg

SEQ ID NO: 154113 - DNA, 438 bp, Homo sapiens
ggaccttgcaaatgcctgcagcacagagtagcacaatggtggcatatagtgctcttttgaaaggctaggccataaatatcttaggttttgtgggcctatggtctctgtcgcaactactcagctctgctgttacagcaggaaagctgccatagacactatgtaaacatatgagtgtgtctgtattccaataaaactttatttgcaaaaaccagcagcaggctggactagaaaagtgtgcccattggcaaatggcgacagtaagagaatttgtctgccttgtttgtctttagatctgacctggaaataaggcaagaccccctaaaactgtgtcaacacaagtttgccatctatatgtgttctggttactattgctgagtttattaaaaaaacaaaactcagcagagcacagcggctcatggctgtagttctagcactttg

SEQ ID NO: 154114 - DNA, 365 bp, Homo sapiens
acttctgtcctcgtgttccacctaactctttgcacctacatatgtgcttcctgtgagcttcaatgtacttgattaattctctgttaccctgaccataacggattagtctagtcatcacctgacccaagatggcagggcccttccccaagattccgggcctagatacagttgattggtcaagggtgaatatcagtcctaagctagagtatttaggaactgtaacaaatagagagagtctgtctcttcttgtgtggttaaagtttagagagtcaaggctccaaatatattgactgccctgttttctgcagaaagctgggtcagctatgaaaaaacacaatgaagccaaagacatagaaaatatacac

SEQ ID NO: 154115 - DNA, 315 bp, Homo sapiens
gaaacctagatccctgaaatcattgatggaccctaggaggaaaaaaaaaattacccaaattcatccaagctaggtgtttgtcccatcagatatttttgtgggtctgcatatgagagagtccgggttagaagtctgcaactctgggccgggagaagtcgctcacgcctctaatcccagcactttgggaggtcgaggcgggtggatcacctgaggtcaggagttcgagacaagcctggcgaaaatggtgaaaccctgcctctactaaaaatacaaaaattagctgggcttggtgatgcgcacctgtaaacccagcta

SEQ ID NO: 154116 - DNA, 409 bp, Homo sapiens
agtaagaagtaaagagaactgatgacagagccctgatgggcagaggagaaggagaaaatacggagccagagagcagggaagaaatccagtaggatgtcgtgggagctgggataaaattgtttcaagaaaaggaagtggctactgttgtcagatcctgcaaggggagcggggatatcaagtaagatattgactgaagtgttactagattaagtaacaacaagattgttgatgatcttggggagagcaaattccatggagtgctggggatagaaggcacagtgtgacaaggagataccagtgaagacggcaaatacagccagatccctagctttggtagccctatgtgaactggcctttcttccttttgttctctgtcctccccgccaccgccgccgccccccccaccccc

SEQ ID NO: 154117 - DNA, 489 bp, Homo sapiens
tcaactccccacaccccctggtgtggcatctgaagacagagagacttgccactggggtctccagactgtttttggtaagtgcttaaacctcccccaaactgatccttagcacaaggacataatggtccttaaactttgccaaacttttcataaaggcttactttcactgaaataatgccagagtccaaagagtgttaaatttggaggatgcacttagtgatatttggatgatgacatagataagcattcacagaaagcagacacacccgcccatcttctgtgggcagaggctggggtctagtgcgcacattagagcaggacctgtcgtcatactctgtgtggcctgagctttggtttcagctctgaaaccccccttgtggcatcaggagccctgtaaatattgtaactggctaccgggtgtgtggtccctgaccacaaaatgaatatgcacggacccatactatttgtatataacacaggcctaattcc

SEQ ID NO: 154118 - DNA, 584 bp, Homo sapiens
cccccctgggggaattgaggccaggcttggtggctcatcctgtagaggcgggaggatctcctgagtccaagagttggagaccagcctgggcattatagcaagactcggtctctacaacaaatttttagcattagctgggcgtggtagggctgttgctttactgggtaatttttgtcttgaggcctcttgcttgtgagaaggggacggcagtatacttgagtttctcaagtcagagtcatggttcattggacttagttttttgtattaaaataaaaatagattttcctgattgtgtataaaaatgttcatatagtcatttaatttccacaccaagccacggcctccccaggtgatcagccagtgccaacattttgctgtctctgacctctcttgatcacagtacatacaatgcacagtgcacttgtaatttaaacgggctattctgttactgcttttgttgttgttgtttttgtttttgtttttttgaggtggagtcttgctctgttgctgggctggagtgcagtgaactgacatcacaccactgcactccaacctgggcgacagagtgagatctgtctcattaa

SEQ ID NO: 154119 - DNA, 376 bp, Homo sapiens
ctttgctagtcacatggccataaatagctgatcgtctttcttcctgctttcataaatctccgataaagcatgtcatggaggagctctcgtcatcctggttaaaaacaacctcttcccctttttgactgccttactcgccactctagaaacccacttcaaaagcctggctcttttcactttgtttcgtagagacaggtctctccgttgccctggctggtcttgaactcctgatctcaagcaatcctcccacctcagtctcccaaagcactgggattacaggtgtgagtcaccacacctggcccaaaagcttggctcttttgagagtgtttttatggcttattttgaaactaaaaccgtatctattttagggcctgat

SEQ ID NO: 154120 - DNA, 565 bp, Homo sapiens
cacgttcatcttcaaggcaggaagacaggggaggtgggggtaccgggtgtgttggtgtcctgtggctgctgctgtgacaaatccacagacagggaggttcacagcagcgacgtctgttccctcacagttctggacacccgagtcaaagatcagtgtcattgagcccacatcaccatgtgggcagggctgtggcccactgggaaaatatccactccttgtctcttcagcttccggtggctgccagcatttcttggctgacagccgcatcactgctatctctgccagtctctgcatcgccttctcttttctctgggtgtgagtgtgtgcacgcacgtgcatgcatgtgtggtgtgtgtgtgtgtgcatgtgtgtgcttgtgtgtctttcacaagcatacttgtgacatacttgtgatggcgttcagggctcacctggataatctacccactgtaagatctttaatttaatcaaatctgccaagagttctcttcttccaaatagggtaacatttacagattgcagggattaagacctgatattttggggcccattatcagtctgccac

SEQ ID NO: 154121 - DNA, 422 bp, Homo sapiens
ttgtgctgacagctgatttttatcttttatgtagcctggacattttgtttattatgctaagaggctccaggttagacttaaatattttattttaggcatgtaggtcttagcctacttttatgggctgtggttcaaatggcaatttaattcttaaagcatttgcagctattatttttatcttctttgtttatccggtgccaggaaagctctcactggttcctgccagggctgcccgaggggacacaaagagtttccccaggctgggccacttgtgtgcttcttggtgggtaaggcatgttgtgggatcaccctatggctgcctcctcgctgccccggtgcttcttggcagggaaggaaaatcttggacctaccaggtcaaagagccttcctgggccaggataactgctatagtggggtctctc

SEQ ID NO: 154122 - DNA, 561 bp, Homo sapiens
  misc_feature (8)..(8): n is a, c, g, or t
  misc_feature (54)..(54): n is a, c, g, or t
ctgactgnttcagaaaaaggtgagatgaggtctcactattgttgcccaggctgntctcgaactcctgggctcaagcaagcctcatgccttgcctcccaaagagctgggattacaggcgtgagacaccgcgcccagctgaagctttttatttgatttctgtgtcctttttttccataatagcaattttaacaggtatgtaattttctatacagtgaatgtacaactgcagttttctttaactattacacaatgtttaaagatttgtgttttcttaggatggattatcaaatatggaatctctgggtcaatggaaatagacatcttaaagtcttctgttgtattttgacaaatgatttgccagaaatgtaacactcctgagtcccggtgaggctcagagagcaccccagggcccactgtaacatttaaatattaaaaatggaaccagagctaattttagtttaagaaagtttaagttgtaatattatgtatttgtttatgttttgagacgagtctcactcttgtcacccaggctggaatgcagtagcacaatcttggctcact

SEQ ID NO: 154123 - DNA, 164 bp, Homo sapiens
gaaaactcttaattcctccctgcccaaaaggggcaaaaagggctaaatcttccttctgtgttggtgtgaatgggtgtgatgtatacagtcataaccttagatttatctatcattttcatggctgtaactaaaagctacggttaattgaacatttattagcagtg

SEQ ID NO: 154124 - DNA, 496 bp, Homo sapiens
aaggcatcatttggagtatcaaatacagaggaaaataaagtgattcttcagcctttgctttggcatagaatgttaccaggtatggacttaactatgtttgctgaaattattttcaggttttagagtcaggaatgaaggaacattccttgagtatttgatagatttgtggtttatagacagtaaattctataatcgatgagcttcctctttagaagttcttgaaccaaatttatggttcactgtaagccagtgtataggatttaaaaggatgagtctttgcatgagtctgatttctaactcatttgatacttctttttcacttccaataaatgttatcttgctttctgaacaaagtaggttatacataaatgcaattacatacggatggttcctgactatacctacacccttgtgtaggtttcaggctctggactggatgctctgttgcctctaagacctgatgggacaggtcaggagcaggggctttggggccaga

SEQ ID NO: 154125 - DNA, 220 bp, Homo sapiens
atgtgaacaagaaactaacctttactctgtgaagccaccagctgctgggggtgacttgctacagcagacaggctactcagagcactgtgctcctctctctacagcctcctcgcctgccggctgtatttccattttccacaaacacacctgttttcccactggattgacctccttgaggaaaggaactgtattatactcatttctacgtcctttgcaccta

SEQ ID NO: 154126 - DNA, 392 bp, Homo sapiens
gtacatgatgatgcaagcattgtacgagtgtctaggaagagggaacggagtgaatatgagcatccctcacagggaggtaaagacgtcccaacaccaaaaatatctcaacacaaacaaacatgtaaggaaaaaaaaaagtacaccgactgcttccactctgaccctgctattacagccacaaactcagtggtctaaccagaatgtgagatgaacaaaaaagggcaaataagttagataatgctgtatctgaaatgacaccagtctcaatacttcaccttcaataagaagcttcccagcgctgaagccacactgtacacatggtttctttctttccttaagcatctggcaccaatgacagcctacatttgggggccaacacaaacgtggagcct

SEQ ID NO: 154127 - DNA, 678 bp, Homo sapiens
ggatgaacgagattcccactgtccctacctactatccagcgaaaccacacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacggacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacgggcctcccggaggcctcttgagccagcatcgacacctctttttcccaaggccccgggggcattgctgaactttcagccccaacaacctggcccattggaagggtaatcctgtccgggaagggcccaacccactg

SEQ ID NO: 154128 - DNA, 376 bp, Homo sapiens
ggatgaacgagattcccactgtccctacctactatccagcgaaaccactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgaaaaaaa

SEQ ID NO: 154129 - DNA, 677 bp, Homo sapiens
atcccagcactttgggaggccgaggtgagtggatcacaaggtcagcagttcgagaccagactggccaacatggtgaaaccccgtctctactaaaaatacaaaaaaaaataagccgggcatggtggcgggcgcctgtaatcccagctactcaggaggctgaggtaggagaatcacttgaaaccggaatgcagagtctgcagtgagccacgatcacaacactgcactgcagcctgggtaaaagagcgaaactccgtctcaaaaaaacaaaaaacaaaaacaaaggtaaatcacaatatccattcaagaaaaacaacaaatatgctaattataatatttatgcactatctttggtaatattaaattatgaaaaatgaataatatgaaagtgaacaaagagcaaacttccttcttccaaaaaaagtgaacttcttaatgtaatctgctgtagtttgctttaattatataatcacagccattacttaaaagctaaaaaagactcagaaaaagaaacacccagtaggagttaaacactgtataaataaccttggaagtaatgaggcttattaaaacgagtaaattaaaaattgaagcccaatatgcgaaatggtaaatgtgattttagcagaacagcataaaattcttcatcacatgtcatcataaagctctccttttgggag

SEQ ID NO: 154130 - DNA, 709 bp, Homo sapiens
tttcaggatggctttctgtggttgacacacttcaggtggtgacagccccaactccaattgtgagctgcattcaacataaaaggtcaatatgtcactctgtttttcctggttaggtttttatgatgctcagtttagaaagtgacgtaagattcagatgcatcaattcacgtgaaccaggagagataataacacgttactcagtacccttaaccccacttccgttttctgttttaggaggaagcaacaataaaacaatctgatatcaggtatttatttacttttctaaggaaaacggcttagtattgcttagggttgggaaggaatcacccattcttccacactgtggggcgtggcccggtggatcacttgtctacacacgattttggagccccacgctaggcctggctggctgcgtgcccgacatgagaacagacacgagtcagcccactcctgagccagcccgctcctgagccagcccactctgctgccccgcaggaggttgctatctaatgtgggaggcacatgtgaaataacagttgccatctggtgtgggagggaagcgtgtaggctgtccacaggctgcacactctcctcttctttttattctctggcccccattttcctcatctgtaaaatgcggagaattcctgctgtattagtctgttctcatgctgctaataaagacatacccaaaactgggtaatttata

SEQ ID NO: 154131 - DNA, 312 bp, Homo sapiens
aggcaccggcatgtgtggctcaagcaactatataaagctcatgactttatgaaatcaaatacagggatttcctttcttactcccacacattccaacagagacatacataagcacttttgtgcaatttaaacttgaagccatcccagtgtggagagagagggagagagctctctccacactctctctccacactggtgtggtgtggaatgaggggctggacccagagggcctgctttggccggggtgaattctctggcttcagtagggttcacttcctttcctgacagtggcttctctccagtgtggagagag

SEQ ID NO: 154132 - DNA, 755 bp, Homo sapiens
caaaaataagatgtgaaaaatagaatatatatattaagataaaggtattatgaaaagatatatagaaatacccagtccccaatcctcacataaaggacttctgaaaaacttccctttttaatttcaaagactgcatataaaggtataatgaactatatcgcttacttaataaaatcctaagtggcatacatcccagtacatttagaaatttaatctcaataaagtcaaaggagttaccgtcttggatgaggatgaaatctgcttcatttatagtataaaactacagttgtggatatgttaagcatgtcctttcttactccatgttaccactcattataaaatgattggtgttttatgtagcttatattttaggataaacaagaggataatcaagcatgtttaaaatcaagttcaaataaaaaattttctctgaaaacttaattttttatgaatctagtatctctttggttaatagaaaacttgagagaacattttattcacttattatggttcacaatttggggtccttgaatgcactccagtggggttcatgaaacctctgaaattataagcaaaagtatgtctatgtatgtaaacttttctagggagagggttcatggttttcacaggattttgaaaggggtcagtcatctgggagtagagtctctgccttgggtgaaagttgaggactgagcttctttgaaaaagaaccttccccatgacttactgaagatgttaagagattaaaaaaaaaa

SEQ ID NO: 154133 - DNA, 408 bp, Homo sapiens
ttcctcctttcaccttccagggaatctgcatgcatcagccattacctcctctttcaaaacacaagaatgggagcacgcaatgcacactttcctacactttgctcttgtaattttgttttgtttttttgagacagggtctcactctgttgcccagactggaatgcagtggcgcaatctcactcaccgcaacctgcacctcccaggctcaagcgattctcctgcctcagcctcccgcgtagctgagattacaggcacgcaccaccactcccggctaatttttgtatttttttagtagaaacggagtttcaccatgctgcccaggctggtcttgaattcctgacctcaaatgatccacccgcctcggcctcccaaagtgctaggattataggtgagagccgccgcgcccgg

SEQ ID NO: 154134 - DNA, 184 bp, Homo sapiens
gtattgtgcaagagtctaggattgggcaccacagggtagaaatgatgaatcaaagcttactgattctgtttggctttctgtggtgcattttggcagccctgtgtggatgtgtcagaggctgtctgaccacgcgtgaggctcgttgatggtgataggtttctatgtgtgacgctaaaacgccagg

SEQ ID NO: 154135 - DNA, 246 bp, Homo sapiens
  misc_feature (239)..(239): n is a, c, g, or t
ggccactgtaggggaaaagaataaaaaggtagttggctaaaatgcagaagtccctgaatgctaggtcaggaatttggactttatcttgtagacaaaatagacttactgagaaactttgtatacgaattatatgtgaaaaaactattcttgacgattatttatatggcagttgtggaacaggaaggcaaagagggacagttttttttttttttttcccttccccaagggtgaccggcganggggatc

SEQ ID NO: 154136 - DNA, 551 bp, Homo sapiens
aagaaatgtggccagtgcacaggggtgatagagagtaggtacccttgtcctaaggagttttgagaaagctacagtcttctgctggcacctggggcttatccattgccataggaaccattcatcttattgctgaagttctaagtgatttgagatgaagaatgtttgcttgaacacattttaccctgtggtcatccttccgcatacaactctaccctcaaagccggagtgcttcctgctgctgtggagccggggtgctgcaaacttctgggatattccacaatttaatgccagtgattaggatttttgttaggaaactccggcaggcagataactccagcaggtccgagacaagttggtgtaaacgttggcacggactggctcacctgttgtgtgattaagtcatggggctgcctcttgttctctttgggacaaagccaggcagcatttgttcaagtgaaaattaaggctctgtgtggtgtgtgcctgtatcaatagaaacaggcaagcagattccgcaggggaaaagactgagcaagtgggtgggagggacg

SEQ ID NO: 154137 - DNA, 387 bp, Homo sapiens
gaagctttctaggtcaccttacccataaatgcccactgaacagatcttctcagatttcagaggctcagtctcattagtcacgtgtgtgataaggctactttttccgagaaggctgaggtctatgctggcagcttgatgttctctgcagatttgatgcaggatttctccctggctttctcaggtcatttcattggagtcatttccttttggggtcctagacctctttggtgctaatgccattaggctatgccaggaggctgctgtgctaagccttggtaaagatgggtgaaatgaatgcttgttgtgtccccctgtacttcaattctctcccttcttgagtaagcaagccctgattacttagtaacgtctctttcatcatcaattata

SEQ ID NO: 154138 - DNA, 477 bp, Homo sapiens
agttggctgtaagtatgtggatttctttattctgttgcactggtctatgtgtctgtttttataccatgaccatactgttttggttactgtagtcttgtacattttgaagtcaggtagtgtgaggcttccagctttctcccttttgcccaggattgctttagtgattctggctcttttttggttctatacaaatttttttctttttttagatggagtttcactcttgttgccaaggccagagtgccactgtcagaggtgcaatgtcagctcactgcagtctccgcctcccaggttcaggcgattcttctgcctcagcctcccaagtagctgggattacaggcgtgagtcatggcacctggcccatttctttctttttatttaatcattggtttggcttatgctgaatatcagtgacaagagaagacatccttttcttgtttctgatttcagggggaaagcatctagtctttcaccatt

SEQ ID NO: 154139 - DNA, 363 bp, Homo sapiens
aaggtaactctaaaaagttatttagcttccatcagcatcctttttcttgactggggagtgcaactaacctatctgtaaagacaaggaaggaagtaatattgctgcaaatacctaatacagagcttgaagcataatcgattctaaaaacaaacaaaggcaacaaacaataaaaggaagtttccattccttctactgagttcatggattttgagctttggtgaaacttctcatctcccataggagaatcccagcattatctgcctccttgatggcacaggaggcaatctggcagttacagatatttagaaaccaaagtgacactgaatatctcagcagtcctaccatcccattcagggctctttc

SEQ ID NO: 154140 - DNA, 468 bp, Homo sapiens
aatagaaaggcaattccatttgttggaagatttttcttaccaaatgttggagagttaaaaagaaatttcccatatacagcacttcagaaggacccaagtcattcacagactgtttatgactacaattaagtcttctcttagtagatgatatcaactccaaacccacacaagcaagctgagttccattcaaagcaataacagcacctactctgtgcttcctcttctcttctgaaaacagcttagcagcttcacagtaatgatgtcttcaaagaattctgatgagccaaggactgtgagcatagggctgatctccatcatacctagtgcagctctgcctgattgcacaaaaaaacttatgcagtttccctttcaaatgaaattagcatagatgaatgtataatttctgagtaatttgccaggccttccccctttttctcataataaagctattctattcaccatcaaaaa

SEQ ID NO: 154141 - DNA, 112 bp, Homo sapiens
atatgcccactaaaaaaagcctagaaacaatgacaaacccaagcgatgagtacctctagtgccaagggaaccttggagaaatggctgattccagatctgggttagaaaatgt

SEQ ID NO: 154142 - DNA, 274 bp, Homo sapiens
cacaggcctgctacgtgagagaggcagaacgacggctccctcaaagacgtccatctcccaatccccaggacctgtcagtgaatacatcaggttacagagcaagggggaactaggttgcagatgaaacaaggttgatcatcggctgactttacaataaagagattctcctggactgtctgggtgggcccaatgtaatcacaagtgtcttttaaatgtgggtgacagacggagaaagtcaaagtcagagacttgaagatgggggaaggggccatgg

SEQ ID NO: 154143 - DNA, 537 bp, Homo sapiens
ttccatgatatccacggtgttctaaactctcgctgtcagtgccatttccatgatatccacggtgttctaaactctcgctgtgggtgccatttccatgatatccacagtgttctaaactctccctgttggtgccatttccatgatatccacggtgttctaaactctcgctgtcagtgccatttccatgatatccacggtgttctaaactctcgctgtcagtgccatttccatgatatccacggtgttctaaactctcgctgtgggtgccatttccatgatatccacggtgttctaaactctccctgttggtgccatttccatgatatccacgacgttctaagctctccctgtcggtgccatttcgcatgatatccatggtgttctaaactctcgctgtgggtgccatttccatgatatccacggtgttctaaactctcgctgtgggtgccatttccatgatatccacggtgttctaaactctccctgttggtgccatttccatgatatccacgacgttctaagctctccctgtcggtg

SEQ ID NO: 154144 - DNA, 498 bp, Homo sapiens
caggagacagaaacgacgtaaaacaaggttggggagaaaaaatggactccatgaacacccaggacactcccataccagcccagagggctgcaggctcctacaagtaggtacagccccactggctaagaggaggcagaaggtccccaccagagccaatccaagaaacaaggctgtcattccactccaccctgctggaaagcagggcagtggaaagaaccaggctatggaatcaggaacatctgaatttcaatcccacctctgctgtgttttgagaccagcaacttaagttcctcaagcctccattccctcctctgtaaatcggtgctgccaaactgagtcgctctccaggccagtgaaacaatgtctgcatagtaagccggctggcacctggtgctggattaactctctttccgcaattaaactgaggctcaagtagaggtctcccaaggccctactgttgtgtggtcttggcaaagtgctttctgttctctaggctcc

SEQ ID NO: 154145 - DNA, 681 bp, Homo sapiens
aggggaatttgggccttggaaggcaaaaaattgggcaggagggttattgtagcaacgtattctttattttattaaaaatttatataaaaagctccaaaatgaagttacttgaatattcggttggttttttttttttaaagatttattaagtaggctgattgttaaaggatagaaattgtgttttcatctccttaattataatagataatagtggtaggaaaatgggagatgatgatcccctctaaatattcccttttgacaaggttagcattttttctttaaggcagaattgatcttcttttaggtaagtatttagattctgaaactgctgcagatggcaggattttcagtactcggtacatttttttaaatggcccattttgatattcctttcttttttttaacttaaaattttcaaaaaagttagatctcacagtaaatatttctcaaatccttccaataggattcaatttgtacacatgtttctgatgaggtcactgcttgttgttatgatacagaaaagcctgtgtctattttaggcatttactgtacatttctcccgagaaaagagtgagatcgtgtcatctcatgctccccatccgcaggtcacttcctgtagaaatatggactaacttaaacctcgttttactgcaatcacagcaaccaaccccataaacacca

SEQ ID NO: 154146 - DNA, 659 bp, Homo sapiens
tagtgcaaaaggtgaaaggtactattgtagcaacgtattctttattttattaaaaatttatataaaaagctccaaaatgaagttacttgaatattcggttggttttttttttttaaagatttattaagtaggctgattgttaaaggatagaaattgtgttttcatctccttaattataatagataatagtggtaggaaaatgggagatgatgatcccctctaaatattcccttttgacaaggttagcattttttctttaaggcagaattgatcttcttttaggtaagtatttagattctgaaactgctgcagatggcaggattttcagtactcggtacatttttttaaatggcccattttgatattcctttcttttttttaacttaaaattttcaaaaaagttagatctcacagtaaatatttctcaaatccttccaataggattcaatttgtacacatgtttctgatgaggtcactgcttgttgttatgatacagaaaagcctgtgtctattttaggcatttactgtacatttctcccgagaaaagagtgagatcgtgtcatctcatgctccccatccgcaggtcacttcctgtagaaatatggactaacttaaacctcgttttactgcaatcacagcaaccaaccccataaacacca

SEQ ID NO: 154147 - DNA, 850 bp, Homo sapiens
atacagaaaagcctgtgtctattttaggcatttactgtacatttctcccgagaaaagagtgagatcgtgtcatctcatgctccccatccgcaggtcacttcctgtagaaatatggactaacttaaacctcgtgagtactgatctgagcatctcttgcagcctgtagtataagaaacccacctgggattttatgatagctgtggaattagaaggcgggaaattaacttttatttcctgaatttgtgtgtgcattgctaagtctgattcctttataatattccttctagaaggaagaatgaggttttttcagtcatcatgtaataaaagcctggggtcttcagcttggccataacagccttgacctccaaagaatgtaataacaatatatatatagctgtaaatggtattatactatcttaaaagttttagataaaatcatagttctctttgcttagcataacatatttaaaagcctaatacaatgctttccattcttttttgtctgttgatacttggctttcttagaactcttttgcttagctgttttagttttaattacttttaaaggtgggttatacatttaggagggtagggggctggtcttacgaagttgaattaaagtcggaattggccttacggttcccccttaggaaccagtttgcattagaaattccgtaacggtaagggacacacacgggattcgataaggactatagagactaaattaggttaccttagagcgatgtggacacgggagaatctaaagcagtgtactttggcatttgaattatatattatttgttaattattgttatcgagcgagagaacgagtaagcacatatgacaagag

SEQ ID NO: 154148 - DNA, 1080 bp, Homo sapiens
ggcataaatttatggtgaggaagaaaagacagcaagcatgcactattctttctaccagtgtaattgtgaaaggaaaaggaaaaaacaatgtggtatccagaggggacatggattcctaaagattttgaacataattatagatacagtgggggtaaaccaacatagaaggggtttaaaacccaggagttgacaggaggatgttaatttataggaggaggcacctgagaacaaggaaaatggggaagagagaatagtacataaatggagaacgagctcctccacttggaaaaaaatgagtaaggaaaggttgagttagttatacacaatctagtgatggggagaggcaaatgatgactttcgtctatgaagtaaggagttaaggtgatttgctaaaaatgataaggtaggtaatgacaatagagatcctgcaatgatttcatgtggactctgtgggacaaagaataaggagatgaccaggactgcagaccaattttcagagtttacttgaagccggaatccttttttcatgaatttttcatatcattcatcttcacgattgagcattgtgacttttctctagtaggtcctatcagtctaggcatagaagaagaatgaatatacagctgaactgatccaggtctgaagttttgccttgtgtgtgtgatgaatcgatcaggagaatgtgttaagggagtctgcaagagtatattcagaatgacacttagattagttgtagaaaagagaataaataggaatggactgatgaattgggaacaaatggagagattaaagggaaaagggcatggaatgtgtgtgaggaactgatataagaggatgtggttcaacaaatttgaacttggagtttaagagttaaaaaatggaattgttctaggtaatagaaagctaaaatgtggatgcctgaagtcaagcggaggtgggtaataaatagaactgaggacaaagagtgtgaggcaagattatcaaactggtcaaccacgtgaggactaatttcatggagcatgaaggcagtgatgaagagggagactgtgaaccaggtatgaagttattgttgaatcagtg

SEQ ID NO: 154149 - DNA, 1082 bp, Homo sapiens
  misc_feature (2)..(3): n is a, c, g, or t
gnngtgtgtatacatatgcatatatacatatatgtatatgtatacacacgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcagcatcaaaaaaattgaaatacaaattacacactggcaattattatttatgacatatattcagatgaagatgtattttctttataaagagctcttac

SEQ ID NO: 154150 - DNA, 1279 bp, Homo sapiens
  misc_feature (2)..(3): n is a, c, g, or t
gnngtgtgtatacatatgcatatatacatatatgtatatgtatacacacgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcagcatcaaaaaaattgaaatacaaattacacactggcaattattatttatgacatatattcagatgaagatgtattttctttataaagagctcttacaaatccataataaaaagacaatctgaaaacctgtaagatagagaaaaacgtagccaaaaatttaagaagaggtatttcacaagagaaatagcaatgttctgtatgtacatcaaatggttattttattaggaattgaaggaatgatttttaaaagtgagataatttttgcttatcaggttggcaaagatgaaagaagt

SEQ ID NO: 154151 - DNA, 469 bp, Homo sapiens
accctgtagacttagccatgacatcttcgtctaggccaatgtcctgaaggatttatcctatgtttccttctagggttaatatggttatatgtcttcaaaatcacaggcaacaaaaataaaaatagacaaatgggactatattaaactgaaaagcttctgcacagcaaaagaaacaatcaacagcaaaattataacctacagaatgggaggaaatatttgcaaactattcatccaacaggggattaatatccagactatataaggaactcaaacatctcgacagcaaaaaaacaatgcaatgttaaaatgagttaatggtctgaacagacatttctcaatttagatgtcttcttagacatgtaaatggtcaacaaatgtatgaaaaaacattcaacatcactaattctcagggaaatgcaaatcaaaaccacaatgagatatcatctcaccctacttagaatggctatta

SEQ ID NO: 154152 - DNA, 377 bp, Homo sapiens
tgtttagctgaaatgagaatttatactagaagacgcctcccagctccatggaccagctcactccataaggctcctgcccctgagggtccgccacctccctcagcacccctccaatcccacacctagggaatttcctgggaacctgccttttaaaccctctccatcctctaccctgcctctagcctctgcaaaggcccaggcacaagtgctgggcatggctggcggggcctttgcttccctcagtgcccagggacaaggatgtgcagggctggcagagggaccccaaggttagcgtggacgggatccatggacgcttccttctttctggctggaaggctgagatgataacagaaaggaagcggatgttctctgaactc

SEQ ID NO: 154153 - DNA, 443 bp, Homo sapiens
agaaaatcagtgaaagaactggttattttaggaagtctctaaaattgacaaacatctagcaagatactacaggataaaaagagagaagacccgaactaccaaaatcaggaatgaaacagaagctatcactagagactcttcagaaatcaaatgggtgataagagactgctataaacacctctacacacataaatttgacaatgcagataaaatcaaccaatccttttaaaagtacaaattaccacatctaaaccaatatgaaataagtgagttgaaaagccctataactattgtgatattatgatacatatattggtttttatccagtgttcccggctaactcccattgcccttgttacagtcttttgttacaatgttggggcactttaggcctcagaaagcaaaatctccctctctaaccttctgccttcctttcccctgtt

SEQ ID NO: 154154 - DNA, 234 bp, Homo sapiens
gttgggtgtgaaatagttgtttagaattgtgtacagttttcttttgttacctttaaagcttccgtagactgtttttggatcaggcagtaaaattgctataaaaagtacttcttttgtcataaaacctcatgatcagttttggaagtggaatgttaggtaacccagccaaatatttacatatacaaaataaacacaagactgaaaaatagtaaatttttaacctttctcttgctg

SEQ ID NO: 154155 - DNA, 244 bp, Homo sapiens
gcttttattttgcagatgctgatgctgtatgagaggttaggagatttaaactccactctaatggaaatgacccatggagataggtgctgaagtttttggtctcaatagctgtctctaggctaaaatgtcttagctctacgttgccgttctttgagatactagtgtcttgtgtttatagattaaatagcttggctgtataagtactgaccaaaaacgtattagcttttccatagactctgaatat

SEQ ID NO: 154156 - DNA, 388 bp, Homo sapiens
ataaattaattttaataactattatatttagctcaaattatataagatactattatttcaacatataactaatatcaaaattattaaggctatatttttcgtgtttttttattgtctttgaagtcagatgtgcattttatacttgcagaaaatgtcagttagggctgcccatattgtaaggcttaatagccacatgtgtctaccatattggacagcacagccctagagttatttttgcttgcttttcacttgaaacaaatgtcagcatgcaggaaacatctaaagccaatttctatagaaaactgtatattatttgtataatatagtagtaatagcaacttttatattctataaaataaattcttcatgatgaattctataataataa

SEQ ID NO: 154157 - DNA, 492 bp, Homo sapiens
atgcatatctaaaatcttgcctacttcaatttgcagtgattcttccccaaatacaatttaatgttcccatgtagatgtcagaaagcatttatcaggcacttaaatgaatcccatacctgtatgccacaatagttaaggacacaagtattgcatagacctgggatgagttactaattcacaatttactctctaccaggctttatgcaaatacataacctctggggcctcgttttacttatctgtaaaatgaggacaataatggtatctatctcatgtggtctttgtgaggtttaaattagaagttacatttaaggggcttgatgtggtgcctggcataaagtgcttaataacctttcatgttttttgttttgttttgctgttttttagagagaggatctcactctgtcatccaggctgaagtgcagtggtgcagtcatagctcactgcatcccagaattccagggtcaagcaatcctttggcttcagcctctc

SEQ ID NO: 154158 - DNA, 346 bp, Homo sapiens
actgtgctaggccaatttttgtatatttttttctttagtgcttttcaatagctttgggggagaaagtttccacatctgtaaaatatggataataactgaggcttaaagaagttaagtaactttctcaagtttatgtaaacaagtttcattgctagaaatcaaaccctggaaactactgactgaaaggtcatcctcttttcctagtaccatatgccacatcatatgtaaaacttttgatctagtccaaacatactttttgggtaagtgattcttaaatttggtttctggtatttttcagtaggttttagaactcaaggctgcctttaacgatgcaggagagatacag

SEQ ID NO: 154159 - DNA, 240 bp, Homo sapiens
ctatagcctcagactcctgggctcaagtagtgatcttctggtgtgagcctcctgagtgcccctttgcctagctactgctccaaagattttattttgttttatttatttatgtatttatttatatatttatttttttagctggagtttcgctcatgttgcacaggctggagtgcaacggtgcgatctccactcaccgcaacctctgcctcccaggttcaagcgattctcctgcctcagcct

SEQ ID NO: 154160 - DNA, 351 bp, Homo sapiens
caggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatgttttcagtgtagccttaacaatgaatcgtagtaacttctcaccttacatgctccccaaaagatgtcactttgggagaacatattcaaggaaccctc

SEQ ID NO: 154161 - DNA, 316 bp, Homo sapiens
acacacacacacacacacacacaccttttacttccccagagcaaagccaaataagaggcaagaggcagtgctgctggaggcagcgtggttggggcggagagacaagtctgctttggggaaaggttgctcagactcagttttgtctcctgcattccatcttgggccactgctgtcctcctgccgcagctcagccccactcgtcacaccgctgcagctcggggatgaagcaatgcatcatcgatgttttggaagttgggggagatggcttaatatagggcatagtcagttgtgaatagtggccggcagggcagagggg

SEQ ID NO: 154162 - DNA, 440 bp, Homo sapiens
taattattgtatttttagtagagacagggtttcacaatgttggccagcctggtctcaaactcctgaccttaagtgcctcctgacctgccttccttggcctcccaaagtgctgagattacaggcatgagccaccgtgcccagcccctattccttttcttatgcatacttgtccctggcccatttctggtgtttgtctctccttcagaaaagttggtgtatggacgaggtcaggagatcgagaccatcctggctaacatggtgaaatcccgtctctactaaaaatacaaaaaattagccgggtgtggtggcaggcacctgtattcccagctactggggaggctgaggcaggagaatggcgtgaacccggaaggtggaggttgcagtgagccgagatcgcgccactgcactccagcctgggggacagagcgagactccgtctc

SEQ ID NO: 154163 - DNA, 239 bp, Homo sapiens
tagtcatcatattttaagagcatctaatcaggtatttatcccaaacatgagcagcagtacattcgatttgtttactaaacagaaattggataaatctggcatccaagtcacagtcaccactttgcttgtacagcccaaggtcactcgggtagctcaggtggggagaagggggtaaggcaggatacaagagccacttttccagccgcacaaggcctattctgatgttttgacagagtccc

SEQ ID NO: 154164 - DNA, 228 bp, Homo sapiens
actcggctgggattacggctatccaggtacccaggctggggcaggagaatcactggaacctcgggggtggaggttgcagtgagccaagattgcaccactgcactccagcctggggcaacagagcaagactccatctcaaaaaaaaaaaaaaaaaactttcataggaaaatttgttcttaaggcagctcgaacactacctccttcctaacccctttctccaacatccaa

SEQ ID NO: 154165 - DNA, 573 bp, Homo sapiens
acctctctctgggcaggcagatctgaagacctgagaaaaaccaaacctcaaactctgcctctaaagacatggaactaagtaagaacctagccctggagccagacagggactctccctggagaacagcagttcccaacctttttggcaccagggactggttttatggaagataatttttctacacataggaggtggggggtagggggtggtttcaggatgaaaccgttccaccctccgatcatcagacattagattctcataaggaaggcgcgacctagatccctcacgtgtgccgttcacaacagggttctcgctcctgtgagaatctaatgctgctgttgatctggctggactcagagctcaggcagtaatgctcacttgctcaccactcacctcccactgcatagcccagttcctaacaggccacagacccatactggtctgctgcccaggggttggggacccttgcggtagagggtcccaagaggttagcaagcgccagtgggctctgagggctgcctttgccatggtcagctgatatccttctctctttgttatttactatatttgctc

SEQ ID NO: 154166 - DNA, 330 bp, Homo sapiens
ttggaggacactagtgctatgaggccaattatacaggtcaggaaatggaggctccaggccccagaatagcctcagtcctcttggggaattagacatcccctagaggatcctacgagaagtagcagggactaccctgcccctgcacaaacttgatgtatacctgggaacagaggcatggctcccaggatggagccagctgtcctaccagaggtgctacagcctctcctgactcccaggctgcagttcctcccttaccagcccagaacctctcacaccttaccctacatcttggcacagcagagaaagcccttgttctgtgatcccaaaact

SEQ ID NO: 154167 - DNA, 374 bp, Homo sapiens
tcgtcccagtcacaaggttattagaaccctctgcctccaaggttcaagagattctcccgcctaaggacccggactccaatgtagctgggactacaggcgcccgccaccacgcccggctaattttttgtatttttagtagagacgcggtttcactgtgttagccaggatggtcttgatctcctgacctcatgatccgcccgccttggcctcccaaagtgctgggattacaggcttgagccaccgtgcccggcctaacatttcaccttttagagtgcttttgagttcatgattcaggtgcatgcttcaggtgaagccaccttttaagggaccatgcaggggaaacctttccagattggcttatgaggaaactgaac

SEQ ID NO: 154168 - DNA, 136 bp, Homo sapiens
gagaagatactgatttgcagattcagttgtccttctctaacagactatttatgtaatattgcagttgtgattgtgataggtaagtggaccagtcggttaaaataaatcatattattttccttttgtgaaacctgag

SEQ ID NO: 154169 - DNA, 465 bp, Homo sapiens
ggcagccggccacagagcctggtctcagggtatagcgtagaattgccaatgccactcatgcatccatgggcacacacatgcacactcacacatgcactcgtgtgcacacagacatatgtgcacacatgcatgtacacatgcacatgcattcacatgtacacaatgcactcatgcacaaacacacgtgcacacacacccccctccacctggttcctcgagtccatcgtccttacttctcagggctgcacctgacctctttcacgtgaatgtgtgactctgacctgctggtgcatttcccacccagaggttcacaccaaactccgccctgccctctggagtaccccccaccactggttcctcggttctaaacttgtgtttattttacagaaaatttaatgagtaagcaaagtctgcttttccagcctgtctttctcatcatctatgtgggcttttgcttcttactta

SEQ ID NO: 154170 - DNA, 353 bp, Homo sapiens
cgaggcaatgtgggagttctctgtgctattctaccactttcctgtagccctgaaactatttcaaaatgtaaataatttaagaggcaaaataattcattctgttctactgaaaatcctttcagttcatccggttcaaattactgtctccttgagtttacagctcagttgcaaacatgttcttaggctaaaattccatctaagacctcagtttgagaggctgtttaacttcctatcaaattattttgagatactggtaccaatgtaaatcaaataaaactataccacaggtaaacataagttcctgtgtcaagatgccccatttttatagaatgcactggtaacaattaggagat

SEQ ID NO: 154171 - DNA, 327 bp, Homo sapiens
cctggacccatgtcctcatctgtaatgaggcaataccatgacctttatcatgaggattaaatgagataatccacgtaaaggaaatggctacataattgtcagtgttcagtaaattagagctgttacgatcaatgattagcaatcttgtgaattcaaaactgagcccagaggatagtctttttgccttctgaacaaagcaaatatctctataccagccctcgcatgcacactgcttaacaaagggcattcatagatattcaatgggagttggacagaggggtcagacatcatacaattgcagagctgcacggatgtgggctgaaatca

SEQ ID NO: 154172 - DNA, 166 bp, Homo sapiens
ggagaggagagactgtttgaagagcacatttatagtagaaaaaatagaatgagcaaaaacatggaagagaaaaaataatattcagggtcgagttctagttggctaaaacatggtccatcgggatgaagactggggagacagctggagttagggaagacaggaagtt

SEQ ID NO: 154173 - DNA, 666 bp, Homo sapiens
gtgtcaaattcttcctgaaacagtctcatctttgcctctgtcctgcccagcttctttgctgttatcttgtacactatttcctaagggatacatagcctgcatattagccgagattgtttctcaaatttaaccacttattaaatttaaactctgctcctcctgaactaccaaacatgctggcacagagcaagcactcagagtccctggctgtttgcttaagtagcatgaaataactcctatgttaatccaagggaaaaccagcctgcctgtgcagtgtgggacgggcaaggaagtgctctggtcttcctcttcttccaggtcttccttccaggaagtgctggggaagtgtagtcccaggagggctgcagagctccattgcactgggcatgggccatcctgtcccataacaggttcctagtacttaccagtccctccagctggagcttgggtgctggaataacactgcaaggactcttgatttctgagaccaatctagtttgcttgtttctaagaaatttggattagatattccagcacaaagtgacttttaaaaaatactcatttctattttggccaaaagtgtaaaattcaggcaagttactcaccagagttctgtggagggatgcggacagagctgaccaaggccattctgctcttaccctgatg

SEQ ID NO: 154174 - DNA, 350 bp, Homo sapiens
gcaaatggaaaatgcattatttctaaaagggaaataccaaaagcactggcaggagcaataatggaaacaagagtgaccagatagatgggaaaattatgataggacctaacctaatattcacatgataaaagggtttctcaggctaaaaatgcacacatatgcctatgtatgcagtcactgatttttttcctagttttatttgcttctttctttctcccaatttcctgggaaacaagaaagtttgtgttaactcctgactcaaaccaaaccggactacagtatggtcaagaattagaaacacagacaacactgaagggctgctctcgggataataattgcttgttacgcat

SEQ ID NO: 154175 - DNA, 336 bp, Homo sapiens
gctgcaagcgacaagaacatcaggaaaatgatttaagatcccatcttaaagtagcagtaacaaagaggaaggctataagaactttaaagacaatatcaatgagggaggaagcaataatagtacctgaagacaagaataagttgataaaagtggggaaaaacagaagtcatttttaaaaataatgtactggaatattgtcaaatgttctcataaatacagacagtggaatgtaatactatagagaatagaatatggaatagaaacagtattgaatgttaagcagaatcagcagtgctaaagacacactagcatcctcacactttaattactcaaatg

SEQ ID NO: 154176 - DNA, 507 bp, Homo sapiens
agaggctgataatgggagtgaggaaaatgaaaagagagagcgagggagtggaaggtgtgtgggatcaggccagggagatttatggcgatttgtacctgattgttcatactaaagccattatgggatgattagagaaaaaggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctag

SEQ ID NO: 154177 - DNA, 440 bp, Homo sapiens
atgcaaagtgttaattctagcatggaaatgtaattacattaggtgagatctcagggagacttggtatgttaggctgagaggaatcttggaaatcattgttatgatgtagagcagggagtgatgtcgtgatacagagttggaattgggaagccagttctaagaattgtatcacacctgtagttttgcctacacaaaagactactgctactaatgacaatgataatctctaagtggaatattttatatattggtgctgagcttaatgccttatatttaatacattgtcacatttaaattttctcaaataatgtgacatatgtactaatacattccctttttagagaagtggaaaataatgaatcacctgaaccttcactaaataatgatctcgtctaacacattagagtttttaatgatattgtaattcccatttcacccta

SEQ ID NO: 154178 - DNA, 407 bp, Homo sapiens
gcggttccttagtcacccttggctactgtacttcccccaagattgcatctccatgtttgcatggtcatgatccctggaagatggtgatgaggatgaggtcccagcctcatagaccttttcctctgagttccccccaaggcacaatggaatgatggacccagggtgggccagggatgatctggagatctcaggagaccacaagctgggcttcctgtctactacatgagtatggtgtgagcagaacagtgaaagctgtctatgttggttcaaattctggtgccaacactgatccacttagggaccctcagcctgcccagaaacctcctctgggcctcaattttctcacttgtaaaatgggattatgggagaatgaagtgactttttttgggtcacatgatggatgggat

SEQ ID NO: 154179 - DNA, 397 bp, Homo sapiens
gccctgcagtttcagttccaaccttgtaaaaagtggaatagaaggttccagggcacactagctgcctgttgaatctgacccttgggtttcatgacatcccaaggcagggagagtaggaaggcagagacaataattagctggagacaggttctgccttctgctctcctcccactgagtggcaggaattaaaatgctgagatcatggcaggaagtgagactgaagaccttaagcgcagcacactttaggtttcttccataaatatataaaatatcttgactgaaaacctaaattcagttaggaccaggtgtttctaataaattgactatctctaaaacttggctgggcgtggtgtctcacgcctgtaatcctagcactttgggagcggggagaattgct

SEQ ID NO: 154180 - DNA, 547 bp, Homo sapiens
actgggtggtagtgggtataatactaagttgagatgatatcatttacgggggaaggcgctttgtgaagtaggccttatgtctcttgtcctttcgtacagggaggaatttgaagtagatagaaaccgacctggattactccggtctgaactcagatcacgtaggactttaatcgttgaacaaacgaacctttaatagcggctgcaccatcggcgtgtgacacgccgatgggtgctgttggtcatcaggacaatcctgaagttctcaatggtggcagtgagaatcttgtcccataggtccctgatgggcttgaagtagtgggtgtaagccacaggagggcccaggcccttgcttctggtaccagccatggaccttcacccccagctctcaggtgacctcttccagggcgttcaccttggccaggtaggaggccagataggtggttattgagggtctgcatggtgatcttctcgttgcctaccagcagcccattggacctggccagggcattagcacagctgccactgtaacccccatcgtccccatcat

SEQ ID NO: 154181 - DNA, 174 bp, Homo sapiens
accctccagattcaacctcaacctggcctaaggcccggcgtcagccccacccaccaatcaaagcccaggagggaaacaagcatggcccacatggggcactggagacaagggaggccctgcttcccacgggcgctctcccccactcctcagtgccccatgcatccaccccacaga

SEQ ID NO: 154182 - DNA, 541 bp, Homo sapiens
taccactgtcagagcggatcagagaaatgtctgtgttaccataatggtaactgcagtcatttatatgatatactaactacatatacctaattaacatgcaacacagtaatgatgatgcatataattatctcttgatattaactttctaaatttcatcttagtatgatattaaatgctgatctgatatgttcagactttgatagtttactgctcatgatgacagtaatctgctaacaattttaagcattagaagaaacattcattatacataacagcagatttccagagacaaaagaaagaaacaattagagaaaaatgtgatcaaacatattggccatgacagctggctgtgctttgcattataaataatttaatcaagtccaacataaatgattttggattattcataaattggcattaactattccatagctcttctccattaatatggataaataagggcaaaaacataaacattttttagcaaaataagccattcaagaaactatcataccaagaaaccatactaccacagtaccaa

SEQ ID NO: 154183 - DNA, 424 bp, Homo sapiens
tatctttaagagttagtcgtctttagttctttttcctggtaacactgtttttaagtaatatctctaacctaaaatgttaaaaagaagaggacattggaaactaaaaagtagtgttcgaattttccataaatgctacatgtagttgggtgaactaaggaagttgaaataataagataggctttacacacacacattttagtgtaagtgaaaaactgagatgaaattagaattatgatgaggtctttccatcagtctgaagtaatgtgtgcatgacatcctttgaaatgtttgacttagacctttcatggaaatgagaatatgcttcattttacagagttaatgatttttaaaaggattttaaaaacaagtagaagtgttttataaatcagaataaactgggtttttttcttttgaaatcaagttt

SEQ ID NO: 154184 - DNA, 485 bp, Homo sapiens
cagactgagagtcctttaaaattaactgcctgtttttcccactgtggctagtgagccttatctctccacttcccaggcattgtgaagaccctgtttctctagctgtgcagctgcaaggtcactagacagataatctcaagtcgtaaagcatgttgttccttaaaaagtaagaaatgatgtaatgcatgtcttaactgaataactgtctttgtttcttgcttctgtaatacgcttccccttgcacagatctacccccaccccacgaaatgcttaaaaggtagcttgactttttgttcaaggctcagtcctttgggtgttggtgtcttggcattggggtctgggcattggtgtcttggtgttggggtctgggcattggtgtcttggcgttggggtctgggtgttggcatcttggagttggtgcctcggcattggggtctgggtgttggcgtcttggagttggtgccttggcgttggggtctgggtgt

SEQ ID NO: 154185 - DNA, 282 bp, Homo sapiens
gtcactctaagatccccttgccaaagacctaggtatactctcacctggtcttcttttgctggtgcttctatcatctccttggaaaggactttgttccttgtatgagccatgcccccacactatccctttcccctgctttatttttcttcatagccttcgcccacagctgtcatatttgatatttgtattcactttctactgtccccctcccctgaccccgctgagtgctcacctcattggagcagaacatggctctgccccctgtgcctagagcagggcctg

SEQ ID NO: 154186 - DNA, 127 bp, Homo sapiens
atatacagaccagccctgccacatactcaaggtggattgaatatcaaactatgatgatgatgaaaatagtcactttaaaattcgtgacattggccgggcacggtggctcacgcctataatcccagca

SEQ ID NO: 154187 - DNA, 512 bp, Homo sapiens
gagggggaccctggggtcttccacagtccctcatctccacctgaagagcatcctgacaagttatggtagttttcttattctttcaaatgataccacgcagttcatcagttttctcagaacgattcttggtggagctgcactacactgagttttacagccccactgagatgatctgttgcttgctggagcctgggtggcagattttctagcaggatctgagaagtcaatgagtgaaggcagaactgccctggagaggaggaattctggcagcataagctcagggaattagtttgggaaagaaagtttgtaataacagtgttctagttcctgctgaataaaacattcagagagcttttcttctcccagcagaaaaataaaatactctggaggcaataggatagttgttctttttaaatgttgtttttcataaaactcagatggttgcagtcatctgaccatgacactgttctccctccttctcctgcactgggcatcttgtgggtgtgtgtgag

SEQ ID NO: 154188 - DNA, 386 bp, Homo sapiens
ggtcttttccagtcttctttactcaaaacattcccaaggattcaggaaatttctatcactatctatctatctatctatctatctatctatctatctatctatctatcatctatcatctcagctactcacatttctccagaggttggatttggtgtcactaatgtttagtgtcattgccttaaaatatgaaactcagtgactgaggctgttatcatatcagcctcttgagtagccacagtaaaataataaaaggacaaaacaaacatgggagaaagaatagtatgtctcagccaactttgggcacactgcctgtgagttagccctgtccacgaggagcagcagaaagaaagaaaaagaaaaagaaagaaagaaagaaagaaagaaag

SEQ ID NO: 154189 - DNA, 489 bp, Homo sapiens
agagctctgtcaccagctgagctgtgcttgagtccttgttacccaaaacaatgatcttggttctagaacacatatgggcactgggctccgtgaaggcccacctgcccatgcttgcttggatgcaggaagacgctcacagtaggcgcacctgggagctgctgcctctggatgccacaaggagaagttgctccaccttttgagcagagctgagccaagggccttaatctaggccctggttacaggttggctccgctgaagggatagagagagtaagggcttgaaggtgcctcttcctcaacctcttaggccaagagtgctcaatggcatgccagggcactgcagagttggccagtggccctagccactggatcctacactcctcccctccctcttgtggctttcctcccatcccccttccatcattaagatgatgacgatgggccaggtgtggtggctcacgcctgtaatcctagcactttgcgaggccaa

SEQ ID NO: 154190 - DNA, 234 bp, Homo sapiens
ttagtccaacagtcctagcaagaagagagtgcttggcgccttgaagaggtgaaggtaaagtgaagaatcaaccagcctatgtgattaaaaggaagtcaaccaaacagcccatgcccaccatccccagatacaccccaagccccttcccctacacatacctctcctacaaacccctgctctggtggtgtaggaacctctaaacccaccacacttccccgacacaactccccttcc

SEQ ID NO: 154191 - DNA, 540 bp, Homo sapiens
tcattcttaccttactccataaatacataagtaaaaactgggaaaaggtcaattactagctgttcttaaacaccctttttctcacaaattaaaaatggactgggtggtagcctgcctgagtttcatgggtgcactgtaacgtcaatgttttaagactgagtagtccttcccaggactctgcttgaagtcctccaggctggtactgtttagggcactggctaggcctctcggtggctactcactgccatcaagtaatgcctgaagctaagcatcaactgatgggcagctgtggtcagtgaactccacaccttaaaggttcatggagacgccaaacaagtagctgtgccatttacttccaattacttcttttatttgttaaccagccaggcttcactgactgttagcacccagtttcttgctatggactttggtgaccccagcatagcactagctccagatacttcacattgccatctcctctactttctcacttctctaagatgtatggaacacttgtagctcacccacaactactgaggc

SEQ ID NO: 154192 - DNA, 835 bp, Homo sapiens
gagcaattaaataaaaaagatcagtcatcatcatcaggcttgctgtcccctttccttccaaacacctgaaaaaatgcctttttagagcatattgacatttaagctatgctttatttcattgtgaggaaataattgtatttttccccttttttttttccatgccttctgatttgctggcattttatttattccttaccatggtagaaacccagttgaggcagtattatgtataagttaaaagcagaactctcgagcctgactgcctgggttcaaatcctgccaatgccttttatatctgatcatgagcaggttaacctttctatgacgtagtgtcctcatcgaaaaaaaaaaaaggggggggtgaataatggcagctacttcatttaagtgatttcacattaagttttaggtggcacatagtatgcattataagtgttactatgatggtatcagcctttgctagtgaatcagctgagcttttaaaaaaatgctatagatgcatttgcatgggggtcttgaaggatatgtgaaaaattgctaagataactcatcgtttggtattttttcctttctagatgaatatatgatgttcaccccttgggcttctttctttcctccagagtttagtataacaactttgactcaaagcagttgctgcctccccagagttcatcctatcctcttgtctagtcttagattagctcttctagggaggtggaatgagtttgggctcagaagtgaggcaaacctgctgggttttaacatctgtgtcctgccactttgctagcctaaatatgatttttaatgtatctcagcttcagttttctcacctgtt

SEQ ID NO: 154193 - DNA, 539 bp, Homo sapiens
tcctaagcttcgcctccccatccagcccatctggcaaaagacagagccaaaggctgcctcctgctggcctcatttcaggctttggcttctgggacctggtgtctttgggactggatttgttccttgcagacctggacgaagagctgctgagaagtctccatgtgttgtcagagacccctcctcttcctcaactccctgtgacccctgttgtgcagacttgggggaaaacaagggcacaagaattgtcacccagcaggtggtgtggggctgctaggaggaacagggagtgtctgctactgagttcagggtttctttaattttttgttgttgttgtttgttgttgtttttttttttttgagacagggttttgctctgtcacctagtctggagtgtagtggcgctatctgagctggctgcaaactctgcctcctgggttctctgcggcaattggctgcttttcagaatgcagtgcatctttttctccctgaagatcttgaagcttctgctcaaagtcactttccatctttttcatttccacc

SEQ ID NO: 154194 - DNA, 470 bp, Homo sapiens
taatgaaagatttctcagaagggtgtttataagtgactgacttcactattcattagccctttcttctataaacttaggtgtccagaatggagtcttatgaaagaactaggattccatattctacaagacgtcctagaaatctgatacccttgaccttgtttgctggataactgtgcatgatactttgccaggtgctgtgaatatgaaaatatacttagatgaggttaccattatcaagaactttatatattaggagccagacatatacatttgaaaataccctcataaatagtcattacaaagcaataagtgcaatagagttcaaagaaagaccattattgactgaattgatcaggtaacactttgtcaaggaagtcgtcatttgaaggattggtatgcatggaccagaagaagtgagtaagaagaaatgcagatgtagcattagcaaagtcaacataatgggaaatgta

SEQ ID NO: 154195 - DNA, 327 bp, Homo sapiens
ctagtgtcttgaccagggagaaagaagcatatccccaggaaggctgttggagaaggtggatgggacccacctgatggggagcttggagtccgagcggtcccatcacagcgctcagagtgtgatgcacaggaggttggtgcctcccctcctggccctgagtccatccctcatccctccccagagagctcttctcagaagtgccctgattggggcctgacgccatttcccttgggattcctgagtttgatctcttgtggaggactgaaataaacctgttgagttggggcaacttggaaatttccttctcctcctccttcttctttctct

SEQ ID NO: 154196 - DNA, 178 bp, Homo sapiens
cgtctcttgaggatccccgcacgctctctctgtgggtggggcgagcagcatgtctgtgacttcaacacgttccatctgaaaggatttcacatcagagaggaggagctgaatcagaggagagcatgctttttttttttgagacggagttccccttgcacaggctggagtgcagtctccg

SEQ ID NO: 154197 - DNA, 542 bp, Homo sapiens
cagaagaaaatcaaaatgagagggcccagttaggggcagaaggagagcagttagaatttgccgaaggtgtgggggctggaagaggtaaggtgatgtgtaggggctggatgtcctgggccaggatatcgggaggctttactcttccccactcccactaaccggaggtcccgagaggaacggggtctgggctgctccctgccacctgtcagcaggtcaagccttccaccggaaactgccccttattcaagaatttagcttctctcaaaaactccgaaaccccttttctctctctctctctctctctcttttttttttttttttttcaatgctcctggccttggacccagcacccaaagacatggattagccctatccactaggacagagcattgcagacccactaagccttggagagagaaaaggatcttgttcattcttagtccccagaatgaccaagacaaaccccgttagccaaacccctaaaaaactgtttggcttaggttagattagctccaagtgtttgaccttgaaggggaacaccc

SEQ ID NO: 154198 - DNA, 305 bp, Homo sapiens
gataactggattaagagaaatcacatgggaaaggcatttgttccttgaagtatctgtagattcagggggttgggagggcccctgtatagagataggaagggggagggaaatgagaaagaatgtctgcttccgttattaaatcatccttccaagggattgaaatatatatgcaggtgatacagcaaatttttttaattgaatgtaagatatttaattattatgacatttctttaatgtcatttaacaatccgttgtggcaaaaatctaataggaataaagcctgtgatcattacagatcaactttt

SEQ ID NO: 154199 - DNA, 562 bp, Homo sapiens
gggaggtagaggttgcagtgagccgagatcgcaccagtgcactccagcctggcaacagagcgagactccgtctcaaaaaaaaaaagccttaagttcttgccttcggggaactcaatttgagtgtgagagaccggcaggggacgcttactgtggtgtgaccagtaatgatgagaaacagcagtactcaggctcactgtgagggatacccagggcacactagagaaaacttaccagagggaagagaggatgggttttgaagaatgtgtaggagtggatcaggtcatgggaggggcagcataggcctgttcagattgaactgaaattgggctctttgtcactgacagctggttcttgtttgtcctccccatttacatagagtgagtctgctgtcctttccaaagcttatcaaatgtttatacatagttgtcatgttccccctacatttcttcctgaggccgaggatgatatgtgatatgggggagataattttggataagaggtaagcagggtggagaaagaaaattcagtttagataaagatttaattcatgacttaagctgag

SEQ ID NO: 154200 - DNA, 564 bp, Homo sapiens
tatgtgcatttctaatctatgatacaatgtgaaaataaagtcttactcaaagcttttgagtaatgtaaatcatccaataccctattactcaatgatcctctatccatgtatataatattcaggcctagggattatttgccaaaaggaatagaattatatgaaagtatttttcaaaactatgtgtttggctattaacactattaaaatacttatgagggctagttacatatcaggactatgaagagaaaatctcacatcatatgatattatgtaatttcctagcaaggtcagaagacacacacagtgccagattcttgagtctgaattaagaaagcaaaattaatatcttttattttgtgtataacaggcatttttgtatatagtagacaattttacatgcagttacagaataagtataactcactatagtttacataaacattaccctaatattcacataatcaaagaaaggaaagaatctgctagattaacctgaacaatattaccatacctcttctggatacttataataggattccacaggatatccaaacttccatttta

SEQ ID NO: 154201 - DNA, 204 bp, Homo sapiens
taagttaatttacagttacaaaaaaggaaaagcactatttatgctatcacaagaagcactacccatatcccttctctctcactttctctcactctcttttctctctcatctaagtgattttgcttttgttttctaaggaagtctttcctcagaagctgcctttccattagggatttcccattctgtttcttcgtatcttgtgtt

SEQ ID NO: 154202 - DNA, 436 bp, Homo sapiens
gaactgtgggtagttctatcaaattatggaacttgaggaggctgttgtacaggacccaggtctagatgcagttgctgagaagtacaggtggcccctggggctttgagtggcatctgctgagtggggctgtgttgggtgagccaggaactcatggagtctctgctaactctgggtggcttctgaattgagtggttgcatgactgcttagtgctggagaattcgctggtgttcagcaagcaccacacatttggtgtcagaaaaaaagacagcataggtcagaaccttccactgactcacagtgagcgagtggtctttggtgggcattgagaccccggtggaaggactgtgtccacactgtggggaggggccagcagggtgtgtgtggaagtcccagaagtaattttctggctgctcacatttccctcacacactacct

SEQ ID NO: 154203 - DNA, 551 bp, Homo sapiens
ttctgggattacaggcctgagctagcatgcccagcgaacagtaattttcttaagaaacggaatcagccacctggattcagtagtcttgtgaataccaacttcagagattaaaaggaaataggcggtattaaataccactttcgttttctaaattcataatgaaaagcatttggggaaaattgtgctaagaggatgataaatgcttccctagacttaatccaaatctacattttaacaagatcccctatgatatcatatgtacattaaggtgtaagaagcattgctctagagttaggcaaatactgtatccattcagcagctctgctataccttggctggcatctcttgattatcttcaccttttttttccttgtggtcacaggatggctgctgcagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggg

SEQ ID NO: 154204 - DNA, 143 bp, Homo sapiens
ttttgtatggccctatgggctaagaatgttctttacattttaaaacggctttgaaaaatcaaaagaaaaatcaaattttgtggcacatgaaaattacatgaaattcaaatcttggtgccaataaataaagttgtactgaaaca

SEQ ID NO: 154205 - DNA, 606 bp, Homo sapiens
ttgttttttattttttttgttttgttttgtttgtaacagtcttgctctgtcatccaagaggggcatgatattggtgcactgcaacctccacctcctgggttcaagtgattctcgtgcctcagcctcccgagtagctgggactatgggcgtgcaccaccacacctggctaatttttgtatttagtagagatggagtttcatcatgttgcccaggctgctctcgaactcctgagctcaagcaatctacccacctccacctcccaaagtgctaagattacaggcatgagccaccatgacagcaaagctgggtatttcttaaattggttcagtcaggtgcaataaattatttgccctactctaaaatttaaaaatcttctaagaattatggttttgcagctgaggtttttttaagactcgagctccctggactcctacatatatccttagaacaacattgtccaatagaagtacaatgtgagccacatgttttgtttaacccagcatatccaaaatattaccccctttgcatgtgcttaatataaaaatttaagatgatttatattccaggttttcaatattcagtgagtaattttacacttagagcaag

SEQ ID NO: 154206 - DNA, 466 bp, Homo sapiens
ccaaacggctgctaaagttcagtcttcaggcatcggaacaagggttaagtataccatctaaataatcccgcactactaaataatctccaaggcaggagtctaggtactgcaaagaccaagttcacagatcaccgaagggaacccttaactcacaaatagtccctgaaactgtggtgtaaaacaggggttccaaaattcagctgcatttcagtatggtctgcagcagcttctaaaaaatcagcatctcgtggctgggtgtggtggctcacacctgtaatcccagcactttgggaggccgaggctggcggatcacttgaggtcaagagttcaagaccagcctggccaatattgtgaaaccccgcctctattaaaaatacaaaaattagccaggcatggtggcgggtgcctgtaatcccagctacttgggaggctgaggcagggagaactgcttgaacctgggaggcag

SEQ ID NO: 154207 - DNA, 547 bp, Homo sapiens
tgtgtgtgtgtctattaattacaaatggatcactctgcagaagtactgtgaagaaaacaaaggaattactacaaaaccaaaaaaattatacaaggaatatttttacaatttgttcttgaatattcaaatttttaagaatcagatatgctcaaatggcaactgatgaggcaccttcaagagtaagtatgcaaaaagaaatgtatagccaggttctgaaaaaagaacaaaaactcaagactgaaaagatgacaatttgaaaacaacttcaaagcttatagtcaaggcaaagtgtattaaaaaaaagaaagggaaaacatcagatcttattaatggtgggaaagacacacaaccaacctaagatgtagtctacagattttatttatttatttattttgagacggagtctccctctgtcacccaggctggagtgcagtggtgcggtatctactcactgcaacctccgcctcctgggttcaagcaattctcctgcctcagcctcccgagtagatgaaattacaggtgcacgccaccatgcccagctaatttt

SEQ ID NO: 154208 - DNA, 573 bp, Homo sapiens
tcgcgaaagtgtatccctaaaaactaatattaaagatagaagagaatcattaaacaaaatccaatcccaaagaaggcaggaaaagagaagaaagggaatgaagaacaaaggggacaaatagaaaattagtagcaggatgttcattttaaaatcaaacttagcattaatcacactaaatgtaaatggtctaaaatgccaattaaaaggcagaggttgtcagaatgaattttaaaaagcaagacccaacagataggtaaagacacatacaggtttaaaagtaaaaggacaggaaaagatacaaattgcaaatactaatcaaaaggaatctagagtggctatattagtatcaaataaagtagacttcaacaaaagaaacattaccagagataaagggggatatttcaaagtgataaaggcagtatttcatcgaaggatgtaataatcctaaatgtatacacatctaaaaacagagcttcaaaatacatgaagcaaaaaccaatataactttatccaggctagctatatccacaattatagtggagatatagttagcctggataacacgtcgccgaa

SEQ ID NO: 154209 - DNA, 625 bp, Homo sapiens
  misc_feature (584)..(584): n is a, c, g, or t
tgccactttcagcttcctgacttgaaatgtctccccgcaaataagtattattactccaccgcaggcctgaggagaaaaaggtgaatgagcctcttcccagtcctgaagctaatcagtctaatgaactggtaatgacaacatattcttatccttctgggccacttctattagcctcatatactgctgagagagtcgaaagtgctgagctaagtcagggaaggtaagagcaggcaggtgactgctaagacacttctgttctacctgtctgacacctgatatcctgcagggacgaaaggccatatttatggatggtgaaggcagtggaaactgtactgacctgggagtcagaaaccctaagtccaagtcctagttctgccactaatatgctgtgatcttaagaaagttactcttctctctgggcctcagtttcctcatctatgtaagtaagggctgagctggtcaatctattaagatcccttacaggccaggcatggtggctcatgcctgtaaacccagcacttcgggaggctgaggcaggtggatcgcctgagcctgggaaatcaaggctacagtgagccattatngcactactgcactccagcctgggcaatggagaccctatctc

SEQ ID NO: 154210 - DNA, 495 bp, Homo sapiens
ctattagcctcatatactgctgagagagtcgaaagtgctgagctaagtcagggaaggtaagagcaggcaggtgactgctaagacacttctgttctacctgtctgacacctgatatcctgcagggacgaaaggccatatttatggatggtgaaggcagtggaaactgtactgacctgggagtcagaaaccctaagtccaagtcctagttctgccactaatatgctgtgatcttaagaaagttactcttctctctgggcctcagtttcctcatctatgtaagtaagggctgagctggtcaatctattaagatcccttacaggccaggcatggtggctcatgcctgtaaacccagcacttcgggaggctgaggcaggtggatcgcctgaggtcaggagttcaagaccagcctggccaacatggtgaaactccatctctactaaaaatatgaaaaattagccaggtgtggtgatgggtgcaatctctgcctcccagcta

SEQ ID NO: 154211 - DNA, 420 bp, Homo sapiens
ttggggagttggggggggtttattccgggtccatctcacacaaagtcacacactctcactggcacatgcgggcacaaagaatcacgctgacacacactggcatgctgcacctccctcaatcaaacagacacaggcgtccccatacaaagaatcttgccctcactcacagacaccttgaggcacccggccacacccgaacacatcgatgcggcattacacactcagggacgtgcatgtgggtgcagacacacgggacacgcgcagtcacacgatcacatgccatgaagcacacagcacagacacaggctctgccaccgtcaaatgcagccccacaggcacagctagaaacacacagcacacacactcagtcataatgtcagtgcccaaaacacacacatgagcaccgatacacccgcacat

SEQ ID NO: 154212 - DNA, 450 bp, Homo sapiens
ttttttcgttttctttgtttcttttttgagacagtttcactcttgttgcccaggctggagtgcaatggcgtgatctcggctcaccatagcctccaccccccgagtttaagggattctcctgcttcagcctcccaagtagctgggattacaggcaagtgctaccacgcccagctaattttgtatttttagtagagacggggtttctccatgttggccaggctgatctcgaactctcgacctcaggtgatccgcaggcctcggcctctcaaagtgctgggattacaggcttgagccaccacttccggcctcctatcccaagcttatccccatctcttatgtcaaatgaataacatcattggtcctgatgcccaagctagaaatttgagtgattttatttttattgttttttgagatggagtctcactctgtcacccaggctggagtgaagtg

SEQ ID NO: 154213 - DNA, 387 bp, Homo sapiens
tggggcatggaaaccaagttgctagtggggtggtaactatggcatttttctcaagagttctatacctagggaagattcgttccctaacatgagactttaaaaaagggctgattacctggactcaaatttattttcatttgtaggttttttttaactactataatacagaccccaatagaatattaactttggtatattgtgaattgaactttcacattttcattacaagacagaatacctgaaacatatttgataggagtctgggggtgaagagttaagaaaatgaaagatatatttgaaccaaattgccatttttataggccttttggttgccttttggcaatttcatatgtttcatcctaaaatgaccacttagggctcagtgtt

SEQ ID NO: 154214 - DNA, 575 bp, Homo sapiens
caaccaaactgtttttattttgaccatatcttttaaactcagaatgcagttagattctaaaaggaaaagggatagacttattcttaaatctatggtattaaaatcttaaagcctttacttgctgcatttctacccctcagttttgttaactattttcttttgtactcagtagatgaacatttaacttgatcaatagtattttatgtagaacttgagaaatttactcaaatggaagcaaagtttaaggtagtgaattgaaaagagaccagtgtggactctggagcctgactgcccatgtttaaatctcttgatgtgtaatcttggacaaatttgtctaacatttttgtgcaaagtgaaggtaacaataatagtacttacctgataaaattattaagaaaattaaataagtatatgtgtaaagcacttagaatagttcctcatatacaactcagtaaataatagctgttacctcatcatcatcactattatcattatccagaacattccctggataggatttatttggttttgcaatatatttctgtaacattaggaaagtgtttatcaaaaaagaa

SEQ ID NO: 154215 - DNA, 248 bp, Homo sapiens
aggggctcagagtctttccagtctccactggggagggaagaaatgggaaatgagataattgggtccaaatcacagtcccagcaaaaactcactgcaggttatcaaatttgaactcaaagaccgagacctgccaatatagggacagagaatgttgaggtcacttagcctaaccttccacacaaagccctgatcgtgtctgcagtaatccagatggatatttctctagctgctgtttgcacatttccaac

SEQ ID NO: 154216 - DNA, 671 bp, Homo sapiens
atagaaattaaggtcaggaccttaaagggaatcttgcccattgatattagtcctgccctaaaaaaagtcggacatggtatgtttactactaatcattttttttccataacgttaatggtattttgtattttcccatgggcacctacattacacttatagactattttgatatttcaacctattattttctttgaatccttttaaggagttgttaaacaatgctgaaatttgccttacagtatgctgttaactaatcatatttctcaaagtcatttgacataatgtttggttaaaggaaatatgtctagcatagttatacccgttcataacaaaagagtatttaaatctttaagaaaaaatattagaaaagctaataatatgaataaataaatatatgaagtatataattcattattaatatatgtgcatgaaatcatggtcatagaatttaaaagtaataatttttgaattaaggatacattctgaactataatagaaaaaggcttcaaaaatgttaggtttataatgtttcatatagatacgaaagtgtaaaaattagtctgatgttacttattttggaaagcatatgaagcaatgggaattttcatacattgctcctagaattgtaaatcagagcaattactttgtctgactatggcattatctgatta

SEQ ID NO: 154217 - DNA, 661 bp, Homo sapiens
ggcactttttaaaaatgtttatatgaggaaacaaagaagacttgctgtgatccagcgacatgcccagtgagtggaagagaagaaactggaattaagctattctgtgtgccacttaggtcaggccctccactacatggtcctgcttctcttgcatgagttagctactcatatcatgagagcatccctttcttaattttctgcgctagtggagcagagccatgtatgtgctatggcccatatgttgaaacttgtttatctacagctagccagatggtctgtaacagcacacaaagaagccatttggaaactttcagagggtcagcacgttttgaaaacaactcagagtaatgcatattgtgatgtcattgcttactttaagcttacagtgaggaatatcttgttaggtactgaatgtgaaacatgcagactttgagaaccaactcagaggtcctagcccccagagacagaaatttatttaattggatcaccctttagacttgttttgtctacatgttctctgaaaaaggaatataatgtcttaatttaaaatactttgttttttaagttgctgctgggttaaatacatttttttttaaagaaaacctgcttatgcagtacatgttaacagatatgatgtggtcatcaataaaaatgtaaaata

SEQ ID NO: 154218 - DNA, 651 bp, Homo sapiens
gtatgcattatactatatatatacataatattaggatcagctgttaaagttttcaaacatctgaatagttaataaaagacctggctaacatatgaagtgttggacttcactagtaatccaagaaacatgaattaaaacaagatgatttatcacctgtctaactaacaaagatctctaacttttaagtacccaacatggctaaatgaaaaggttaaggaacaggaatgggaaactggtaaacttttccctagagcgatttggatctagcaaacattttaaaagtgcattctttataccagcaactccaaggaaattgatttatgtttgtgtgtatgtatgtatttttgtggattttcatcacattatttgtaacagaaaagtccaaaatattgtgtccagcaatgagaaattgtgaaagtatggttcctctataaagcaataatttacaaccattaaaaagagggtgggctgggcgcagtggctcatgtctttaatcccagcattttgggaagccaaggtaggaggattgcttgaggtcaggagttcaagaccagcccggacaacacagggagactccatctctacaaaaaatttaaaaaattagccaggcatggtggtgcatacttgtagtcccagctacttggaaggctg

SEQ ID NO: 154219 - DNA, 459 bp, Homo sapiens
ttatcagttcaaaaaacttaaaaacccaatagaggcaaaagaggatgccagtttgcaatccctgaagtagagagagctcgtgctggggagaagtctgccaagacgctttgaggtgggatgtttaaaagttctgtttcccagagcttggctgggctgggggaggatccctgcagctgaggaggaggaaaagccactaagtcccctcccagagcgggacaaaccagagaccctttgcagttgctgggtcaccagcaggggtggtgtggaatacaaacagtacagctctccgcctgccagggagaggaatggtgtcttcaaagcaaacaatgaggaagtgagggtggagccagggatgcttttgctaatgaaagtgcccctcaggaaaggtgccacaggctgttagctcttcaaaccagcagctcttggcccagtgccagacccagcagggcccgaccaaag

SEQ ID NO: 154220 - DNA, 328 bp, Homo sapiens
aaaaaaaacaaacaaacatgctggatggtgagcaaaccaatctgtgaaggaaatgaaaatggaaatggaggcaatcgccccatgtgagctgtcagagtgcagctggaggagcaggaaacagcgtattcgttaggagatctgggaatctggggccacgcctaagtctgcccatctgcaaagaccccttgtccagaaggtgtggaccacggagattgtgatgttaatttcactgaactggtgccacagggtgcctgatgcaacaccgttcctgggcgtgtctgtgagggtgctcgagatgacattaggattaggacagtgggttcaggaa

SEQ ID NO: 154221 - DNA, 192 bp, Homo sapiens
gggtgacagagatttcatcccccccaaaaacacacacaaaaaaacaaaaaaaacaaaactcaaataacagcacccccgtggccccaggctcctttccatctcaattggagccctgtcttcctgtgggggatgtactgtgatttatccagggctgcagtgcaggtggtcagtggttcgcatggacggtgagag

SEQ ID NO: 154222 - DNA, 229 bp, Homo sapiens
cttgggaggctgaagcaggaaaatcacgtgaactgggaggtggaagttgcagtgagccaagatcacgccactgcactccagcctgggtgacagtgaagctctgtcctgtcacaaaacaaaacattgaccacagacctctgaggtggtggatgtccctcctgtcctggttgtatcattatacattgtatattaatgtatcgaaatactacaggtacccccaacatgtgta

SEQ ID NO: 154223 - DNA, 293 bp, Homo sapiens
ggaacagcacactgccgagctgggagggattttagaagtcatgcaaggcagtttaccctcagccctgctcccatgagcccaaggacagggagtccctacctccccagcagccattccatatctaagtggctcttccagggagaaggttctggagctggtatggcatcagagttgtaaggagtcttagtactcgtcttatgcttcttgatagaggggaccttgaggctcagaagggacacctgccttcctgaagtcacacggggagtcatcctgagtgccacagcaggctctta

SEQ ID NO: 154224 - DNA, 402 bp, Homo sapiens
tgtgcactgtgatgggttttagggattcagtagtgaacgttgtcttcaataagtttacaatttaatggattaaatttctcttaagagaaaagatcactaagaaagtggaataattatcctaaagccattttatgttccaaaaaagcctgctttttggtacatttgagatacacttaaacagctctacttctctagtattgcacgttagaaatcattccagaaaatgtagtcagtggccttggtctgtgggtaaggcttgtcctgtaaaggccactagcaaagaaaatgctttctcccttgctttcctgagccatctaggccttcattatatctacctccccaatttgccctagctccctgatggtggggatgcctgttcaacacccaccccttccaagcata

SEQ ID NO: 154225 - DNA, 153 bp, Homo sapiens
tacttttttacttatcctttttctcctttcttaatatttctgtcactagagctgcccagtacttccccagtcctctgagagcaacatgttttattccccactgaaaccagtgtttcctcaagttatccttaactttgcttccaaagatatttt

SEQ ID NO: 154226 - DNA, 509 bp, Homo sapiens
gcctttgtcgaggtcttaggtgctaaaattcagccaactgtttctcagattctgcttttagcatgtgacgacggggagggggaagaggggtaaaaccaccaaggaagaacaaaacacactcatcaaattgttccagaatctttcttagaagctgagagggattggagcttcacagattattcaagggtaaaagggcaaggtttagaatgcttcccaaatttagaagtcttactccagaccgttccagatgaacggctttctaggttttaccagtctccaagaaaggcgattctctcatctgccctggcaatgaactctcactgtttgatagctttgtgtgaaagttccttcttatatctaacttaaatcccaggagcttatttaaactcatttcctcctcgactgctagtggatattcaaaggagttggccttgatctttgaagcaatccttcatactaaataatatgaaggacttttctgtaattgttagaagaaaaagaaaggaata

SEQ ID NO: 154227 - DNA, 240 bp, Homo sapiens
agatgtatagcagggttacttggggccccctccattgcaacgtttttattttccctgcatgattattgctgcccccgggaactcttcttgaggtcctccaaagaaatcccacagaagtgaaccccaccaggatgtgatgcatttcccatccgcaggagctggctgagagcacgcacttgctgcagccaccagggggagctacaggtttctctttggagccccagaactcagtggcctgag

SEQ ID NO: 154228 - DNA, 298 bp, Homo sapiens
tcaagatcacaccactgcactccagcgtgggtgagacagcaagactccatctcaaaaaaaaaaaaaaaaaaagcacacacacaaagaggagccaggtgaggttcccaacctcaagaaatccttggtgctatgactctcacagtggtgtgaccctcacagtggattctcagtaaacagatactggtcccacagttgaatgtggggatcactgaggaaccaaaatcgaagtcatcagccaatgagaaggctttgaatgcgtctcacagtgagactcaagaccttctgtaacctacctggg

SEQ ID NO: 154229 - DNA, 408 bp, Homo sapiens
gataggccagaatgactctggaagtataactcggaccctgatagagtgtaaacctggaaatctgcactcacaatgtgcctaagctcatagttctcaaacttcagcacacattagaaccatctggagagcttgttaagacatagattgttggttctcactcccagagtttctgattgaggggtctgagggaagacccaagaatctgcatttcaaacaagttcccaaggaatgccgatgctgccggttctgagaccacactttgagaaccactgacgtaaccaaagtctttttttttgagacactgtctcagtccgacacccaggctggtgtgcagtggcacaatcatggctcactgccacgctgacctcctggactcaagcaatcctctcacctcagcctttcaagcag

SEQ ID NO: 154230 - DNA, 296 bp, Homo sapiens
acttcttggagctaggggctagggtctaggggcttcttgaaggtgttgatgtctctggtaacttacactgcagggcaggtctctggagggaactttgaacaggttaagcctcaaatgcaggcagagatttccaattgggaaagttaggtgaacgtggctttatcatctcttttattggtttatgggtattttctctttttcctgttttctttcccaccatttaacattatctgttctctgcctttttaaccttctggctttaaatgaacagttgcttaatctatagattaacagga

SEQ ID NO: 154231 - DNA, 443 bp, Homo sapiens
ctgcaggctctatgccgttcgcacccaggagtacagtcgtctttgcccccctctcccgggatggaggctgtagattgtgtcagcggcaggcaccccctccctacggggcagctcatggcccagggtgccttcccacctgtagaggactttcctacagaggaatcctgatgatcacgcagggctgggctcccaccccctatcaggaaccggagaccaaggaggacctaggcagagagctgggaagccccacgggggatgtgagggagaggaggagggaggggctttcatcacttcccctgtgctcagagcccccagaaccggggatccagagctcggggcgccttctccaaacttccccagtcctgatgggagtccccaaaccatcttcttggggctagatggcctccccaagtctagggggttcaggctatgagacacggggc

SEQ ID NO: 154232 - DNA, 222 bp, Homo sapiens
cagccggagctcctgtctgctgggcgactgtatgccggtctagaaaggccagaagagttactgcacttgaggggcaagggatctgggataaatataacaacttccatgagtccttcattgagggctgcccacagcatttattaactccttggcacatcttgctgtaggcacaaccacatggattccagaagccagagagtgaccttgggcaaaaaataagtt

SEQ ID NO: 154233 - DNA, 558 bp, Homo sapiens
tgggctcaagtgatcctctccactcagcctcatgagtagctgggactacaggcatactccaccgcacctgggtttttgtttgtgtttgtacagacagggtctcactatgttgtgttccctggctggtcttgaactcttggcctcaagcgatccttctgtggcctcccaaagtgttgggattacaggcgtgagccaccatgtccagcctgtgtgtgtgtactaatagctacctagataaaaatacttaacagcaattacctctagattacctcagcaccattgacaatcagcccgaagactttgtggtggggctgtcctgtgtgttgtagggtgttagcagtatccctgggtgcagtagtgtaacaatcaaaaatgtgtttggtagcacaaaagtacaactatagttaacaacaatttattgtatattttagagtaactaacatagtgaaattagaatgttcctaacacacaaaaaagatacatacctgagggtatgaatatctgtcaccctgatttgattattatttattatatgtttatatcaaaatatcacatgta

SEQ ID NO: 154234 - DNA, 391 bp, Homo sapiens
cactgattctgggccaggccagacacccagctggacccaggagatactgaggtgagtaaagccaaaatgcctccattcagcaggaggcgggcagtcacaccaaagtgataaaggcacaaaatgcagaggcagcagaggagcaatgactaccttgttccaggactctgtgacctcagggagagctttcagaggaggacatctgtgcaaggcttggaaggatgaacacaaatttgcctagcagaaaagggagccaagcaaatcctgatggagaacagcttgggtgagagtgtgagccacaggattgaggggctcaggcatgtaactggaggagcagaaagaatgaggggagataaagttgggaggtcagcagaggtcagtcacagaaggtttt

SEQ ID NO: 154235 - DNA, 477 bp, Homo sapiens
atccattttgtgctgttataatagaatgccacaaactagatcatttgtaaacagaagaaattatttagcttgcagttctggaggctgggaagtcaaagattgtgagccttcatctggtgagggccttcttgctgcatcacaacatggtggaaggcatcccagggctagagagcatgctcaagagcaaaaggggaacaaattcacttctataaccaaaccactccctcaataactaacacactcctttgataacaacattaatccattcatgagggtagagttcccattacctaatcacctcttaaaagtcctaccttttaacatagtactgttgtattggggattaagtttccaatatatggccgggcatggtggctcacgtctataatcccagcactttgtggggccggggtggctcacatctataatcccagcacgccaaggcaggtggatcactcctgaggttgggagttccag

SEQ ID NO: 154236 - DNA, 694 bp, Homo sapiens
catttcttccccacccccttaagatggggcctcaatttaattttaccatatagattcatgttgggcttctgcttgagtcatttgtgtattttaccttattttaaaaatatttccatagttttgcagaaaatgctgctctttttgaaatttataaaccttaaacttagtgaaaattttgtgatattaggtatttatattgcatattttgaagtttatttgtaggtgtaagtttctagatgaaaatctagtcagttcatgaaatctaaatttttaatcaaagtctccactgccgatttgatttatttttagcaaatttcaaataggagttttctgggaaattgaagtttcagaaagagaaatgtttcctgattgaaaatttcatgctctggaaagttgaaattttggaaagagaaatattttctgattgaagatttcatgctcttaactaggttcagatgatatggggattattttttctgcaccattgaatagtaataatgaaatgatttatttgattatttccattaacctcaaattgtcaatagtttttttttttttctgtcccatctcttcatagaatcctttaaaaatattaggtgaataattacataaaaatgaaatgatgtcagtagaatgttatctctgaatggaatacatctttccagtgaaacacaatttgtgagattaaaagtac

SEQ ID NO: 154237 - DNA, 160 bp, Homo sapiens
aagattttgaaagtgtagagtttgggcttaaatcaaaggtactggggagccagagaagatgtttgggtagggagaggcctgattagccctcaaaatgtggtcttcagacctacagatagcctgagacctgctgaatctgaatgtgtattttaataagatg

SEQ ID NO: 154238 - DNA, 210 bp, Homo sapiens
gcatacctggaccttctgaggtccaggtgctgtcccctgcttattctgcctcccacctgccccttctcacctgaggctcttctgccctggtgagaaggtccaggtatgccggcatactggagaaaggcttgggtagctatgctactattaaacaaaataggctctaaaattggaagctttattagtaataaagagcatcacttcatattg

SEQ ID NO: 154239 - DNA, 267 bp, Homo sapiens
gcccctactcaagatggagttgctctggtttacctgcctctgaaacctataacatttgagaactttgtcttttatttcaataatatcagcaaataatatgttagactatctattatgtaggaaattttgtgatatagtaatatatttatgcttttaaagtgatttaatcataaaagtacaattttacatcagattatgcaacttagatataaatatcaatccaaagtcaacaaagatcaattgtaattgcttgagtaacaattttta

SEQ ID NO: 154240 - DNA, 856 bp, Homo sapiens
cccggttctggtgggctccaccctcacgttgttctgaggggacttaaggctgggaggccctcatgggtcaggaggagctgctggcaaaacctgatagttgctaagctgatctgaacttagcttgcaaggagcagcagcccagaggccttcccagcaacagcatcgaagctgtcgccagggccgcctaggggatgtaggatgggccacagccatgtgccttctgagttttctcctgcaaactgtgcctttgcctctctttagtaaaaaatggaaacaactgcatctctctaccttctaaccccacggaacctccaagggctaggggcgccaaactgagcaaataaaaatagagaacgtctagttaaacttcaatttcatataaacagtgaacaattttttaatataagtatgccctgagcagtgtttggcacacactgaaattcagagttcactgattcttctgtatttatctggtaatcctccaggggtgagttctgagtggggtgaagtggaattcagacccaggcttgagctctaggttaccctttgctccccgaggttacagatgacaagaatgtggccttaaatgtaatgtgttatttgaaattaaagtatacgcacacacaccctacacacacatgcctgtacacacataccctacgcacacatgcctgtacacacgcaccctacgcacacatgcctgtacacacgcaccctacgcacacatgcctatacacacacacccgacagatacatatacacacaccctacacacacatgcctgtatacacacaccctacgcacacatgccttgtatacacacaccctacgcacacatgcctctatacacacaccc

SEQ ID NO: 154241 - DNA, 808 bp, Homo sapiens
ccagaattctccaatacttaacttccctgtgtacatgaccccctgggtttcagagggcacagggtcaaaggtcttgtccctcccttaatccttgcagctcactccgccctttctgctctcatctgtttccctgtcctagcttgaacaaggctgacctcttcagaaatatttcctaagccccactgtgccttgctctattgcacttcagacccccttacctccaatccttgtgtcctggcttcacaaacctcttgagtggaggaaaacattacctacttgagagtttctggctcaagtgacactgtaagttcatactatctaaccttccttggcccttacttcatcccagtccttttaagttcttaagttttcagtctgcagcaagttccactgcacctaacacatcccactattttggagctcttgcgctccctctggggatgaactagcactgagactgtactgtacgccactggggccttcaaatgccctcttcaagtattagaaacatatgggctaggcatggtggctcatgcctgtaatcctagcactttgggatgctgaggtgggaggatcatttgagctcgggaattcaagattagccagggcagcatagtgagatgccatctctaccaaaaatacaaaaatacaccatgggcatggtggcacatgcctgtagtcccagctactcaggaggccaagaggatcgcttgagcctgggaggcagaggtttcagtaagctgagatcataccactgcactccaacctagggaccctgtctcaaaaaggcagtccaaagctcaggtca

SEQ ID NO: 154242 - DNA, 231 bp, Homo sapiens
catgcgagtttgacgggacacagctcaatccacagcacccatccaggcagagtcctgcccggtcatgttccccatccccaccaagctgcagtcctggccaggctggagccctcagccccaggaaaggagaccctcgatttcccaggctcccagggccagccaggggcttcttttgtaagtgtttcctggaaggcttttcagtgttctcctctccccatctggactagccaa

SEQ ID NO: 154243 - DNA, 1224 bp, Homo sapiens
cgctgtcgtctcaccccgttatctgccctcgctctgaggtgccttcccggaaggaacgtcccacaacattcccataagtctcattggcccagtctcgatcacgcgggcagctgtgaggagtaaagtcgtcctcgctgggcacattgcttccctgaatagaaatgaggttccgttactaaggaaggaaagggatataaatgctggtgagtcatcagcgcagattgggggatgctgaggtaagtttattcatgttgaggtggaagtttctgtgaggacattttgggaacactgttcagcctgcagtctggggtccctcagaaatggactgattagaggtctgggactgggtagataaaagaggaacctggagcattttgttatgctggaaaatgagaacgtgccagggaaatgattgagcaccatcaaagtcaagcaacctccaccaaccttgtctgggattgtttcacaccaacataattaagcatggtaatgagttataagccattgagagaccagagaggccaggaatccaggggtcagtactgacagcaatagatagataatttcattgcagaagagaaggtgcttgcttcaataagatgcataagccatcagtcagtgtggagggactagggcaagaaagtcagcatttcccagccttcgtgggacagatgggaccggcagatgctatgcggggcagggtggagcagggatgcaggggttctggagaggagagtttgcaagtcaataactacagtggagaagtcagacctccctttggccaggtaacctgagtgaacaccccacccactgagggctgtggatgttgtgtgcctgcaggtggaacacatgtgtgtccagctgggtgtgcacacatgagttaatcaggagatgtcaggggaggaaaaaggctgtggaaatgtcctagattaaagaggacaggacccccaagatgcaggaaggactctggactggaccctgttccgtaaatcatcataagttatttccttgtccttaggaaataactcaggacaaagggccaagatgaatgcaacctattcttaaatgattcagagaaaatactatgttattatatattatacatacagcatacatatagagtgagagagctgtgtacagacacacagctgctaaacacttgtatgggtgtctttgtacttattctagtaactttaagcttaaaattctttacaaataaaatgt

SEQ ID NO: 154244 - DNA, 694 bp, Homo sapiens
cgctgtcgtctcaccccgttatctgccctcgctctgaggtgccttcccggaaggaacgtcccacaacattcccataagtctcattggcccagtctcgatcacgcgggcagctgtgaggagtaaagtcgtcctcgctgggcacattgcttccctgaatagaaatgaggttccgttactaaggaaggaaagggatataaatgctggtgagtcatcagcgcagattgggggatgctgaggtaagtttattcatgttgaggtggaagtttctgtgaggacattttgggaacactgttcagcctgcagtctggggtccctcagaaatggactgattagaggtctgggactgggtagataaaagaggaacctggagcattttgttatgctggaaaatgagaacgtgccagggaaatgattgagcaccatcaaagtcaagcaacctccaccaaccttgtctgggattgtttcacaccaacataattaagcatggtaatgagttataagccattgagagaccagagaggccaggaatccaggggtcagtactgacagcaatagatagataatttcattgcagaagagaaggtgcttgcttcaataagatgcataagccatcagtcagtgtggagaggttatgtccaagtcacatacgcttgtaaaacagccgtccagtgacaatcagcacggtgcaagtcaa

SEQ ID NO: 154245 - DNA, 533 bp, Homo sapiens
atctcagcactttgggaggctgaggggggtggatcacttgaggtcaggagttcaagaccagcctggccaacatggtgaaaccgtgtctctactaaaaatacaaaaaattggccaggtatggtggagcgcacctgtagtctcagctactcggaaggcttaggaagatcacttgaaccgaggaagtggagactgcagtaaaccgagatcacaccactgtactccagcctgggcaacagagcaagactctgtcttggggggaagaaaaagaggttatatggctggttacaagagacacatcaaatataaaaacataagaaagttgaatctaaaaggatggataagaccaggtgtggtgactcacacccataatcccagcactttgggaggcctaggtgggaggattgcttgagcccagaagttcaagaccagcctgggcaacatggcaaaacgctgtctctacaaaaaatacaaaatttattcaggcgtgttggtgcatgcctgtattcccagctacttgggaggctgagatggga

SEQ ID NO: 154246 - DNA, 301 bp, Homo sapiens
agggtaaaactctgtccagagaaaaggctctcttccagctttcctgacttaatgcaatgtactccacgggtaaaatcctccaatagctcagagctgggtgtgcccccgcctctgtctgtgcccctgcctctgtctgtgtccccttctgccctgtgggccagtgcagatggccctctgaggggaggagagtgaggctgtttcaacagtatctcttgggctccaagacccagacaaccagatgaagaacaaaaccaagcaaccaagcacaagtgaaggtctgcacgccctgccctaggcaccc

SEQ ID NO: 154247 - DNA, 367 bp, Homo sapiens
ctcaatcacatcgtccttaatctctgtatcccatccaacttcttctgtttgagggttaaacatgttagagagttggaaacactgtgttgcaagtggctgaacagaagcagctgcagctaaagctgaagcttcagtctgctgggaaagtcttgtttgcaaatctgtcacagcgccgaatgccgaagagccactcattggtagagcttgctgctgtttctggcggaatctgcgaagctgtaccagtatagaaagaatcatgtctcctggtccctactatgttaagagcacgcataaacgatatagcctgggtcattgatatcatgagtcactttcactaaaattaatcgctatggagggccgagtatgg

SEQ ID NO: 154248 - DNA, 297 bp, Homo sapiens
taaagtcacagggccaaaagggaaaagaggagcctgacagcttcctcaccctgattcttctctgtccctccaagcacctcaagctgggacctcagtcctctgtccttgacactcactccactcacctgaaggggaagaataaaataaaattgataataagcattagttgtacctcatgggcctggcaccttcctttatacattagtggaaataaagcaccttcctcaaggcaatagccaccctggggtacccatttgatacattaaatgaaatccaaataaagtctttccatgagtc

SEQ ID NO: 154249 - DNA, 476 bp, Homo sapiens
gccttctatgtcacttgtcccgaaagaaaagaaaagaacaagacttcctgattgataactgatctgggccaggaatgcagcagcacttgatgtctgagggaagcggtttttcattgaagaggggaggaagacgaacgtgccccaaagcaaggtggggactttgactacaaactcagtggggctccgctttctgcctgtcgctggctcgttttatcgggcactgcgattgaagcaggagattagatttgggacctttaactcaacctaatcccaaatgcacctttattttatgtctcactgaggaagaactaacattgcaatggaaaactatggcatcctgctttctttagaattttattttcaacttatttgaatgggctttatatttaattaggtaaaaatttttataatatagtacttgggtgaatataaaaagaaaaatataagcaaaataaaattggttaatatattctaaa

SEQ ID NO: 154250 - DNA, 368 bp, Homo sapiens
accagtcctgcaagacatgtgttcttttcctgttgcagttcttttcatgggctcagagttgttagttgtgtcacagttgggtctggctgcagaccataggcaccttctacctcatggtgcacattggggttcttgtcttgtgccacacagcctctcattcttctgtggctggttcagacatctaaacgtgttgcttttcttcactgtgttgagcagcccagccccagaaggaatgctttcttgttctgttcaagttgcttgtgtatcagctgttccccactcccaccctttccagcagccaaaagtttccctaggctttcttgtctcagcaactttcccatcttgtctctcttggatgatgtttgccg

SEQ ID NO: 154251 - DNA, 238 bp, Homo sapiens
ccccaacatgaactctgtacccattaaacagtaactttctcttcttccttttcttacttcctcgtaagttcttgttttttgttgtttttgtctctgaatttgagaaggctgaaattttgtcgctttatagtttgcaactatatttctagtgctaggaattgtgcctaacactcactctaacaaatatttgttaaattgactgaatgcatggtagataagcttgagggaatcacacaag

SEQ ID NO: 154252 - DNA, 871 bp, Homo sapiens
tgtgagatgtgccttttaccttctgtcatgatcatgaggcctcccaagccacgtggaactgtaagtccattaaatctctctctctctctctctctctctttttttctgtaaattgcccagtctcaggtatgtctttatcagcagtgcgatatgtctttatcggcagtgcgaaaatggaataatacagtaaattggtaccagtagagtggagtgctgctgaaaagatactgggaaaggtggaaacgactttggaactgggtaacaggcagaggttggaacagtttggagggctcagaagaagacaggaaattgtgggaaagtttggaactccctagagacttgttgaatagctttgaccaaaatcctgaaaatatggacaatgaaatccagtctgaggtggtctcagagggagatgagaaattttttgggaactggagcaaaggcgactcttgttatggtttagcaagagttttgccactgccctggagatttgtggaacattgagagagattatttagggtatctggcggaagaaatttctaagcagcaaagcatttaagaggtgacttgggcgctgttaaaatcattcagttttaaaaaggaagcagagcataaaagttcagaaaatttgcagcctgagaatgcgatagaaaataaaatcccattttctgaggagaaatccaagccggccgcagaactttgcatcagtaacaaggagcctaatgttattccccaagacaactgggaaaatgtctccagggcatgtcagaggtcttcatggcagcccctcccataacaagcctagaggtctaggaggaaaaagcagttttgcgagctgagccaagggtccctgtgctgtgtgcagcctagg

SEQ ID NO: 154253 - DNA, 264 bp, Homo sapiens
aaggcaagtatggtggccttcaaactttcttggccaggcaacatctttgtagaagaccactcttagagtactctagtattctggagaatacagtttgtcaggggcagttgtcttaaccttctataaatgtgtacttgaatcattgtaatgcaatgttgggcacattaggaaatacacagtacatttttgcctttaaggaattttaaatggagattgttccaaatgatacttattcacaattccatttagtaattagatcactct

SEQ ID NO: 154254 - DNA, 324 bp, Homo sapiens
agtcaaattgtattacacgacttataataaaaacagaagcccttgccgtaccacttctcagccacatgctgttctccagacaacccttttatcacttcctgcacttaactctggtatttgtctgtctttctgactgataggtttatatgggttattcttcgcataccacggttagacactgtgtatacatgtcctcttatgaacgacagggattgccctcacacaccctaatgttcttctcatcatcatcagtatagctgtgtcacaagtataatttttattagtttgattgtctttacattattttgactctgtaaatattgt

SEQ ID NO: 154255 - DNA, 708 bp, Homo sapiens
tcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaactta

SEQ ID NO: 154256 - DNA, 257 bp, Homo sapiens
caagatggtgccactgcactccagcctgggcgacagagcaagacaccatctcaaaaaaataataaaaaacctaaattatcaacctttgaataattcatacttaacgaaaatatttctaatttttatgtaataagaatacttttacttgtagttaagctatcaaaactgtttaaaattttttccatcaccacataaacagccaactgtagaactacaacaatttttcgtaaaagtaggacaacttttttcttaaaaat

SEQ ID NO: 154257 - DNA, 210 bp, Homo sapiens
ctccaaaataaaactctatacccattacgcagtttcttcctagaatatgggtaaatcttaattactgatattttcagatcaatttacatcaaattaagtacaagtctgtcttcttaaagtaacacattctcttgtaaaagtattgcctttaaacagagacatctgtgaatccaaagaaaatgtaaatcctcccaaaacaatcagttttcc

SEQ ID NO: 154258 - DNA, 662 bp, Homo sapiens
tataatcttagatcgttaagctattagaccgatacatgtcgaggatgatgtggatagtggtttagtatatcaggttatcttttaacatttattaatctttttagatttcaaagtgacttgtttttttcttcatatccttgtccttctcaaaactgcagcgttttagacatgtgtttctcaaggttatcagctactcttcccaaggagaagctttcatagattagctcctctggttccggtgctgctcaggacatgaccctatggagttactcagtttcagagcaggctggttggtgatactttccttagccattcctgacagggaccttgacagtgggactcagaacactcttatgtactcgattttgagttgctaataatgggcgaggaatttcttaattctattggtgaggttcctgggcttttctagtaggagggaaaaatgcatttttccaaagatagttctagagaagttcaaaaaacagttgtgcaatggacagaattattgtaatcatcagagggttttccaaagtatctattctgcaggattatactcatctggttctcaagttctcagttgctctgtctcaatcataccttactttcatttaataattatttattaaacaactgcaactacatcctaggcactttgctaggtg

SEQ ID NO: 154259 - DNA, 451 bp, Homo sapiens
cagggttcaagtcttttctgtgtgacctcagtgagtcttttaacttgtcttggctctgttttttctctctaagatggggataatgatggcacctacttcacagagttattctgagctttgaataaattagtgtttataaaatgtttagaacagcacataagtgaattcaaatctttgctaaatatttaggaatgctgttcaacgttgcctttcctgacaacttctcttgtctctcttttctctccataaaatggaaataatgatggcacctgcttcatagttctttagaactttgaacaaattaatgtttataaaatgtgtagaacggcacataagtgaattcaaatatttgttagatatttaggaatgctgttcaacagtgccttcactgacaacttctattgtctctgtttcctctctctaaaatggggataatgatgacacccactgc

SEQ ID NO: 154260 - DNA, 458 bp, Homo sapiens
tattttctctttttttgaattctaatgggccatattgttcgctagtattgcctccaagcttagcatgatacctggcacatatgtgctctgttgatatttgtcaaatcaatgaaaagcttaagtggtgggatcctaattttggggaggagagctgagaaaatgtcctgccatgaacttgctcaggaatctaatcagtcagtcaatgtctgagatgtagccaatagtgatcttcctcctctgcactcttctaggggctgtaggtacctctaagtctctgaccatgaactgctaagtaccataacgtcttactgaactgtatttgccctaccagacttgtgaaccttttgaaggtagtaaccctttcccgtgttttatgcaccatcagtcataaattttttttgctatgaaccatcagtcatatttttttttgctatgagtcttgcacatagcagaaaaat

SEQ ID NO: 154261 - DNA, 448 bp, Homo sapiens
ccacactgtgatagactgaatggaaagggtctggtttacaaaggagagctttgtcttgaattaactcagtgagaggaaggccacagggatggtctgtcccctgcagtgcaggggcctgaggttccgggagggaaagtgatgagatcaggtaactagggaatagcagagtgcggctggagcctccgtgcagaggtctcctttacaccacatccagacacttgtagggagctccttaatctctgtggatgtccagctgttctcttgagacatgggcctctatgtccacaccctatgactctgctgtcagaagagtgtgttgctggcctcagtgtgggcactggcaggtggaggaggggacaccaccacggggaggccagcatctgccccctcgaacagcagcctaccctccctgtgcgcctccttggctgaggtccccctgctgctttgc

SEQ ID NO: 154262 - DNA, 650 bp, Homo sapiens
tgggttttgaagtactgcgtgtcgtcttcagagttgttttcctggaggcgctgataccggacttggtggagaaggatggtatgaatgtgtttctaggtggctgcctggacaagggagttcagcctttgggagataaagcagaatataaagggtcacactctgtcacccagactggagtgcagtggcgcaatctcagctcgctgtagactcaacctcctgggctcaagcgattctcccacctcagccttctgactttgcctcgggagagaaaaagagagtcgattccgagtacagctgggccactgggactgcattcctgcctgtgaggaggacagcctgtcaatgagccagaaggggctaacagaggttgtacttacaggttctcaagttttgctatcataaacacccaaagtacaccacgccggcaagctgaaggctgacaggatagaaaacttgcacaagacagttaacattgtagcgatcatcttgccaaacagagggcagcaatgcttgtgtcttggtcggaaaggagttggagtgaagtcacacaggcaaccttcagttgcagggtcaagaagagccacattcaaacctgactatatgaaataattatcacccagagatattggacttggaatagaatagagaaa

SEQ ID NO: 154263 - DNA, 460 bp, Homo sapiens
tctctctaccccctatctccaacagaacttttaggtaggccaatgcttagacaaatctgtaacagtaatacataaacacaaaggggagatgtagggagccgatggcctgagagacatgaccaactcagcgttccactggaggctatatgaccaaacagcaaactgtttatcatgaatgcaggatgtgggcaaactcatgactgcgcctaccgccagaaggtttgctggaggcaatcattccctggcactgtgctcactgagattatctactgggacatctagagcctattgttcaaagaatgcagtcttgcaagcctgctgtaaatcaagccgctgaccgacaatcacccccacccttctccctcttttacccaataaaatgtgaagggctctaaagctcagggcccttgtccattagaagcaaggagccccctgaccctttcttccaaatatactctat

SEQ ID NO: 154264 - DNA, 350 bp, Homo sapiens
gagatgacacagatgttagagttatctgacaagtatttaaaggaatcaccataaatatgtttcagtgagcaactgtaaacatacaaacaagcaaaaaaatagtctcagaaagacatagacaatataagaaatagtcactgaaaatacatcttacatggaataataggggcgatgatgctcttatggtacggtgaatgcataaagagtaatcaccgaaatcggtacctcttcgtcaaagagccctggaagttatgcagactgcaaggcagtacgccattagtgtgatacaaggtgggctacgtcgcttaccgaggctcgaactctgaacatctaggtcctagcagttgcct

SEQ ID NO: 154265 - DNA, 340 bp, Homo sapiens
ggcaggtgcagtggacggagcttggtggttgtgactgagggacaaagtggtgtgaaagacaacaagggtcaggccacacctgccagcaaccactgctttgtgtgcatggtaggtcacaggcagtaacttggaagtgaattcatcagtgacatgcaagtattaactttatttacaagatttatagaagggatgaacaaacttaaaatgtttgcccctacactgattataaaagagtactaaaatcaattatgaaaatgtgggtttaaattcctatttgttctgcatcagtgaagatgcttcttgagtgtctgagaaaaatcttggtatgaggagtaaacat

SEQ ID NO: 154266 - DNA, 482 bp, Homo sapiens
tggttagaggaaaaaaatgcttttctgagtttatgcaaaatgatcatgttttattcatttggtagaagtcactctaatggcatgcagggtagatgatgtcagcttttccatctcagctgaatcaaattgtacggagcccttaatctctgctaggggctggggcaatccagtggaaaaggatggtctcaatctcagtgcagtaggaaagcaggaatcagctcagtgaggcaggaatctacgcaggtgcgcaggtgtagaggaagtgctgtagggccgcaggggttggggctgtgatagagaagggtggaggatgcaggcaaggggctcccagaggagttggtgtctgggctgtggctgaagttcaccgtgtgacactgtccacgaggaaggcctcagatgaaggagggcacttcaggtagagcgtgggcactgcacaatggttgtcctggatgcgcaggagtggggtggtcatccacaaatga

SEQ ID NO: 154267 - DNA, 547 bp, Homo sapiens
cccaaagtacgggattacaggcgtgagccactgcgcccagccgtttcttttattttaaatgatcaagtttgaggtcatgtgttatggcagccttagtaaactcagacactccccctattctctctttccccaagaacagtcatagccaatgactgaccagagtaagagtatgtattagtccgtttttgcacagctataaagaaatacccaaggctgagtaatgtagaagaaaagaggtttaactgactcacagttccgcatggcgggggagcctcaggaaacttataatcatggcgggaggtgaaggagaagcaggtaccttcttcacaaggtggcaggagggagcgagtgcaagaacaaggaagtgccacactaaaaccatcagctctcttgagaactcactcactatcatgagaacagcatgtgggaaaccacccccgtgatccagtcaccttgacctggtcccttcgttgacacgtggggattacaattcgagatgagatttgggtggggacacagaaccaaaccatatcagagtacaaaggct

SEQ ID NO: 154268 - DNA, 611 bp, Homo sapiens
ccgcgctcggcctcaatttttagttttactttaaaattaaatagccagatgtacctagtcactatcctattgaacagcatggagctttgcctctcaatatgcaaataagctttgcctctcaatatgcaaataaaaaccaaacctttgcttcaaaagctaaatattgtttagggatttatgtttgatttttcaaagaggtggtgttgcagggtttcacagatgtgactgtcaacatttttagcagggaactgggaggagaggcaagatgatactaaaattgaattggagacactctaggattggataaagaagagtacagtgattctaagtgcaagatatgttttaggggacttcatgcagcttggtttgtcactagaagtttattttagtgtttagatgtataaacatactgaattgtgtttctagtcttaacatcaaatgttttataaattaaatctacaaaactaataaaattcaagttccctaacattaatttaatgtgacatatgacatattctacaaattgcttacaatatgaatatggtatggaacaaattattttttagttttgcttgacaatactactggtatcttggaaaggctcaattctt

SEQ ID NO: 154269 - DNA, 548 bp, Homo sapiens
ctacggactgacctgtatccccccagattcatatgctgaagccctggcccagtgtggctgcatttggagatggggcctcttggaggtcattaaggctaactgacatcacaaggatggggccctaatctgacaggactattagccttataggaagagagacgcccccgctctctatccactccctgcaatgcacaacacacactccacagaaaggccatgtgaggacacagcaagaaggcagctgtcttccagctgggaagagggctctcaccagaaacggaattacccagcaccttgaccatcgactgagtctccagaactgagaaaataaatttctgttgcttaaaccacccagtctatggtattttgttatggcagcccaagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgcgaggtttcaaaaaaatggcgctaa

SEQ ID NO: 154270 - DNA, 762 bp, Homo sapiens
gccttttgattcaaagatgtggaacagtgtgtcttttaacatataccatttcactttttactgctactcacctggaaagcaaataattttttaaatatttgactcattttataaaagatttttttaatttaaaatttaatctgagtataatatttttctgagaaatgcctgagcatatctcaatattttatatctaaatctagcatttatattttatcttagaactttgacttttgtagatctctgtgaggtactaattaaattctacaaatatttactgagcgtttgagtatcttctctatgcaaggggctgaacgagctggttgagaacaaaacagggaaaggagttaacatctattgaacacctgttaaattttagatcttcatctcatttaatctgtatagtaaatttgttagtaggtacgatcctcattttataccacaggaaacttaggcatggaggagttaagctctcatcacctaaatggcagttctggaatttgaacctaagcccatgctacttttctaacacacaatactgcctcgtgtgtaaatataaattggattcctatttctagcttatagtctagtccaggagttcacaaagtggagtctgcagatggactgctggtggtccctgatttcacttttggttatcacaagttcacaactgtagtcgttcatcagtattcatggaggattggttccagtacccctgctgtgggtaccaaaatccatggagctgaagtcccttatataaaa

SEQ ID NO: 154271 - DNA, 659 bp, Homo sapiens
ctttgtgaggcttcagtgcagcagctctcaatcttaagtctagacaccctgcaccccatgagacccatctcagtcaacctgggctgctaaaacaactatcatagactggggcgatttataaacaacacaaatttgtccctgttctgatgtgtgggaagtctaagatttaggtgccggtagatctggtgtctggtgaggatcagtttcctagttcatacacggtgtccttgcatggaagaaggaaggagaggtctctcagggacctctttagtaagaacaccgatcccatttgtgagaactccaccctcattagctaatcacacttcaaagaccccacccccacagtctcatcttggaggtcaggatttcaacatatgagtttgggggtccacaaacattccattctcagcaagacccaaacctgagtccacagggagcatgcctggggagagctaagtcaccccacaccctcacccaacctgctgtcctttgtgttactagagcagcctggctgtgctgcctgaacccttccttccttctactgcaagcccttcagtccttgtgaaaatagatttctcttgcttcatgcatgcaaccttttagggtctatcttggaaccttgctacatgaatatcatcttaatatagttgaggacaccc

SEQ ID NO: 154272 - DNA, 185 bp, Homo sapiens
ccttatatcacctatgtcatgtggtactaatgtaaacattgcatcaaatattaaggtcagctgcaaaacccatatacttaggctatttaaccaaaagtgtatgattgtaagagtttgaaacagtcattaacacaaagttaaatagcctaagtatgtgggttttgcagctgaccttaatatttgat

SEQ ID NO: 154273 - DNA, 295 bp, Homo sapiens
cattcaccctgcctttccaggaggtgccatagtaggactgttggcactgccacactctgtccccatcttaccgtgaaccccggaggggggctgaggtgtgattccagcctactgtcctggcttctggcttccagactcagcacacagtagggacttcagagggcttgaaggaaatcagcggctgaatgcctgaaaatataagctttcaaatgcagtttgcttaaggttagtacagatgtccccatcttctatcatccagagtgcatttttccctctaaatggaaggacaacaagc

SEQ ID NO: 154274 - DNA, 555 bp, Homo sapiens
acagtgagacttcatctctacaaaaaataaaacaataaatttacaaagcatgttggtggaatgaatgagttaaagctgccagtgaagccaacttttacttggaaaaaacatcctttgtccctttcaaaccctcttaaaactccacaaagatgggattttctttgggagagggtgagtttgatgctgcacatgggtgaagagactggagggagtggaggtggcaagtcttggagttgtttgcatctctcagagaggttatcccatagagataataaatagatggtgggagaagaatatttcatttcatttggaaggcatggacatctccattccatctaagcaccctgcttgtcagccacaaaacttaaaaattaactggatacattgccactgagggatagactaaatatttggtcggccagtcatgccatatctgtgccactctgagtgtagagtagactcccaccttgggcatcactgtgagacttcatctctacaaaaaataaaacaataaatttacaaagcatgtcggtggactgaatgagttcaagctgt

SEQ ID NO: 154275 - DNA, 340 bp, Homo sapiens
cttcctaaccacctccacagatctccaggagccacagcgtgggagaagatgctcagcctcactctcctgggaaggcctccagctcaagcggggaggctggacaggaaccagcttcctgcatgtcagatcccaggccctgtccagagccaggcctcagtcttccaggatggaacatggcctccccacctcggactccttgcccagaagctagacctcagtttcccggccttggtttcctagcagcgccccaggccagaggctgcaccagtcttccaaggcagcacagcgctttggtcattggctctgagatttccagacaggctgagaagcaacaccaccg

SEQ ID NO: 154276 - DNA, 339 bp, Homo sapiens
aacaaaccctgatgacatgtgtttatctatgtaacaaaccctcacatgtaccaccaaaccgaaaataaaaattttttaaaaaggaatgtggacaaaagagagttgcttattgtgaatgtctgtctggccaagaagcccctcagatgtgcagggaaggcattccctacctttctcctggaggtagctggggatgacctctccttctcattcctgaagactgtctcgctgccagaaccacccatattctgctcctcctcacccaaaattttcctgctgtaagttgacaatccttgccatcaagttacatccgctgccccaccccatcgccactcacttttt

SEQ ID NO: 154277 - DNA, 259 bp, Homo sapiens
aaacaaaagaggtgatataccatgaaatttaacatgatgcctctacttgccagaagctctgaaacttaaagcgagctctctcagctttctctttgtgaaaaaggaaaatcagcaagtgttgcagagacggcggcaccaaaccaagacttcctctttgacgtaatcagaaacgctgatgaaattggaaaggagtgcctttctcattcactctgtggagttcagcgttattcaaccctgccaaactaaattcacttctcac

SEQ ID NO: 154278 - DNA, 211 bp, Homo sapiens
ctagagtaagtttaggttttattagtgttagagtagtatttagcttgatagggcttctaagagtaaaatcatatcttctaagctatttcttgatattgctctttattcaggccaaaactattagaggttctgcttcagtctttcattcatgtggaccctcaaatttagatatagtacttctttggtctttgatttttttcttttcgaataa

SEQ ID NO: 154279 - DNA, 1203 bp, Homo sapiens
gaaattttttttttaataaaaacaggtctcactgacataggactcttcagaagttcctacttcttagcatgtagagaggaggaggggattgatatcctattggcatcacaagagaagatctcttacctgtctagactgagaccaataattgttagtcaaaaagttagctgaagctggaaatcacaaaatgttacacatatatagcttaaacattttattttaactttataaattcattcatttttcatctggagagaccaaggtctttccattgaagcagttctgcagattggagatgactgtagactttctggcactttcattgtacattatccacagtttatactgctagtttttctttaaagagggattctaaagatagtcacaaggcaatttgagtgcagaatttttccagatttgtgcggtttttttcctactattagagtagtctgtacctaatttgaaagcagtttatgtctcaacttaatgttccttgaagcagttttattgttgaagtcatatttcactggtttttataacatttatataaattatgttgctgtaatcacaaaacaactgtgataaacaagttggaaagaaaaaaaactagcttatgttaaaaacaaaactcagctgctgggagaagaaccagccactgcatatgcagtggaccctggccatgtttaaccaggtaaaggagagcattccttaatccttcaaggcaattcagacagtttgtactgcagactaattaacatgatctgtaagccaggggatcaataatgttactgtttttatcataatcaaatcttatacaatagttgggtaaagcatagttcttaattcagttacctataaccttgaagaatcagatttctaaaaatttctataggatggtatatacttttaccttcataatgtaattaacaagttatttgtgttcatgaatcaggtgaagaaaattgagattttgtttctaatgagctctaataataatataagaacacttgaccataatttgactatagtaaaattttttaacattttccgaagtcatgtagacaaattttctgagtatttctaatgagtttgcaggaaggaaataaagttagtagagtgagtctactattatcattaaattaaacttagatactttctaacacactcagttatttttccttctaataaataagtaaaatgtca

SEQ ID NO: 154280 - DNA, 2111 bp, Homo sapiens
gaaattttttttttaataaaaacaggtctcactgacataggactcttcagaagttcctacttcttagcatgtagagaggaggaggggattgatatcctattggcatcacaagagaagatctcttacctgtctagactgagaccaataattgttagtcaaaaagttagctgaagctggaaatcacaaaatgttacacatatatagcttaaacattttattttaactttataaattcattcatttttcatctggagagaccaaggtctttccattgaagcagttctgcagattggagatgactgtagactttctggcactttcattgtacattatccacagtttatactgctagtttttctttaaagagggattctaaagatagtcacaaggcaatttgagtgcagaatttttccagatttgtgcggtttttttcctactattagagtagtctgtacctaatttgaaagcagtttatgtctcaacttaatgttccttgaagcagttttattgttgaagtcatatttcactggtttttataacatttatataaattatgttgctgtaatcacaaaacaactgtgataaacaagttggaaagaaaaaaaactagcttatgttaaaaacaaaactcagctgctgggagaagaaccagccactgcatatgcagtggaccctggccatgtttaaccaggtaaaggagagcattccttaatccttcaaggcaattcagacagtttgtactgcagactaattaacatgatctgtaagccaggggatcaataatgttactgtttttatcataatcaaatcttatacaatagttgggtaaagcatagttcttaattcagttacctataaccttgaagaatcagatttctaaaaatttctataggatggtatatacttttaccttcataatgtaattaacaagttatttgtgttcatgaatcaggtgaagaaaattgagattttgtttctaatgagctctaataataatataagaacacttgaccataatttgactatagtaaaattttttaacattttccgaagtcatgtagacaaattttctgagtatttctaatgagtttgcaggaaggaaataaagttagtagagtgagtctactattatcattaaattaaacttagatactttctaacacactcagttatttttccttctaataaataagtaaaatgtcagaatttcatccataatatcttgtggtcaaacagtggttattatgaaagactactttagaagtcttaagtataactaataaagcagagacttttaatatatttgactttgtcagtctgacagtgttatatactagcatttgaatatagttacatattctacatttcagaagctacactctaagagatagaatgcctcacaggaagatagctcatagatacaaccttcctgtttgcactagttcatgataagatgtttgcaattatgatattctcaagtagcattttggaaatgactttattatgacattttaaataacttttaagaaaaaatctaatttatagtttgatcctttgtacagttaaactcttaagaacgtgaaaaggaatgcacacagaaaggttgcatgtaactctctagtgttattttaattcatccatgtaaatgcattcttgatttttctcttcctttctctacttagattagatgacttatgagaaaggatagatgtaagagttaagcagcataagaagtggggggatagaagaatttgggtgtcttaagaatgtttaagaaagtagaagtatcaagcagtagttggttttatgttggtttttttaaaactttgtttcatttatagactctgtatttatctgaaatgtgtagatctccctttccattccacagtgacattgaagatccgtaccttaggttatctttggttttaactttggtatgattaatgaaataaaattattttctgaaagtttctgtatcttaacatcagtatttgatgaatatgtttaaaagataaaacttggaaaatcttggtatttaaaattatcactgtttagaaacttatagttttgagttagtcaatcttagaaatgaataccatgcttggttctct

SEQ ID NO: 154281 - DNA, 483 bp, Homo sapiens
cagccttgggctccctaagtgctgggattacaggtgtgaaccaccgtgcccagccaagaaacatctctaaacccctctcttcctcccagcagtgactgtgaagggcactggggacaaatccctttttgaaaggatcttctggatgatgtcatggatttgggcctcttcctgctgggggtcactgggtggtacttcttggccatccagccaatagcaacaggccagcatgtgatgacgtcactgtcacccccactgtctcctcgggttccaaggagcaagaggcttgcaccattcctctctaatctgagatggattttgtgggtttgcgtggggggaaggttttgttttttttttttttagcaagaatcttcttaagccatacacccatctcattaggattagttttgttaatctatagatccacttattcggccgcacgccagcctccgagtgtcccaaacacgaagtcaaagggtgagcaga

SEQ ID NO: 154282 - DNA, 424 bp, Homo sapiens
tctggtattacagtgtcctacctggtcaatgttgtctttattttgattatttatgtatgaggataggactttttataccaattaaaatgtttttgtttatcccattctttctgtttctgtttcttctgttttctcttaaatttattgtcttctgctgttttgttttcttgctccatctttttctttttaatattttagactttatatcttctctgatcttctttgaagttttaacatgcatatttaactttagatttcaggatttaaaatattttccttcccccaacttaaggacttcattagctttggtcactcccttcctgaaatgacacttttgttattgaaggtatttaaagtgtgactttttagaaattcaacaatatgcacacaccagtttttcaccacaccagtaaatgtctcatat

SEQ ID NO: 154283 - DNA, 304 bp, Homo sapiens
acaggcatgtgtcaccactctagactaattaaaaacaaaaaattgtagagacagtgtctcgccatgttgtccaggctggtctcaaactcctggcaatccttctgccttgacctcccagtatgctggggttacaggtatgaggaacctgcctggcacccagtatttttaaatcaagttttcctactgctccccaaccaaaatgacttctcatgaggcttctcagcaatcaatgagctttattaatgagatctcaacactgacaaggtgaaaatttcaagaaggacaagcaaggtgctctgtttaa

SEQ ID NO: 154284 - DNA, 334 bp, Homo sapiens
aattacattcacaatgtagtacaagcaataccactatttctgaaactttagtatctcaaacagaaactctgtaaccagggagggcatggtggctcacgcctgtaatcccagcactttgggaggtcaacgtgggcagatcacttgagttcaggagttcaagaacagcctggccaacatggtgaaaccccgtatctactaaaaatacaaaaattggccatgcatggtggcatgcatctgtaacaccagctactaaggaggcagaggttgcagtgagctgaggtcatgccattgcacttcagcctgggctgcacagccagactccatctcaaaaaaa

SEQ ID NO: 154285 - DNA, 233 bp, Homo sapiens
ccacaatcaagttttcttgagctttattttctgagctttttattgtgagaacaacaggcaacctgaatatgctcttgcaaaatacactccctactcttttccttttcactagcagagaattactgatctatgttacttcaataaagcactgggtaagagagctaacaagaacagggttctacctctcaatgctacagtaagaaacatacaagagtactgtacggtcatctttg

SEQ ID NO: 154286 - DNA, 374 bp, Homo sapiens
gcatacatatgataaagcagacatgacttaaacacatttacttttcttattaaaaacaacaacaaataagtagaaatcaaggtagaaagttagaaatggcagaagaaaaagacatttctggcagcttggatgaggaaaccattactctcaaactgggctcaggaaaggattgagaatgaatgtagcatctcttctgggacttgaaggatcaatagaattcgaattggcaaaaatataggtgaagaaggcattaagttatttaaagcgaaggaaacagcatcagcaaaattatagaggaaagtgtgaggtgtgtgggtctaggggcttatacattgcgtttgattagactgaatggtacacaaagaggaatactg

SEQ ID NO: 154287 - DNA, 610 bp, Homo sapiens
gagatcgtgccattgcactccagcctgggcaacaagagcaactccatctcaaaaacaagagaatgggtgtgatgtgtgagtgtgagagcaggtgtgtgtgagcatgcatgagtgtgagctgctgtgagtggatgtgagagcagaatgtgtgtgagcatttgagtgtgcaagtaggtgtctgagtggttgtgtgtgaacaggcgtgtaagcatgcaagtggatatgcatgagcagaatgtatgtgcatgcgtgagcaggtgtgaggtgcaagtgtgtgtaagtggtgtgaaatatgagtgagcaggtgtcaatgaggtgtgaaagagctggtgtgagcgtgtgagtataagtgagcagctgtgaggtgtgagcatgtatgtgagcaggtatgtgtgatgtgtgagcatatgtgtgagcatgtgtgtgtgcagatatgtgtgggcaggtgtgtgtgagtgggtgtgagatgtgagcatgtgtgtgaggtatgaggtgtgagcatgtgtgaggtgtgagcatgtgagtgggtgtgaatgagacagagagagagactgtgggcagccagggagctcaggaacccgtgggaggtttatttcttttcttttttcct

SEQ ID NO: 154288 - DNA, 455 bp, Homo sapiens
atttcatgacccacgaatggatctcaacctacaactggaaaaacccactactctggaggagctgattccgtactctgctggatcttcaattcctgaccgctggaaattggctgcaattttcctggtgagttcctccctccatgttctcctcactaatacaccctacaccagacctccagtcctaaaagccaccacctgcttcacgtcaccacacctgtgccaatcagatttcctctgttccctcttggaccttcagggacctccaggataaatgccaggatcccagttactggcagactgagagaaggatgacagccccaaaagatcacgaggttcctatctgttcatatttggtgggcagctttcgtctgcaagaacaaaatacaagccgggtgaggcggctcacatctgtaatgccagtactttgggaggccgaggcaggcggatcacctgat

SEQ ID NO: 154289 - DNA, 265 bp, Homo sapiens
atagtgccactgaactttagcctgggtaagagaatgagactgtcttaaaaacaaaacaaaaaacatggtaaaggggcatgtcatgtattattacattcacttagtattcaaggaagtattttaggtaaaaggtgtccaaattaggaaaccaaagcactgttggctttcccaagaatctgaagaactctctgagcctggtttcttgctagcaccattataaatgagttagaggtggtgaggcagctggttctgctgtcccacgccg

SEQ ID NO: 154290 - DNA, 166 bp, Homo sapiens
aacccagcagagttcacactaaacctcttttggtcttgctgagtcctcatcaccctgtggcagtacctgttcagctagaaatgcagagctcacctgaacccaatttgactttcaaggaagaatttagtggcaggtgcaattttgctagtttacaaacccacttcga

SEQ ID NO: 154291 - DNA, 608 bp, Homo sapiens
agttgtgaacttccagcagagacaatggtgcctcccccatcttgccctggaggctggcctgaccaggctggattcattcaaagtttaaggcactggtctcccaatgccatctattatataaatcatctttcccatgctggtctgaaataccctgagaatcaggggtgctcagtgtaacatcataatagcaaaaaattagggacgaacacaagttctatcagtattgcagaataaactgatacagctacagaatggttttttttttaaacttttcttatagaatattagacctttgatatagatatttgtttaaatacatggattcataagtatggagttatccttcaatcaatggaaagccaccaaatggttttgtggtcaggagagcttcaggacacttaatgctagttgtgacgtgtggggaaggaacccattgttgcttatgtgaacgtgtaggtaggtctatgagtgaaaaaatagccaaaagaatcaactgcacttattttgagatgagatcacagggacatatgccttctgtattatacctttatgtacaattggaattactataatgaccatttgttacttttgcaaccagaaaaaaaaaa

SEQ ID NO: 154292 - DNA, 431 bp, Homo sapiens
acttttcacaaaaatcttacttatccttacatgtaatagattttttgtaagtgaattaataaattttatttttagtgtgataaatattgataggtataacctactgaaacaaaagctctttggaatccttaatcatttctaagagtctaaaagaggtccaattcccaaagagtttgagaaccactattctagaaggcaagagaaaaggaactcctgacttcaactttcatctacaaagtttaaccagaaaacaaatataaaaggtcatgaaaactttagacaaatagaaggtcacaagaaagaccaagaaatcacgaagatcataaacctggaggacattatgttacatgaaataagacaggcacagagagacaaacaccacatgatctcacatatgtaatctaaaaaagtggaaatcagaaatcacagaa

SEQ ID NO: 154293 - DNA, 509 bp, Homo sapiens
tcaagatgaaagtgacggaatatctagaaggccagacacgctgaaaggagattaagaaaatttaagtaacctttactgttgacctgggaataattacataataaaatcaagtccagccccatccccctaaaaatgcgattatttactccaagaaaaacaaaatgttcagcaggaaaggcaaggtatcacaataacatagctgtgaagagtatttatacagtccttaaaatcttatagtgtaaaccctgaatacaacctaaccaaaattgtgacataattactagcgaggagattggagagcagaaaatgtgcatgtttgtggtgggagtaagggagtgaggagacaggtaaatcctcagcttccttggcttatggttaatggttaataaataaggcctaaatccaatataccaggaagtagcaattagaggctgagacaggagaatgcctaaggccaaaaattcgagaccagcctgggcaatatagggacactccatttcttaaaaaaa

SEQ ID NO: 154294 - DNA, 619 bp, Homo sapiens
ttgtactcatcaatctaaagatctatccatacagcattccatttttgatccatccaatgataacacctaggcatataaccatctgcaccttcactaaatgattccactgtgcatataaccatacatacacccaacaggtttttaaaacctgcattctccattcttgcatccagccatttgctcatattctactttccatctatttcttacattattcaatacacccaattttgcatgcatccgttattatatttcaaattatattagacgattattatattcatctttctgggctttaaatatccaatcccacataatttcaatgactagttattaaatccacattaaccatataatacaaagaaaatttcagtaaccattcttgcatccttccatcaactcacatgtctgcctgtctactactactaccaagcttgaaaacaccaatccaaccctgcctccttgaacgcacctatccaccaatcactgaattattgtgtgtaactttccctctgtactcagattgaagtcatggccacttcaaaattttactggctgaacacatctacttcttactaatgaaaatattcctgtgggtctgttatgatggctctcaggg

SEQ ID NO: 154295 - DNA, 525 bp, Homo sapiens
tttacctggagatggagtcttactctgtcacccaggctggagtacactggcacaattttagctcattgcaacctccgccttccaggctcaagtgattctcctgcctcagcctcctgagtagctaggattacaggtgcctgccgcctgccaccacacctggctaatttttgtatttttagtagagatggggtttcgctgtgttggccaggctggtctcgaactcctgacctcaagtgatccactcacctcggcctccgaaagtactgggactacaggcgtgagccaccgcgcccagctggccccattctttccacccttagtcgcttatgttcttttgattcagctgtctaaatacctgcatctctctgtttctggtcaccctgcttggtgcaggccatcattttatctcaactggatcattacagtagcttctgtagggttgcctctgttcctttcattttccttgctacagccagagtgataattctaaaatacaaatctgataatgccacttcctttaaaatc

SEQ ID NO: 154296 - DNA, 281 bp, Homo sapiens
agaggatgcagtgagctgggttcacaccactgcactccagcctggtgacagagcgagagactgtctccaaaaataaaactttttagaaaaacaacaaaaaaaagtcattaagaaagtaaattttaagttatgtatatcacaatttctaaaaataatgatttttaaaagagtagagcaaagttgtgggtttgccagccttaaccattccctgtgattgcctggatagacatgggccatatccgtgctgaagggggccaggctcatggacttcccaacagatt

SEQ ID NO: 154297 - DNA, 661 bp, Homo sapiens
ataactccccctaacaaataaattagaatcaaccttcatgtggggagacctcccagtggaatacgagaagtaacaagtgacctaattgtgctgcaattgagtgatataaccccagtgaaggcggtggggaagagaaaaactaacccaagtaattatgggaaacagcattttggctgtatatcggagattaaacaaatagaactgtgcataaatactgtattatagttactgagttttttttctcacagggtatggggcagcaattttgaaactgatgtgtgtataaggattgagcaaataagtaaatatgtcgtagataatgagagccaggtttctcattgtcagagaaagaagtttcaaataaagaaaggggaaggctagagtgaaccttgaagtgttggattagaatggaagcataagtattgtgggagacagatgaatgctcaccccactcaaaatatacatgtcctaatttccagaacccatgagtgtgttatgttacatggcaagggggaattaaagttgcaggtggaattgagattgctgatcagctcactttaaaatcgagattcttttcaatgagctgtgtgggtccaatataatcataaaactcattataagtgaaagagggacgtaggagagtcagtgtcagagtgacgca

SEQ ID NO: 154298 - DNA, 331 bp, Homo sapiens
catttgcccctcaccccagatgctactcagggaagttcacgcttagtcaaaattatcacaaaattcagctaggaggttccttcactctgtagccccttcccaattctgctggctgccttcccttccccaaggacctctgtgaggtaacgccaggaatagcttccatgggctcgagctaaggactgggagtacctacggggctcctcctgctgcttcttctacttttatatttcacttggctccctaaatccattttgtcatgcacgtccatgtgaagagtccaccaaacaggctttgtgtgagcaacaaggctgtttatttcacctgcgtg

SEQ ID NO: 154299 - DNA, 192 bp, Homo sapiens
cgtgtgcccctcggtcctggttctgcatttagggttctctctgcagaactcaaccccctccagtgagacagccgtgtccagggatgtgttcagctcccagtgcccccacccagctcctctgctccagactgcaaatgccattaatatttagcattagaaggatctggtgaagcccataaatctgcatatgtt

SEQ ID NO: 154300 - DNA, 384 bp, Homo sapiens
gttacttaatgttaggagtttcagaaagtggttgaaaagactaaatgacatcacatacagaaatccttcaaaagttaaaaactgctgtacaaatattacaataagcagagaagaaaaataattagtgataataattagattttgcattggttgttctttgtagagatcacgcatacagacattgtttctaatttctgtctcaataccttcctattctataatttcaaaaaataacccccacacacactttccctacataccattttagttactatgatgtggaaaatacacttttcggccaggcgcagtggctcacacctgtaaacccagcactttaggaggccaaggagggcagatcacttgggatcaggagttcgagaccag

SEQ ID NO: 154301 - DNA, 720 bp, Homo sapiens
cagatgctataaatatcttcttagactcgtaaattagtattttggttttgtggttgtcattgtaaatagatctgtttatttcccatttgtaattgtttattgtcttgttgtaattatagcaggagaatcgcttaaaccctggaggcggaggttgcagtgagccaagatcacgctactgtgctccaacctgacggacagagcaagactccgtctcaaaaaaataaataaataaataaaaaagctgaaggaatatagtacaaactgttaatagtaggtgtctttgggtggtatcattaatttttcccttttactatacacttttgtaatttttaaaaaaattcagaatgggccaggcacagtggctcatgcctataatccaactttgggaggccagggcaggaggatcacttgagatcaggagttggagaccagcctgggcaacgtagcaagaccttgtgtctacaaaaaaaatttttttaggccgggcacggtggctcacacctgtaatcccagcactttgggaggctgaagcggacagatcacctgaagttaggagttcaagagcagcctggccaacgtggtggaaccctgtctctactaaaattacaaaaattagccaggcgtggtggcgcatgcctgtaatctcagctactcgggaggctgaggcaagagaattgcttgaacccaggaggcagaggttgcagtaagctgagatcatgc

SEQ ID NO: 154302 - DNA, 185 bp, Homo sapiens
acctacttccatccataccacttctctgcttctttcctcatgttacagttaaagaggaacctgttgtgtccttgctatgaaacctagctgtcttttccttagagatctatttctgtttcctgtcttctctctaacctttgtctttagcgtctttattttgagtcaccttttaaacttcctcaaat

SEQ ID NO: 154303 - DNA, 432 bp, Homo sapiens
ctgggaggacgcttggcagtgctgagtcagagcaggcgtggctggccctgcgcaccggtctctctcagctgtgtgtggttctctgaattcagaaggctctggggctcccccggcggctctgcatccaggtcatgccacccctcccagaaagccttcctttttccacatcagcactcaggctgtggtcagcgggagtgcagtgcggacgcctgagagcccatgtgctcttgaggtggctttgtagaacctactccctggcctcttaggaagtgactctcagcgggcagctcacgtctcatttcctgcgctttgctgaggtttctgtttgtggttgggggagtgtgggacctcacatgccttgccttgtgccagcggcatttgcagggcaattaagagcctgggctgcagacagagggcgagcatcactccctg

SEQ ID NO: 154304 - DNA, 328 bp, Homo sapiens
ttcctttgagtcctggatatgatcccttcaaactcctaccttctccatctctctgtcttcctcccctgtcagacttcttctcttaaactttagtccaccctgctgtcaagggactcagagtcctccaaaagtaagtaccaaggctgaagaggaaaaaaagactatttggaaatagactggatattttatccactcagatgggtggtggagacatttcgatagctgttagatgtctttgcagtgactcatttaacatttagtccacagccttcaaaagggcttcacagggcaaatgaagatcttaaaaaccttctccatgaatattggt

SEQ ID NO: 154305 - DNA, 376 bp, Homo sapiens
cttatggttctggggctcagaaatctgatgtggatctcactggctaaaatcaaatcaaggggattattgcttcgggggccaccttcattccttggctcatgacatgcttccatcctcagagccggcaatggccagtcaagtccttcttgcatcttatcactgaatcccctgcctccctcttccacgtttaagggacccttgtgattacagattacacaggacccacccacataatccaggctaatctttttattttgtggtcagatgattagtagccttaattccatctgctaccttgattcccccttgccatgtaacataacgtattcacagcttctgcaggttaggatgtggacatcttggatgcaggaagagc

SEQ ID NO: 154306 - DNA, 603 bp, Homo sapiens
gacaactgcagcagagggagaaatctgaaaacgctgcactgtggacgaagatggaggaaggggccatgaaccttgaaggcagctcacaagctgggaaaggcaaggacacagatttgcctcagagcccctggtgcgagcagagccctaccaccaccttagttttggcccagagaaactgacttcaagacttctggactccagaatataagtattaaatttctgttgttttaaaccaccaagactatagtcatttttctcggcagcaagaggaaaacaaggggaattccgagggcagggatgtgatctgatgtacattttggaaaggtcacccacccaatgccttgctttgtggagaaataatccgggagaagagcatcccggggaccagttgagaggccggagcccgagttggagagacagactctagagagttcgaagaagaagaggaaagtcgtgatgtggaaagcacaccctttggggaaagggtgtgctgccggatgaaacgtggggtgacaggcagagtcctggtgacgcacaggctgctggcgaggaccgcaacgtaggcagaggtgccaccttcacagttgctgaagtgaggaccag

SEQ ID NO: 154307 - DNA, 376 bp, Homo sapiens
ggcgacctagaggacccggaagaggtctttgcatattttggataacagtccttaattcaatatgtcttttgtaagattttctcccagtctgcggcttttcttttaattctcttgacaatgtcttttgcagagcagaaatttttaattttaatgaaatccagcttatcatttctgtcattcatggattgtgcctttggtgatatatctaaaaagtcatcaccaagtccaaggtcatctagattttctcctgtgtcatgttctaggagttttatagttttgcagtgttgttttgttttgttttggttttgagatggagttttgctcttgttgcccaggccagagtgcaatggtacaatctcgtctcaccaacctctgc

SEQ ID NO: 154308 - DNA, 387 bp, Homo sapiens
accagaaatgtgatttagctattaacaaaaaaacaaaactgaaagaggaagaggggtgacaggcacacataagacatgaatggctgcgaacaagttctcagacctggtgcgggagagaaggcacgggactcctcccaaagcttcctcctccagggctccctaacgagatacatgaaaagggaggggaaaaataaccacagtcttttagcttatcaatttctcacatccaactccaaacagcagaaatacaaagactgtctttttcactcctaacccaggaggaagaaggaaaagtgcttatttttagccaagccaaaaaacataagcagctacagattaataagaagcagagagaaaaaagaaccctcacaagagtattgtataaag

SEQ ID NO: 154309 - DNA, 111 bp, Homo sapiens
gctggggccatgtgtttttataaaaatatctacatgagtcacttaggatgcattcagttacagggaatagaaaactcaatttaattggcttcaacaagcaaatgtgttggt

SEQ ID NO: 154310 - DNA, 643 bp, Homo sapiens
catatatccaggctttcaacaatatcaacaaatacttattcagcacttgctatgtgttaggccctatttgaagcatctagcacacagcataaacaaaaacaaagccccaactctcaagaagcttatactctagtggaaagctatacacaaagtacagtagtgattaatgctcagcaaaataaaacaacagaaaataatagggcttaaatttaatcctcattctaggggcccaaaatatagcttactgtggaagactgatgtataagaataaaaaattagttgtcattatctgcatttttgaatcacccaaaaatggtcaagtttttcctacattattaggagggaggccgcaacaatgagaccagtgcactctctaccaacacagactaaagactaaatctcataaaataattagaaataaactaattcaacaatgtagaccacatataattttttctagctaacattatactttcatactagaaaaaaaaaaggcttaaaataaatattctattttatctagtccattctcagtcagaaagacctcagagtgggaacgggtccaggcgcagtggctcacacttataatcccaggagctggggaggctggagaggcctccaggcaggagagaggatcacttaa

SEQ ID NO: 154311 - DNA, 427 bp, Homo sapiens
ggccctatggccacccagcctgggcgttcctgcactaccctctgtgtgcctctgtgccaccgctgacagcaatgacgattggtgctattctttaaggaatgtttccgataccaaccgctgaacctacaagttgtttaagccttacaggaactctcagtcactctcctttaagagatgtggcaaaaagaggcatgggtttgcacagggcctctcctcaaggcctcctgacccaggctgggctttcctctccaagccagcctgcctcatccaaacctgtcccaagacctccctgtggggactgcccagccctctctccaggtaggtgataatgccttgttttccaaaggaaaaaattgaagctcagagagttcgggaagtcacttgtccaaactccgacacaggaagaagccaagcagcagaactgggt

SEQ ID NO: 154312 - DNA, 209 bp, Homo sapiens
tgtcccttgggagtgtgaaatccgagctaaaaccagaacttcactaatagaaaacgagttctctcttacccactaggagaaagagggaaggaaataagaaacaagtttttgtgagagtcacaaagacaattcatcagttagaaaatgagacctatgaggaaaagataaaggattccactggtatcatttagcaaagaaaagagattcta

SEQ ID NO: 154313 - DNA, 690 bp, Homo sapiens
ctgtaatctcagctactcaggaggctaaggtgggagaatcacctgaacccaggaagtggaggttgcagtgagccgagattgagccaattcactccagcctgggcaacagggcgagactccatcaccaaaaaaaaaaagaaaccctgaaatctccctgtaaagaaaccctctacctacactcatcttgtgatatcataaatactatttttattcttccagttgccaaaaaccttgtgtattaattatatattgtggcataacaaattgtcccaaaatttaacagtttaaaaagcacacatgtattatctcagttttgtgggtgaaaaatctggatatggcttagctgtcccctctgctttggtgtctttctcaaagaacagtcacactgttgactggtgccgtgctctcatctcatggcacaactgggaaggatgcactccaagctcacgtggttcaagattcagttcatcaggggtagttggactgacatcttcagttcctggctggctgttggtcaggggctgccctcagttccttgccatgtgggcctctcaacaaggcagattgcttcactgaagtgttaaagccaagaaagcaatggagagaatctgccagcaagacagaagtcacaatcttggtgatatatccacagaaatgagatcccatcaactttgccgtaatctattcatg

SEQ ID NO: 154314 - DNA, 417 bp, Homo sapiens
ctgtaatctcagctactcaggaggctaaggtgggagaatcacctgaacccaggaagtggaggttgcagtgagccgagattgagccaattcactccagcctgggcaacagggcgagactccatcaccaaaaaaaaaaagaaaccctgaaatctccctgtaaagaaaccctctacctacactcatcttgtgatatcataaatactatttttattcttccagttgccaaaaaccttgtgtattaattatatattgtggcataacaaattgtcccaaaatttaacagtttaaaaagcacacatgtattatctcagttttgtgggtgaaaaatctggatatggcttagctgtcccctctgctttggtgtctttctcaaagaacagtcaccagagctgaggaccatcgttgggggatcctcta

SEQ ID NO: 154315 - DNA, 403 bp, Homo sapiens
ctgtaatctcagctactcaggaggctaaggtgggagaatcacctgaacccaggaagtggaggttgcagtgagccgagattgagccaattcactccagcctgggcaacagggcgagactccatcaccaaaaaaaaaaagaaaccctgaaatctccctgtaaagaaaccctctacctacactcatcttgtgatatcataaatactatttttattcttccagttgccaaaaaccttgtgtattaattatatattgtggcataacaaattgtcccaaaatttaacagtttaaaaagcacacatgtattatctcagttttgtgggtgaaaaatctggatatacgggtacttgtatcttttgggtagaatgatttatttccctttgagtatatacccagtatggggatg

SEQ ID NO: 154316 - DNA, 1105 bp, Homo sapiens
tttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaagaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttt

SEQ ID NO: 154317 - DNA, 686 bp, Homo sapiens
taattttttgtatttttagtagagatggggtttcaccatgttagccaggatggtctcaatctcctgaccttgtgatcctcccgcctcggtctcccaaagtgctgggattacaggtgtgagccactacacccggccctgttgtttcattcttttatctttctgtttcatctcatttaatcaccacaataacccgacaagacaggaactattattatccccgtttttctttttctttttttcttttttatggcaggggggagtgcagtttcactcttgccacctaggctggagtgcaatggcgcaatctgggctcactgcaacctccgcctcctgtgttcaagtgattctcctgcctcagcctcccaagtagctgggattacaggcatgcaccaccacgcccagctaatttttgtttttagtgttttagagatgggatttcatcatgttggccaggctgatcttgaattcctgacctcaggtgatcagcccaccttggcctcctaaagtgttgggattacaggtgtgaaccaccacgcccaacctcattgtagttttaattcacattccctgatgatgagtgggttgactatttttccatatacctgtcggccatttgtatgtcttcttttgagaaatgtctatttaggttctttgctcattttaaaatcaggttgtcttcttgctat

SEQ ID NO: 154318 - DNA, 604 bp, Homo sapiens
cttcgcgaacgtgatacatcaatctgaaaacagagattggatggatacacacaccaaattttaataaaggtataagttggactagaagcagaacaaaggtgattttaactgtatttctaatattttaattattttaaaatagctgatgcaaaaatgacaaagattagcatttatttattctagatggttgatcacacatatttgaatattattttctaagtctgtagttttaagcatttcaaaatctaaagaataatttttaaaagctataaaaatatgaataaaggactagaaatcagtaacttttaattaatatgctggattctgggacaactttaaactcaacagtagtatttaccatggtgtcaaatttagcatttatcttgagttcacaaacttgagttcactaattttgtctctgtttttcaaatttctagcgtttacagactactataacaaccatactcttttaggctaagtgttggaagatagtaatagatttctggctgaaaaagaagtcttactttactaacgtaaatcccagatcactattcaagcccatcattctcaccgtcccttcacgtggtcatcgtgcccacctaca

SEQ ID NO: 154319 - DNA, 503 bp, Homo sapiens
gttaagtacaggatttccactcaggcccttttcaaacccatgtttcaattttgcaggtagtcagtatttgtcagcacccctgtaagcaggtggctgtcctggcttggtaggggagggactaacagagacccacatcctggaggacacagtgtggcgctcatggcagcacatggacactgagtggacgtgctgggctgcagaggtcccaccccccggcacagtgagagtgcgtctcggggcagcacacccactgaagctgggtgcttggggcagtgtcctgggagcctgacgggcggcgtcctgggatggccatagtgggggcccctggggctcctgagtggcagagcgcgacacagtggtcctggtgtgtagggagtcaccatgatactggcaccagctgatgtgggaggcaggtcactgtgttgcttgtcacccgtgggacagtgagcttggaagctggaccctcatgctcagcaggtgcttgcagcccaggagctgtggtc

SEQ ID NO: 154320 - DNA, 357 bp, Homo sapiens
cgcacaggcagtcctgagacttctagtttgaaagaatagaattgaccaggttagttagctatgactttgcaaagagtaaagtcccgaggtaaggagatatagggcagctaaatagtaagggataggggtttatgttaaggtgtggaacaagggatatcaagtgagtagttttttttttttttaatattgaagtatatattggaaacaaggccatatccaatgctacagtccaaaccaaacttttaaagccaagacagcggaatgaaacttactcttagccttcttcccttagctgttgagcagacttaacaaactctggtaagaaatccggcataggcaggaaccttacaaaaaaaa

SEQ ID NO: 154321 - DNA, 265 bp, Homo sapiens
gtgtgtgtgtaaaattacttcatgatatataaaacaataaaattggaagtggtctaaatatgctttgtaaaaccatagtttttattgaaggctaaatcaccacaaatttacactgtaacattaccagtattttattgtctcatctgacagaaggacttgtccttagtgtcagataagtagtttggtggaaaaagactcttgtgttaactcttgtcacaagtcaaggaagagtggctttcagggctattgatttgaaaggtagata

SEQ ID NO: 154322 - DNA, 361 bp, Homo sapiens
ctgttcagtttgccctccagccgccacctccttctattattggctgaatgaattagtgcaaaattagtagccaaaagggtagacagtgtgaatggaagggaggagaaggacagaaactttaatctccaggaaagcttatttatcctttaaaaaatggaaagttgggcaggcgcagtggctcacgcctgtaatgccagcactttgggaggccgaggcgggcagatcacgaggtcaggagatcgagaccatcctggctaacacagtgaaaccctgtctctactaaaaaaaaaaaatagaaaaagccaggcgtggtggcaggcgcctgtagtcccagctactcgggaggctgtggcaggagaat

SEQ ID NO: 154323 - DNA, 355 bp, Homo sapiens
aaataagaagagatctgtgaataagcaggaagagaactatgaacagtggtgacctgaaagtcaactgatcaaagcatttcaagaagaatggtgaactatgcagtatgatgctgataggttgagtaagataacttgagaattgactaatgtaaagatattggtgaccttgaactagctatttcagtgtaacaatagtggcagaagtctactctgagtgagcttacagaataatggaaacagatgaattacaaactgcaagtacagataactcaacaagttttgctacagttaccagagaaactgaatagctagaaggacatagctccaaggggataaagaataaagaaattttctc

SEQ ID NO: 154324 - DNA, 107 bp, Homo sapiens
cccttctgttggaacaagcatcctttctattaaaagcaataaatctcctcttatttaagtggcagatggtttagattgttacttttgctttcagcaatcctctagaa

SEQ ID NO: 154325 - DNA, 614 bp, Homo sapiens
gaaggtccaagagtcccaaagctgaactcggagtctgatgttcaagggtaggaagcatccggaactggacgaagtagtaggctggaagactaagccagtctagtcgttccaatttctcctgccttttattttggccacactggcagctgattagattgtgtccacccagattgagggtcggtctgcctttcccagtccactgactcaaatgttaatctcctttggcaacaccctcacagtcacactcgggaacaatactttgcatccttcaatccaatcaagttggcactcaatattaatcatcacatatttgagttttactatataccatcaaaggtcgatatctaagctgaaacatgaagagtgtagattaaccagattgtgtctggcaagtgtggaaatgttaggagagatgataaaggcaaaacgaggggcacaaagctataaagggatgagggcatggcaagttcaggaaacataagttcatctactagaatacagcattgggaaagaatggagctttcatttcatagaggtaaagctacagagagactcaaggggcacatcatgagaggtcttgtaagccactttagaagtttgagcttcagcctaaa

SEQ ID NO: 154326 - DNA, 418 bp, Homo sapiens
aaaaaagaaaaaaagaaaaggctttattagcaactgtatgcagacataaagtaacttttctctctgcctcatgttcaattctatatcagattggcaaaaaggaaaaatatttgactaatcaacttgaatttaataacgtgatctagggcaagtcatttaaattttccagaccttcttgtcctcatgtggtgtgatggactcaatgtttctgccttgccccgctcctctgccctgccaaattcatatattgaaacccaaatgcacaatgtgatggtattacttcccacagataactaggaggtaattaggttaagatgagccatgagggtgggattagtgtccttaaaagaagaggtagagactaaagctagcaagcactctccatctgtctctctccctctctgtctctccctgtcat

SEQ ID NO: 154327 - DNA, 337 bp, Homo sapiens
ggtcacccaaccaaggagtaaagaactgtgacttgaaccctgattctctgccaccaagcccaatgagaaaggcttacaactagtggtaggaaggatgattttcagtggttctcaacacaaatatgaaaaacagaaaggggatgcaagtgactcaagtttggaaaactgcacacgcccctctgctattctaactgaaagatgaaattaatagtaagcagggcattaatcactgatctcttcctaattcagatacttaatttttcttgtcttctttgattagctcctccaatagaataatagaatactgaatagagccataactgataatagctttatc

SEQ ID NO: 154328 - DNA, 331 bp, Homo sapiens
aagagaagcattcgtagaggaagattcatttgatctggtccttgaacagttgataaatgagtgggattgaccaggcaaagaggaggaacaaaggtattgacagcccagggaataacaggttcataggttaagagggcttgaggtatcaagtggtcacgtttacgggaaatgagagtgaaaatatatatgggcaacgggttgtagatgaccgtgtgtgccacatggagaggtaagaacttgactttacaggtgatggggaaatgatgatgatcttacaactatgatataacttgctttgcatttcgggagggtccctctgagaacagtgaag

SEQ ID NO: 154329 - DNA, 279 bp, Homo sapiens
agttggtatcatcaaccattttatttttcaacaatctaagcacatggaaaatggactcctgttttgatttgtgtagagaatcttttcattttctttttttcttttttttttttgtgacttccaagtccattaatgaaaatcacatgagataatgttgagctacttaaatatgctagtattccttgaataaatgaagcataaagctccaccagaagctatcagaacacacatttggcaagatgttaaatctgtgggagtttaaccaccttcgagtcaaag

SEQ ID NO: 154330 - DNA, 352 bp, Homo sapiens
gcttgtttattgttcttagggctggatattcgtatgttctgataagaactcaatcggctcagaaatgtcatttcttagattctactaaacgtttgtgtaggacctgtttaatgaaaacacaggttccattcagccatataaaatgacacatcacacaccacaaaaatagcccccttgttccaaaaacacagacattttacatttctacctgaagtgtacagacgctgactgaagctctgtgttgcagtgatgcgtgctgctaggattgtggctctgttttgcatttgctagccaggcttcggctttccagtcaggtattttttgttttgttgatgttgttgccgccgttggg

SEQ ID NO: 154331 - DNA, 473 bp, Homo sapiens
ttcttgtaaatattatgccagatacagcaaaaggcaaaggcacagttaaagacccggatcataatagctcagaaaatagatctgatccgggatttttttttagactaagcctgactccatttcaccccttaaacaattggctattacatcaggtcagaccatgtcctccccccattatccaaatcgctaatatttaaaactattaccatcaaatcaaaggactctagaaacaagccttcctagtcctgtgggaccctgccagatagccaaatcagacaactctaggaatgaggtttcctagcacgttgggacctgctggtgtttgttggtctacacatacattctatggaatgctttttggccaagagaggggactgaggactaagctatgattttttttatcttgcccaaattcctttctaaggggtctgggtaatcatgccctaaaaaccataaattctcatcagatgggt

SEQ ID NO: 154332 - DNA, 436 bp, Homo sapiens
actgtgttcttctctctctaaccagtgaatcacaaggtccaacctaggctgatttgcaacatcaacttttccctccttaccaccagtactcatttgggaatcttatcttttgattgtcatagtgaaagactcttctccttcctcagaaaggacccccatctctgctctggatgacaaaatctgtctaggatggtattaaaagtggctctacctctacggaactgatgtgtgattgatggcaccctacccaccttggacactcctgggttatatccccatagctaccttttccacagctctgttcagctatatatttctgagtggtattttcttttctttttttttttccactggactaactttgattttgatttgtggcattttttattatactttaagttctgggatacatgtgcagaatgtgcaggtttgttac

SEQ ID NO: 154333 - DNA, 286 bp, Homo sapiens
gcacctcaccataatacacattttaatactagccttatttctagttctattttagatacgtatcatcttttgtcatcatttttacctacttctaatttattgactgttatgttttaagcaactttaagaacaattatttgcatttgaggatgagctgtaaaatcttgattatttgatttagggtgtttgtaatatgtgaatgaaccagctgtacctgattctgtatagtcatgtaataagtatttattgatgtattcctgatggggatagaaagctttcagcaata

SEQ ID NO: 154334 - DNA, 406 bp, Homo sapiens
acacttatccccggcattttgtatttttagtagacggcatgctggccacgctggtctcaaactcctgacctcaagtgatctgcccaccttggactcctgaagggctgggactacaggcgtgagtcaccgtgcccggccatttttgtatttttaggacagcgttttttcatgttggccaggctggtctcaaactcctgacctcaagtgattcacccaccccggactcccaatatgctgggattccaggtgtgagttaccatgccccggctaccactttacttttcctgcaggctatcacagaacgtgtacaatctaggctctaatcaaccaaatcaacgtcttgccatcggagtttgctggtgaagggcacttggggtcctggaaataactgtaggctccaagccac

SEQ ID NO: 154335 - DNA, 453 bp, Homo sapiens
tttcacaatagagactggtctggctttttttccaaccgtgtggttgagaaatgtaagatgtaatactctacagtaaaatgccctttaccatcaactaagctgccagctagaaagcagcatggcccagtttagatcagcattcccccaaatctgtttccaaaacacgctagtgttctatgacattaaaaggtattactatgtaaaacataaatactagcagtatttttctctaaaaatgtactcttttaatatgccaggaagattaagggggtagacagctgtcatcatgcaacaacttgcctttaggaaacagcttaccatagcccagaatgccaggctgtggcatgaagccactcaacccacaagtgtgtgacatacattagagcactgaggcatgggagcatttaccaacagctatgatactgtgtgtgcaacatacagatcaagctgtga

SEQ ID NO: 154336 - DNA, 169 bp, Homo sapiens
ttgattcttttgcatacaaatatggctgaaaagttccaaatgcatatcagcttttttgttagactttggatatgtaagtgctttatttggttattactaaaatttcccagtgatttgtgtatttaactatttgtcttctgctttttttctccagtatactttatctatg

SEQ ID NO: 154337 - DNA, 558 bp, Homo sapiens
tatgctcattgtgaactaaggaaatggcagtgatggcatctcaaatagtggaccatggcacccgtcatgggggtatccctgctttttgtgcccattaaaggtttgccaagttcttctaaacagactcttcagcagtatagtgaccattatactacttcctcatagtgtggcttttgtaaaaaactaaaagaaaatgtcctggattgattttgtcaaaacagttacatgagaagtgtagataatgatggactctttcaaggattattcaaaccaaagtaaatactagatggcacggatggactactcaaatgtggtcagcagtactatccaatgctctacttataaaagactcctcttttggacagataacttgtagaagactgaaaagaaatatgtatacgtctgtatctatgaaatgtattgactttttttttattttttactgctttacttctggtaccattcctttattttgtcttaagaatctacactccttcatttttagttcatctagttcaggtgaagctgattttgccctagattcaaagccaaattgtg

SEQ ID NO: 154338 - DNA, 549 bp, Homo sapiens
aactcattaggcagtggttctgcacaaggaaaggaaagtctagaaggtgggctgctacactccccaccttccccacaaaatgctcagcaactacaaagggtatcactcagagacaagactgccattatccccatccccaactcaagtccccaggctctgagattttgcctaaaggaagaatcagcccataaacagataactcctaatctcttcccaaaggagctgaattcatttgcaacaaagcatagagaagttcaaacctgtctaggtgtggtggctcatgatgtaatcccagcactttgggaggccgaggcaggtagatcatttgaggtcaggagtttgagaccggcctgaccaacatggtgaaaccccgtctctctactaaaaatacaaaacaaaaattagctgggcatggtggcacatgcctgtaatctcagctacttgggaggctgaggcaggagaatcgcttgaactcaggaggtggaggttgcagtgagctgagtccacgccactgtggtacagcctaggtgacagagcgagactccgtct

SEQ ID NO: 154339 - DNA, 437 bp, Homo sapiens
tgaatgtcaatctccttcctatgggtccccatccattgctgtccacctacccaccatgcctagcctgggtgtccagcgcaacatccccagcgcggctccctcccaggtgggtccagccctcccccgtgggctctgagcagagtgaaatggctcggtgggttctgaggactgcctctgaactcgtgggttctgagcagaagaccatcctggggtctctccagccttcggggtagagtgcacagaggtccagatggagtgaggcactggccagctggaatctcagctcccctcaagccccatggacccagagtgaatcccctccctgttccggggctctgtgttctcttctgcacataggagctgcaagcctgccatgtactgttccttcagggcagctgtgagatggggttgggcaggagatgatagtatcatcctgc

SEQ ID NO: 154340 - DNA, 514 bp, Homo sapiens
ttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagttta

SEQ ID NO: 154341 - DNA, 115 bp, Homo sapiens
agagcattctctgaatgtgaacacatgctctcttgtacctgctcagccctcagtccacccatccccatgcctccactacactcagccactcagcaagtctaatgtcagggtcaag

SEQ ID NO: 154342 - DNA, 668 bp, Homo sapiens
gtgaggtgaaacatgaggatatcaattggcttgcctgtatgtaatgttaattcttgcatcatctttgacatatatgccataatctgtcagccacctggtctaagcatttctggaagactatgatctgatgtactgatggtacaaaaaagtgcacaagataataagtatcatagaagcgtattggaaacaaagcagacatcatcctacagaatgttagctctttctttgttacagttcaaaaatattgtcaaggaaatggagaaattcttgagcaaagcaattaattaaaatggtcgagatggtcaaagatgtttttgaagagatagagttaaaacaaattttaaaaaaaagaaaaacaggacagtttgttaatacagagaaaggcaaagaggtgtgtttcagacatgatggaatttgataattgtgaagggacctgaagagcccaaataatactttcagccaaaggtagcattagtttttaatacattgagtaataattttagggatcttgtcatcctaacaatggcccagttcctttgcttttgaactgggatttaaaaaaccagctaatagaagtcagttcctaaaacacagcagaactttattgacttgataaaacttttcaaagtatatagtgttaagaatttagtatttcttatttttacctc

SEQ ID NO: 154343 - DNA, 207 bp, Homo sapiens
tggcttgctgctaataaatacgtgggtaaatctctgttcggggctctcggctgtgaaggctgtgagacccctcatttcccacttcacacctctatatttctgtgtgtgtctttaattcctctagcgcctctgggttagggtctcccagaccgagctggtctcagcagtgtgtacaggttttccactttctatggttcctagattgtc

SEQ ID NO: 154344 - DNA, 239 bp, Homo sapiens
tatcttgggacctaaaccaatagatcatttgtaactgttgggctttggcgttaagaaacttttgtaggcatgctcctgactcctgagaaagtgggccctgattgattagtgtgacttgggtctaggcagcccatgtgtgcatctctgtggcagttgggctgagtaaacttgctaaatacatccagctctctgtaatacctggtgtaactctttaaaacttctgtttttttctgacgtga

SEQ ID NO: 154345 - DNA, 562 bp, Homo sapiens
atgttaagaacccataaattcattttttaaaaaagtcattcatcaacttcagaggttttaaggataccagcagttaagattcgtattaaaagggagaaaaagcaagtatttttcttgtgaatttatttcatattgttaagtaaaacaaaaagaagccacaatgtagaaatgtagaatgtgaaacaagtaaagtataaaacaatcaaaacaggatataaaagaatcaaaataataggtacatacataaaaaatacatggatataaaggtagagagagggcaatgtacagagaagacatggaaaggatggccaattcacaaagttacgtctgagataagcggttagggggtggtggtggacacaatgacattttcatagttagctagtatagtattacattgtttgaatctttagtaatcagaatatgtccatttcacttgtgtaataatggaggaggaaaaagccatacaatatgaaaagaaatgtaaatggctatacatacttgaagaaataatatatgaatcattactgagacggaataaatgctgaggttatacatactt

SEQ ID NO: 154346 - DNA, 354 bp, Homo sapiens
ctagtgttaaataactttttattagaatgtcctctctattgttaagttgccacattatatgaggaaactcacttcagtttttgtgccttggtttcgttgttgtaaaatggagagaatggtacctgttttgttattccatttaaaaaatcacttgatataatataagtggcagtgcttagaaaggaataaaaatagttacaccaatgctaggtggtgtttttgtttttactaagaaagtccctgaagtcaccctgctctccccaccacatacatacacagacacacacatacacacatgtacacgtgtcaggtctaacaatgaaatacccagttaaggcattttgattccatgaa

SEQ ID NO: 154347 - DNA, 575 bp, Homo sapiens
aagatgacccaaggctttaaaaaggacagacataacctagttgaagaaagatggaaaggacattccaggcaaaaggaaacaacgcatatgcaaaggcaaaggggtgagaggaacatgatgaaaccaggacaggattttctgtgacttatctattccatctcattgctttatattccacccatttacctcatatcaagtggaatgatgcaaccccaggcatttcaggaaatttacataaccaatcatttaatctcttaaagagaaaggcattgataatgcaggctttccatgagattaagcacgttcttgagtgaaaatagaattgggtgcttataggaaaccaggtggaaagctgatgaaaatcaggcagtggatggaaaatgcaatacatttgattttctattctctttccctgggaatttgagaagttggaatcctttgccatgagggtaaataaatctatgggccctcttagcctaaagatgaaatgactgaaggaaaaaaacagggtaattctaagaatttcatgtgaggccaaggtccattttgaaacccttttgaactaaacttttgca

SEQ ID NO: 154348 - DNA, 386 bp, Homo sapiens
tgatggtcctcagctcattcctacctcccagtttttgggaggccgaggcaggtggatcacaaggtcaagagattgagaacattttggccaacatggtgaaagcccgtctctactaaaaatacaaaaatcagttgggcatggtggcacactgtagtcccagcttcttgggaagctgaggaccatcgttgaacgatggtcctcatcgcgtcgggctctgtggctaggttcaactttggcaaaagggctcatttccttaaaatctgcctccacagacttggccaaaaacataacgttcctctctgtgcccttgatggcccctgggtgctgcccgggcttccttaccttctcccagatggaagcctgcccagccctgccccggcttctgg

SEQ ID NO: 154349 - DNA, 314 bp, Homo sapiens
acttgattttattggataaaggacaaaaaagttctatcattgtgagaacagatctatgtccaccttataaaataaccccagtcatcttaatttaaacactattgattggtaacccaaatgaaaatcaaaatcaataagagaatttttttttttcagagtgggatattatagactccatcctgaaactagttttagggaataaactttccagtcatataacctaatttatgccactttttatgaatgagtgacttgggctgggagaagagatagaaagttttgacaattttgaaaatgtaggaagtgataagatg

SEQ ID NO: 154350 - DNA, 499 bp, Homo sapiens
catgcccctcagactcaaaaattaccatcccaactcagacgcaaccatccctaaggcttcatttctgagccccctttactggttctgctctaaactcgtcccactggcccctcctggacctcagcctttacctgcacacatctatttccaggagtcttgaccactgtatcccactttaatgtaaacttccagcccctgtgattcttccatactcccgatccctatgtccttccttcaggctttaaccttctccccactctcagggaatgttctatcagtctcaggcccttctataacacaggttgcattcctggcccaattctgtctccacctccagttttctcttttaaatcaaatccagctgctcctcactctccctactctgtctgtgatataaagttctcaatcagatgggatcaaattgccagtttcaagcacaattcttagaacagttatggcatttccagggtagggagagtctgaaggcagtctggagggg

SEQ ID NO: 154351 - DNA, 128 bp, Homo sapiens
ggctctggaaagatgctgggaacacccagataaataagttatggttcttgccttcaagaagtccccaggtcggccaggcgcggtggctcatgcctgtaatcccagcactttgggaggccaaggcgggc

SEQ ID NO: 154352 - DNA, 490 bp, Homo sapiens
tcttcatctactaaaaatgaaagggattaaactagacgcctgctaaggtcctctccagacggtttccttgttaatcaagtcctgctctacgcagaagttaccaactggttctgtaacctataagacactagagaaaagtctgattccaggcttaaaaattggttttttgttttggagggttttattcatgtatttatttaaagacacggtttcatctgtcactcaggcggagtgccatcatagctcaccgcagccttgaactcccaggctcgagcaatcctcccgccttagcctcttgagtagttaggactacaggtgcgctccaccacgcccggctaatttttttttttttctgtagaaacagggtcttgctatgccacccaagttggtctgaaactcttggcctcaagtgacccttccacctcagcctctcaaagtgctggaattaaaggcgtttgagtcactgggtccagtctggtttttttttttt

SEQ ID NO: 154353 - DNA, 400 bp, Homo sapiens
ggccttccctctctgactgcagtgactcatttttcagaggaggatgaaaatagaatcaacctcagaggtttgcgatgaggacccaatgatgtcatgccaaaaagtacacatggcaagccttccagaaatgtcagctattattaggacttgtacttgtcctgcagatggcaatgctaagccccattttatacgaaaagaaagtaagattctgagaaaggaccacttaggcacacaagtaaagctagcagtgtcacacaacagccccacggtcactccttcacttaaaatcctcccatagctctggcctcatttatttttctttctttgtctctttttcttttctcttttctttttttttttttttttttttttttttttggaggatagggagtatggctgt

SEQ ID NO: 154354 - DNA, 785 bp, Homo sapiens
  misc_feature (642)..(642): n is a, c, g, or t
tgatcttcctgctttggcctctcaaagtgctgagattacaggcatgagccaccacacctggccctttattacatttctacacttccttttaaacttccctttgggctgggaacagggactcacgcttgtaaactcagcactttgggaggctgaggcagacagaacacttgaggtcaggagcttgagactggcctggccaacatggtgaaatctcgtttctactaaaaatatataaattagctgggtgtggtggcatgtgcctgtaatcccaggtacttgggaggccaaggcaggagtattgcttgaacccaggaggcagaggtttgcgatgaggacccaatgatgtcatgccaaaaagtacacatggcaagccttccagaaatgtcagctattattaggacttgtacttgtcctgcagatggcaatgctaagccccattttatacgaaaagaaagtaagattctgagaaaggaccacttaggcacacaagtaaagctagcagtgtcacacaacagccccacggtcactccttcacttaaaatcctcccatagctctggcctcatttatttttctttctttgtctctttttcttttctcttttctttttttttttttttttttttttttttttaaaaaatttntttttggggcccccccccctaaattcaaaaacggggttagggttttttcttgggaaaaatttttttccctctccccgggcggggggggaaaaaaaattttcccaaagaagggttttttttctttgggggggcttggggggttc

SEQ ID NO: 154355 - DNA, 349 bp, Homo sapiens
ctcccgggtttaagtaattctcctgcctcagcctcctgagtagctgggattacaggtgcctgccaacatgcccggctaatttttgtatttttagtagagacagggtttcaccatgttggtcaggctggtctcaaactcctgacctcatgatccaaccgcctcggcctcccaaagtgctgggattacaggcatgagccaccgcacccggccccgctcctttctgtagatctgcctggttgtctcatcctgtggacatgcgagatgctcagtctagctttcatagtagggtttgagctgttatctcacctgcagtcttttctccttgcttgtctgaataccatttgctcaa

SEQ ID NO: 154356 - DNA, 660 bp, Homo sapiens
  misc_feature (446)..(446): n is a, c, g, or t
  misc_feature (478)..(478): n is a, c, g, or t
  misc_feature (487)..(487): n is a, c, g, or t
  misc_feature (500)..(500): n is a, c, g, or t
  misc_feature (506)..(506): n is a, c, g, or t
  misc_feature (511)..(511): n is a, c, g, or t
cacaagttaaagataatgcaattagataaacaagtcagtccattgatatgcagactgcaacccaaactctctgaggaattaaaaacaactctccttgtcttgcaaattgtttacaaaaataggacgtgcctctaaaagcaattcaaagcccacttattctaactaaccccaaatctcacctattcatctcaggatgccagcaaatgctgttcaacatcaggacattgaaatcagtactgtcctgcacttaagaaggaaaagccgaaataataattaccctaggcctctagtaggcaaataagccccccaaactctgtttttttgtgaaaatttacattacttctctatgcctttgagatacacattccctaactagtattacctgagaaactatcccttttaaaatgcttttaactggtgacaagaaggaagaagcctatagttanatatcccagaaatttatttgatgtttgcttgnatacatttnatatagaaagatngggatngtttnccttggatgcccctggccaatctcgtgaggcattgaactagaaacggggtgcccatctggagacatcagcgatggaaatcacacgcccgattttagcacgattccttaagatttcgtctctagtgttatcgagcccactcccttaacat

SEQ ID NO: 154357 - DNA, 531 bp, Homo sapiens
tcctttcaaggatatttacatctagaaggggaggtaagtcttcactctagtgtaaggcagaagagacagagaaattgtggcagtggggagtgtcaccaagtaggaatattaattcttgtggggagaatgaggaagtttcattaaggaggaaacatgtatagtagatatttcaggacatgtagggtttggttaggcagaaagagagggaaggggaggaaggatcccatgtggaataaaccatgttaccaggacaagagaggataggatatattagagaaatagtgaacagtcctatgtggttggagggcaggagacagtggtagttgcagtgacacatgagttggaaaggtcaccaactgccaaattatggagggccttgagtccagggtagggaatgaaggtttatttaataaagtacaggaagctactcaagatctttgcataagaaagtgaagcaatcccagctcaacagggtgtagagaatgatcaggagactgactatgccctaggtggtgtgtcctgtgtaaagta

SEQ ID NO: 154358 - DNA, 450 bp, Homo sapiens
gggaaaagagaagagaagggagggagagcaatagaaacactgaaaaggtaatgggtagaaatttctgaaaaactaagaaaaacaataaagcagcttagagaatccaacacatgataattataaatgataacacacctatatgcatcatagtaaaactgctgaaaaccaaagttaaagaaaaaactcctgaaggcagccaaagaaaagaaaaaaaagaaacattacatatagacaaaaaaaaaaagaatttcaaaagatatcttttcagaagtatataaatgagaggatactggagcaatatctttaacgtaatggtggaaaactgtcaacccagaattgaatacccacctaaaacacttcagaaaccaaagcatatagatacctttacacaagcaagagctgagaaatgtcattcccagcagattgcactgcaagaaattatttaagtag

SEQ ID NO: 154359 - DNA, 401 bp, Homo sapiens
ggtcagaggagaggattcttgggcccatgtggagagaatggcttctgatagtagggagagttccttagtggtattaaaaaggaagagagagagagcgaaggtatagatccagtaggtttgtagttttgctgaggggaagaaaagagagttcccatgtgatggcttttatattctctgtgaattgtgggacaaggccttctcctgacagtgggggcaagagaaaggagtcaagtctatagaagttttgaggagtgaagcaaaggtaagacgtgttcacaatgagtggaggaaatgaaagagtaaggtcaccaataataaatcatgaggtgggaaggcccaggggaagcttgtgaactgagttttggatgtgatgatttggaagggacattagagcatacagg

SEQ ID NO: 154360 - DNA, 522 bp, Homo sapiens
acgcaagcaatctcttgccctttttccacgttaccctttaaaataacctttgttcagtggtacatttagttaaggcatttgtattcaaatgtagcatagtatttgcagagaaattaccttttaaaacatctcaaaagtgttttctaaaatgatgaaataaacagtggggttctgtctatggtgggattgtcagtttattaggtgagtattttccaaggtcacagtttgtgaaaaaatggtgctatgtacaagtggagtttgttgggatagacaatcacttacaaagcccagatggccagaagggaattggtgttgctcctttcacttgtatggttgagcagatttgtcacatgccacaaaaccattctttgtagtcatgcttagtatgagcttgctttgttgttacggtcatgttctttccagccctgccccagctatgaattgtctaagtgtgagggagcatcagagcttcagtattgtttaaagaatgtagaaaaatacaaatttgtctaattttgaaac

SEQ ID NO: 154361 - DNA, 279 bp, Homo sapiens
tgatagattcaggctgtgcacgtttggcgggaataccacaaaagggaggttgcgtgtcctccttactgcatcatatcagaaggcacattccatctgtttgttccattactggtgattttcactgtgatcacttaaggtggtgcctgccaggtttccttagtattttctgctttgaaatgaataaatatcttatggggaagtattttaagactatatacaaattctcttaatcattaagctttcaccaactagttttaacattcattggtcatttttgtc

SEQ ID NO: 154362 - DNA, 349 bp, Homo sapiens
atattctttattcttggcctgtgcatactactgactctgaacagataggaattgtctttagggctgagttaacctgagggtcatctgtcaaagtaggactgtgttccaaacttctactaaacctaattagaccttgtgcagtgtgatacatgattattgtttagtttataacatttaaaggaaaatgttatgagaaggctggctgtggtttatttccctgtatcttctttttaacatagatcatctacagttaagtattgtagtacttagtgatggttcagagacagcaaagacacccttttacagcacttagattcccacataagactgacatgatggctcaaatatt

SEQ ID NO: 154363 - DNA, 555 bp, Homo sapiens
ccagaaactgatgtcaaactgggacctgatgtctactacctggggactaggtatccatgtgaggcttgatgttcatccgcggccagacgtccatctgatgcttgatgtccgcctcagtcctgggtgtctactggagacctcatgtccaactagagcttaggaacctactgggggcctcgtgtaaacctggggactggtatgcagctgggtcctaatgatcccctgggtcatattattcacctagtgcctggtgacacttagggcttgagtgtcaaccttaggtcttgttttcatctttgacctggtgtccacctgggacttgggtatcgacctgaggacttggtgtccaattgaggtgtcatgaccacctggggactgaatgtcaatctggagtctgatgtaaacctctagttcagtatacacctgggcatggtcttcacttggggcctgctgtctacctgggccttgctgtcaacctggggcccgatgtaaacctctagttcagtatccacctggggccagatgtcttcctagagacttatattcacttttgac

SEQ ID NO: 154364 - DNA, 2460 bp, Homo sapiens
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctgggggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgtttt

SEQ ID NO: 154365 - DNA, 5758 bp, Homo sapiens
  misc_feature (3024)..(3024): n is a, c, g, or t
  misc_feature (3029)..(3030): n is a, c, g, or t
  misc_feature (3056)..(3056): n is a, c, g, or t
  misc_feature (3059)..(3059): n is a, c, g, or t
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcagtgacccaggaggctctcacgtggagtccccagaacagcatcaactcctcacgatgctcctgacggtggtggacagactctccatgccccgatgaagttgacttgctgtgctcagatcctccattcaagagagctacagacacgggggtgctggtgagcaggagccgagaccatctggggtgggaccgaccaagagtttgaggtgtccagggggtgacgtgaagatgacctattgcagagggtcccttctcattcacgctctgaagtctgcacaggggcaggggctaccgtgctccatttcagtttggcctctgttgtacagccgagcagcagaactctatggtcactcccccgngtcanngacaatttgccacctccaccggcagncangctctgcctgaatattctcgcctgatcgtaggattgtggggagggatattctcattgatctctaaggaaaatattgttcgctttttaaaaacatgatctggtaccatttcattgatctctttaaggaagaaaaatcacatggttgtcatgagcatgtaccgacagagctaggagggccagctgttccgggttgcccagggctgtcttgtttttaaaatggaaagttcgatgtcctggaaaacccctcagtcctgggcaaaccaggtcacgctggatagaaggagttagacattcatatgatgtgccgatgtcttgccagttgtagagttttgtgtaaacctgtgtgtggcctgcgtgtccacatgggtgtgtaggatggcacctacacacatacctgaggtcacctcttggtccagtgagccagaatcctgggacttcatcatctttttttttttttttttgagatggaatctcactctgtcacccaggctggagggcagtggcgcaatcttggctcactgcaacctccgcctctggggctcaagcaattctcctgcctcagcctcccgagtagctgggattataggcgtgtgccaccacgccctgctgatttttgtattttttagtagagatggtgtttcactatattggccaggctggtcttgaactcctgacctcaagtgatctgcctgccttggcctcccgaaatgctggggttacaggcatgagctaccatgcccggcctcagaatcctgggacttctgctggagccaggggtcagaacagactcctctactgggactgcctggcagggaggacagacgctcaaggcggccccatgagaacacagccacctggaaaaatggtggaagggaagattctgccaacctcctccgactccctatctcagttacactggtccataatttcttttctttttcttaagtctgtttcattggtttctgttcctggaaaatggacacaattctgatgaattcatgtattctgcatccacgtgtcagcatctccagccttgtgacgcagtgcctggctcagaacaggcaatcaggccatggcatctgaatgaatgagagggtgtgccctggccgtatctcaggcagcagatgcattcagctgcaggtaacagacacgtagacaaacagtggcttaaaaaagagaggctttaaaagtattttgtttttctttcttcacgtagcaagaagtctggcatttggcattcccaggctgtggcgtgacagctttgtgaagttatcagggtctcagaccctgacatatttctgctctgctaccctcagcatgtagatttgatcttcacggctacaagaaacctgctgctactgcaggcatcttacacgagttccaggcaggaagagaaaggaaagggtgacagagacagaaagcaatgtccccagatacccttagttttccatctcataagccagaatgatgtcacgtggcatccctggatgcacaggaggctgagagatagtggcgtttgttagctggtctcctagccatcctgaatgccaagtttgttataaagaaacagaggcaaaatggcgatcaggcaggcaactgggtggtctctgccacgggccccttggccattctttgtaatgatggtctttgtcttggaccctattttggatatttgggcacctttgtggtacccttatgtgctggttttgctgttgtctgcccttcaggaatagcagctgagtcaagctgtccttggctgctccaatctggagtcagaggttggagatttccatggctccccatggctccttggggcctcctaagaaaatgttttaataaggaagtccaaggctgagacagacatgctccttcttagagacacatgggaacatgcctctgctcacagctggtagccacagatgtaaaccgtagcccatggaacggagacagtgaagaattgatggataaatgaataatgatgatggacagcagatgtataaaaggcataaaaggatagtgttagggctggaatgtcttccccccaattcatatgttgaacctttaatgcctaatacttcagaaagagactgtgtttgaagatatggtctttacagagggaataaagttaaaataaggtcattagggtgagccctaatccaaaggatgggtgtcctaatcagaggaggagattaggacccagacacacacacacacacagagccaggtgaggacacagggagaaaatggccacgtacaagccaagatgagaggactcaggaagaaccagccgactccacccttcaaaactgtgagaacatagatgtctgctgtttgagccaccctgtctgcaagcagtcagcaagcattcattgagtgcttgcagtattcaaggcaccacagatacaatgttgaataaggcaaagcacctgccctcaggtagcttgcagtcagggaggtaagggtagtgggcagagagacctggaaacagatattagacctgcactaagcatgtgtggttattgaacagtaaaaatgccaccacaaattgcgatatgatgtaagtaaaatgcgtactggctattgaagacttggcacagaaaaataatgtaaaatctcattagtaatggttttatattgattacgcattgaaataatactattttggacagattgggttaaataaaatattaaatttgaat

SEQ ID NO: 154366 - DNA, 2840 bp, Homo sapiens
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggcaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctgccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgtttt

SEQ ID NO: 154367 - DNA, 1066 bp, Homo sapiens
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggcaacaaccccgatgtgatgattcctgcgtattccaagaaccgggcctatgccatcttcttcatagtcttcactgtgataggccatgtttccatttgataggggacgcccccggcgctgtgctatcctgtgccggccacccttgcgttggtt

SEQ ID NO: 154368 - DNA, 450 bp, Homo sapiens
gtgagaacgcacccatgtggaactcagggttcctgccggcttgcgtggcaggggaggctggcccccacctggggatcacctggtctcagggtccaggcaggctccccactacatagatagggcggttaccatcatcctctctggaaaggagacggcctgtgatggcaggctccttctacaacaagggttcctttctggaatgctgtggtcagccctcggcaatggagctttgagcagattcgtgatctccccagtcacgagtgtccacgctcaggcagcgccaactcccgtgcttcggactggggaagctcctgaccagcctctgggccctgagggctgctggctcctgtgttttcatgtttctgtcccctttccaggactttgagcttcaccatcttcttgatcctgtttttggcttttatcgagaccccatcctcactcaccagcacg

SEQ ID NO: 154369 - DNA, 160 bp, Homo sapiens
tcaggatgggagtgggatcaggtactgagcttgtcagtttctgttatttcttttttcttttagtgatgattcctgcgtattccaagaaccgggcctatgccatcttcttcatagtcttcactgtgataggtgagtgcaggtaacgtggccagcattttgt

SEQ ID NO: 154370 - DNA, 653 bp, Homo sapiens
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaaggtagggcacccgtggtcagggtctgggaatggggctgccctgtgctgtgactaacagagggggctgggctggtgtctgctg

SEQ ID NO: 154371 - DNA, 5860 bp, Homo sapiens
  misc_feature (3126)..(3126): n is a, c, g, or t
  misc_feature (3131)..(3132): n is a, c, g, or t
  misc_feature (3158)..(3158): n is a, c, g, or t
  misc_feature (3161)..(3161): n is a, c, g, or t
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggcaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcagtgacccaggaggctctcacgtggagtccccagaacagcatcaactcctcacgatgctcctgacggtggtggacagactctccatgccccgatgaagttgacttgctgtgctcagatcctccattcaagagagctacagacacgggggtgctggtgagcaggagccgagaccatctggggtgggaccgaccaagagtttgaggtgtccagggggtgacgtgaagatgacctattgcagagggtcccttctcattcacgctctgaagtctgcacaggggcaggggctaccgtgctccatttcagtttggcctctgttgtacagccgagcagcagaactctatggtcactcccccgngtcanngacaatttgccacctccaccggcagncangctctgcctgaatattctcgcctgatcgtaggattgtggggagggatattctcattgatctctaaggaaaatattgttcgctttttaaaaacatgatctggtaccatttcattgatctctttaaggaagaaaaatcacatggttgtcatgagcatgtaccgacagagctaggagggccagctgttccgggttgcccagggctgtcttgtttttaaaatggaaagttcgatgtcctggaaaacccctcagtcctgggcaaaccaggtcacgctggatagaaggagttagacattcatatgatgtgccgatgtcttgccagttgtagagttttgtgtaaacctgtgtgtggcctgcgtgtccacatgggtgtgtaggatggcacctacacacatacctgaggtcacctcttggtccagtgagccagaatcctgggacttcatcatctttttttttttttttttgagatggaatctcactctgtcacccaggctggagggcagtggcgcaatcttggctcactgcaacctccgcctctggggctcaagcaattctcctgcctcagcctcccgagtagctgggattataggcgtgtgccaccacgccctgctgatttttgtattttttagtagagatggtgtttcactatattggccaggctggtcttgaactcctgacctcaagtgatctgcctgccttggcctcccgaaatgctggggttacaggcatgagctaccatgcccggcctcagaatcctgggacttctgctggagccaggggtcagaacagactcctctactgggactgcctggcagggaggacagacgctcaaggcggccccatgagaacacagccacctggaaaaatggtggaagggaagattctgccaacctcctccgactccctatctcagttacactggtccataatttcttttctttttcttaagtctgtttcattggtttctgttcctggaaaatggacacaattctgatgaattcatgtattctgcatccacgtgtcagcatctccagccttgtgacgcagtgcctggctcagaacaggcaatcaggccatggcatctgaatgaatgagagggtgtgccctggccgtatctcaggcagcagatgcattcagctgcaggtaacagacacgtagacaaacagtggcttaaaaaagagaggctttaaaagtattttgtttttctttcttcacgtagcaagaagtctggcatttggcattcccaggctgtggcgtgacagctttgtgaagttatcagggtctcagaccctgacatatttctgctctgctaccctcagcatgtagatttgatcttcacggctacaagaaacctgctgctactgcaggcatcttacacgagttccaggcaggaagagaaaggaaagggtgacagagacagaaagcaatgtccccagatacccttagttttccatctcataagccagaatgatgtcacgtggcatccctggatgcacaggaggctgagagatagtggcgtttgttagctggtctcctagccatcctgaatgccaagtttgttataaagaaacagaggcaaaatggcgatcaggcaggcaactgggtggtctctgccacgggccccttggccattctttgtaatgatggtctttgtcttggaccctattttggatatttgggcacctttgtggtacccttatgtgctggttttgctgttgtctgcccttcaggaatagcagctgagtcaagctgtccttggctgctccaatctggagtcagaggttggagatttccatggctccccatggctccttggggcctcctaagaaaatgttttaataaggaagtccaaggctgagacagacatgctccttcttagagacacatgggaacatgcctctgctcacagctggtagccacagatgtaaaccgtagcccatggaacggagacagtgaagaattgatggataaatgaataatgatgatggacagcagatgtataaaaggcataaaaggatagtgttagggctggaatgtcttccccccaattcatatgttgaacctttaatgcctaatacttcagaaagagactgtgtttgaagatatggtctttacagagggaataaagttaaaataaggtcattagggtgagccctaatccaaaggatgggtgtcctaatcagaggaggagattaggacccagacacacacacacacacagagccaggtgaggacacagggagaaaatggccacgtacaagccaagatgagaggactcaggaagaaccagccgactccacccttcaaaactgtgagaacatagatgtctgctgtttgagccaccctgtctgcaagcagtcagcaagcattcattgagtgcttgcagtattcaaggcaccacagatacaatgttgaataaggcaaagcacctgccctcaggtagcttgcagtcagggaggtaagggtagtgggcagagagacctggaaacagatattagacctgcactaagcatgtgtggttattgaacagtaaaaatgccaccacaaattgcgatatgatgtaagtaaaatgcgtactggctattgaagacttggcacagaaaaataatgtaaaatctcattagtaatggttttatattgattacgcattgaaataatactattttggacagattgggttaaataaaatattaaatttgaat

SEQ ID NO: 154372 - DNA, 5605 bp, Homo sapiens
  misc_feature (2871)..(2871): n is a, c, g, or t
  misc_feature (2876)..(2877): n is a, c, g, or t
  misc_feature (2903)..(2903): n is a, c, g, or t
  misc_feature (2906)..(2906): n is a, c, g, or t
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggcaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcagtgacccaggaggctctcacgtggagtccccagaacagcatcaactcctcacgatgctcctgacggtggtggacagactctccatgccccgatgaagttgacttgctgtgctcagatcctccattcaagagagctacagacacgggggtgctggtgagcaggagccgagaccatctggggtgggaccgaccaagagtttgaggtgtccagggggtgacgtgaagatgacctattgcagagggtcccttctcattcacgctctgaagtctgcacaggggcaggggctaccgtgctccatttcagtttggcctctgttgtacagccgagcagcagaactctatggtcactcccccgngtcanngacaatttgccacctccaccggcagncangctctgcctgaatattctcgcctgatcgtaggattgtggggagggatattctcattgatctctaaggaaaatattgttcgctttttaaaaacatgatctggtaccatttcattgatctctttaaggaagaaaaatcacatggttgtcatgagcatgtaccgacagagctaggagggccagctgttccgggttgcccagggctgtcttgtttttaaaatggaaagttcgatgtcctggaaaacccctcagtcctgggcaaaccaggtcacgctggatagaaggagttagacattcatatgatgtgccgatgtcttgccagttgtagagttttgtgtaaacctgtgtgtggcctgcgtgtccacatgggtgtgtaggatggcacctacacacatacctgaggtcacctcttggtccagtgagccagaatcctgggacttcatcatctttttttttttttttttgagatggaatctcactctgtcacccaggctggagggcagtggcgcaatcttggctcactgcaacctccgcctctggggctcaagcaattctcctgcctcagcctcccgagtagctgggattataggcgtgtgccaccacgccctgctgatttttgtattttttagtagagatggtgtttcactatattggccaggctggtcttgaactcctgacctcaagtgatctgcctgccttggcctcccgaaatgctggggttacaggcatgagctaccatgcccggcctcagaatcctgggacttctgctggagccaggggtcagaacagactcctctactgggactgcctggcagggaggacagacgctcaaggcggccccatgagaacacagccacctggaaaaatggtggaagggaagattctgccaacctcctccgactccctatctcagttacactggtccataatttcttttctttttcttaagtctgtttcattggtttctgttcctggaaaatggacacaattctgatgaattcatgtattctgcatccacgtgtcagcatctccagccttgtgacgcagtgcctggctcagaacaggcaatcaggccatggcatctgaatgaatgagagggtgtgccctggccgtatctcaggcagcagatgcattcagctgcaggtaacagacacgtagacaaacagtggcttaaaaaagagaggctttaaaagtattttgtttttctttcttcacgtagcaagaagtctggcatttggcattcccaggctgtggcgtgacagctttgtgaagttatcagggtctcagaccctgacatatttctgctctgctaccctcagcatgtagatttgatcttcacggctacaagaaacctgctgctactgcaggcatcttacacgagttccaggcaggaagagaaaggaaagggtgacagagacagaaagcaatgtccccagatacccttagttttccatctcataagccagaatgatgtcacgtggcatccctggatgcacaggaggctgagagatagtggcgtttgttagctggtctcctagccatcctgaatgccaagtttgttataaagaaacagaggcaaaatggcgatcaggcaggcaactgggtggtctctgccacgggccccttggccattctttgtaatgatggtctttgtcttggaccctattttggatatttgggcacctttgtggtacccttatgtgctggttttgctgttgtctgcccttcaggaatagcagctgagtcaagctgtccttggctgctccaatctggagtcagaggttggagatttccatggctccccatggctccttggggcctcctaagaaaatgttttaataaggaagtccaaggctgagacagacatgctccttcttagagacacatgggaacatgcctctgctcacagctggtagccacagatgtaaaccgtagcccatggaacggagacagtgaagaattgatggataaatgaataatgatgatggacagcagatgtataaaaggcataaaaggatagtgttagggctggaatgtcttccccccaattcatatgttgaacctttaatgcctaatacttcagaaagagactgtgtttgaagatatggtctttacagagggaataaagttaaaataaggtcattagggtgagccctaatccaaaggatgggtgtcctaatcagaggaggagattaggacccagacacacacacacacacagagccaggtgaggacacagggagaaaatggccacgtacaagccaagatgagaggactcaggaagaaccagccgactccacccttcaaaactgtgagaacatagatgtctgctgtttgagccaccctgtctgcaagcagtcagcaagcattcattgagtgcttgcagtattcaaggcaccacagatacaatgttgaataaggcaaagcacctgccctcaggtagcttgcagtcagggaggtaagggtagtgggcagagagacctggaaacagatattagacctgcactaagcatgtgtggttattgaacagtaaaaatgccaccacaaattgcgatatgatgtaagtaaaatgcgtactggctattgaagacttggcacagaaaaataatgtaaaatctcattagtaatggttttatattgattacgcattgaaataatactattttggacagattgggttaaataaaatattaaatttgaat

SEQ ID NO: 154373 - DNA, 1758 bp, Homo sapiens
agcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggcaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctgctgaaagaagtcctgacatctggaaccaacccgtggggtccaggaccaagctctgatttctccccaaaagccccttttggggagaatgtgttagagatgagctttataataattccttt

SEQ ID NO: 154374 - DNA, 233 bp, Homo sapiens
aattgagagaggctttctggtgataaaatttgaactgatttctggagaatgggtttaattccaatagggggagatggaccaaatttaattttgatgagggaaatgtcttgagcaaaatctagaaaaggaaaatatgcccattttaagttttaatgagtggtccagttggggtacagtgcaagaagagagttctagtgaaaaggtagttggtctgataggtgagggtcttgcag

SEQ ID NO: 154375 - DNA, 205 bp, Homo sapiens
accaccaggcccatcttctccagaatgaaacccccctgagggtcctgcccttggtgggccaccttcactctcatacagagaacagaggggctcagcttgttaaggaaacttcccttaacacctctcaccacattgcagattctcaaagagactgggaattgagcttatcacccctccccaagatgtagattctgtcccccaactc

SEQ ID NO: 154376 - DNA, 315 bp, Homo sapiens
cggtccccaagaagacactctggatatatctgagtcaagtgattagaggctttttccctccttcacatactgctctctgactgagatgtgatctgtgcagttaactttgctgcctcctttccactgttgggtatttttgtccttttcttttgtttctttttttttttttttttttgagatggagttttgctcttgttgcccaggctggagtgcagtggtgcgatcttggttcactgtaacctctgcctctgggttcaagcaattctcctgtgtcagcctcctgagtagctgggattacaggcgcccaccaccacg

SEQ ID NO: 154377 - DNA, 746 bp, Homo sapiens
tagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcga

SEQ ID NO: 154378 - DNA, 507 bp, Homo sapiens
aattaattgcttatgatgtattttcaggtcagaatttgagttataaaggtcatagagatcatctaatataattatcatcattctcaagatgaggaaaagttttcttagaaacattatttggcatttgtttctacttggataaaatatagcatgcatattaaaactattttcctttgctgtgctatgcccaaatggaataacataacttagtgctaaagatgttttatgactagtttactcaaatttttattatctgtacctcttatttgatacaggtaaatttaacagattgggaagactaatatcatttggctattgattacttatagaaagttattctcaaagtcttttggaacttttacttcttatattagaaatcatattttcttataaatactgactttaatgctaatgtaatgatagttgtaggaatattacaaataacagtttagtactcatgagagaagtaattcgtctgtctttcactgattaacaaaatttaagggc

SEQ ID NO: 154379 - DNA, 474 bp, Homo sapiens
tgataaaaaataaatgaataatgaaggacaaaaagaagcttagtatgagtcatatacaggaaacaaaattcaaatattcaaatgtgataggaaagtgtggaagacaattctctaatcctattgaaatttaaaaacagggaacagtatttgtgaaaagaggaaattactcagagaaaacttcaggtagaaaactagtatacaccagggcttcaaagggtactagatgaaatttgaccaaaagagcaaaaaatactctaggtagaacatcaacatcccaataaaggcacagaaagatacttattaaagacaagtatagtaaattgcaaggttaaagagtttggattccttggtgtggtagctcacgcctgtaatcccagcactttgggaggccaaggtgggtggatcacttgagcccaggagtttgagtccagcatgggtaacatagcgagaccccatctttactaaaacaatttt

SEQ ID NO: 154380 - DNA, 302 bp, Homo sapiens
  misc_feature (31)..(31): n is a, c, g, or t
ggcaggcagtgatgctgaggtgatctagagnatccctgctcatttcttcaatatttaacctctctaaaggaaaaacagccaaaccattttaaaaacaaagatctttctcgcctcaaccctttccctcttctccccttcacaaaccttgttccatgccttgtcttccgatgaaccacaattctccactgaaccgaggtgagagtgatttgtgcaactatcactccactgaagttgaaacttcaatctttttaaagttcagaggctacttgtctcattgacacataatggggtagggtaccgac

SEQ ID NO: 154381 - DNA, 603 bp, Homo sapiens
gtggagcaggctgaaggtcaaagggggctccaggccatagcatgggccctgcctgaagcctggataggaagctgggattttctcttcaatacgcagtaagtttcttgccccgtggttgccttatctgtagctaggggcaaagacaataagagagctttctcggcggaggttgcagtgagctgagattgagccattgcactccagcctgggcaacaagaacaagacaccgtctcaaaaaaaaaaatttttttttttgggcagagcttggtaacacacgcctgtaatcccagcatttggggaggccagggcaggcagtccacctgaggtcaggagtccgagaccagccgggccaacttgttgaaaccccttctgtactaaaattacaaaatttagccatgcttggtgtggtgtgcctgtggtcacagctactcaggaagctgaggcaggagagtcgcttgaccctgggaggtggagtttgcagtgagtgagctgagattacgccattgctttccagccggggtaccagagtgagactccgtcttaaaaaacaattttttatgggggtggctttactcagcattattatttggaccttcagcctca

SEQ ID NO: 154382 - DNA, 323 bp, Homo sapiens
gtggagcaggctgaaggtcaaagggggctccaggccatagcatgggccctgcctgaagcctggataggaagctgggattttctcttcaatacgcagtaagtttcttgccccgtggttgccttatctgtagctaggggcaaagacaataagagagctttctcggcggaggttgcagtgagctcacaatgaacatacctattaaaacagctaaaatgaaagagactgtacacaccaaatgctggtgaagatgtgcaggaattagtaactttatatactgctgatgagaatgtaaaatggtacaaccattttggaaaataatgtgg

SEQ ID NO: 154383 - DNA, 277 bp, Homo sapiens
gcatcaactatgtgcaatttacaattaaatcactgtgctaagagctattgataatataaagatgtctaagagaatatttttggcctttcaatagccatttcatgtacttaaataatatattttagaagttgtcacaagttagccaagccacaagccaaattagggatggtgaagaaaatggaagatggtcaggatgcccactttttcttcttctttttctccagagctgaagtatgaacttcattatgtctgcagacaacagtggcactgccttgac

SEQ ID NO: 154384 - DNA, 455 bp, Homo sapiens
cccctccatcccggggaggcattataaaggtatttgtagaattcagatggttttgaatttaaaaaaagataataccaggggggctagttattaaacaagataggaaacaccaggtgctcagtaactatatcaagagatttaatttgtctaaggctgggcgtggtggctcatgcctgcaatctcagcactctgggaggccgaggtgggcagatcacgaggtcaagagatcaagaccatcctggccaacgtggtgaaaccccgtctccactaaaaatacaaaagttaggtgggcatggtggcacatgcctgtatcccggggaggaggaaaataaatttatggtttgcagaatgcagggcccagcgagggtgtaatttgtcaccttgataaaagaaactgtgcagcaactcgtgctttttctgacgtcagaaggacaacggaaataaaacctgagctc

SEQ ID NO: 154385 - DNA, 343 bp, Homo sapiens
agtcttcaggaatatttacaggactgtatagaattaggagccatcaaaggggatccctgaattctttctgtttttcttacaaataccagttttaaggtcaagatttactaccccatgcaacagtgtagccgcattttaaattttaaatttttgactgtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaagga

SEQ ID NO: 154386 - DNA, 235 bp, Homo sapiens
gtaagagtagaatgagggggtaagtgacttcctatacctctgtattatcttaaattttataatgggcacttaaaaaaaccaataaacaaaattatctatgttacacagcatcactttccaaacacaaatagttaacgtgataccttcatctacaaaagcaccattctttcccctttgtttactgggtgactttcttaaaaggtcccagagacttttttttttttctttttttttt

SEQ ID NO: 154387 - DNA, 493 bp, Homo sapiens
aggaccttaaagggaatcttatccaatgatattaggcctgccttaaaaagaattcagacatgatatgttgataccaatcatgttttccatactggtaatggtagaatttgtgttttaccatggacagctattattaaacttatagactatttttatattttaatattttttctttgtttccttttaggagttgttaaacaatcctgaaatttcccctacaatatgccatgaactaatcatattttctcaaagtcatttgacgtaatgattgattaaaggaaatatctccagtataattacacttgttcataacaaaaaagtatttgaaacttcaagaaaaaattagaaaaattaataatgaaatatgaacaaataaatgtatgaaatatataattaatccctaataaatgtgcatgaaattatagtcatagaattaagagtgatgtaatttttcaactaaagatgcattctgaattataatagaaaaaggttt

SEQ ID NO: 154388 - DNA, 725 bp, Homo sapiens
actttataacatcactgttgagagctcaggcacccttttctacaccaggtctacctagatggttatatgacctaagtccccagtccacatgctcaacatgaagacctaatcagaagactggaggctgatgagccacaacccttcccacctccccactgcttacccatgtattcccaatagggaagcagcctgatatgatgtttccatcatatcagagcacaggatttattgcctaatgccattgtcaccccttgctcaagtgtgtgacatgaacctcagttttctcacctacatctcctttgctgtttggctgtaaggactaaaagaatggacggaaattactgggcctattaaggcattcgatgactgatggctcttccatggtccaatggataatctcatgcctcctactcaagaagtgtctccaaaggtttctatgaattctcaagcctccaggaaactgattaatggttaattgagcaacttgttcagtgccatgtgataaattaatgaccaagtagaaatcaacccactcaaccccagaacatcaatcaaatgtttccctatgtttctagtcttactggcatctgagtcacatccaaatcccaggtgagctctctttgccaacaaaatgtgtttgtagatctttgattccaatctactacatgaatcagcaaagggagctgagaatataaagtgtctggcaggtgccctcattcctgaac

SEQ ID NO: 154389 - DNA, 437 bp, Homo sapiens
gtttgcctgtaggatttttatttgtttgcttgagtcggattctggaaacttttaaagcagagcagctgttttccacttttgcctcaggactcatcactcctatactctgccgattaatttatacatttatgttacctgcttaacctccatgaatattgcaatacttccctaacagccaatgatttctgaatatgcttagaaggtgttgccctggtgagaatggttatagccaaaagcggagaaaaaaattcttgggctcgaaatctttgaacattcatccagcatcccatcctttacctcactggcatggatgcagcaaccaggttccatcttggaagcagagactgggccctcatcagacacaggacctgccagcacctcgatcttgtacatccagcctcaagaactgtgagagataaatttctgttctttataag

SEQ ID NO: 154390 - DNA, 265 bp, Homo sapiens
ggcgaggctctgaggcttcatcacgatggccaagaaagggtttatgttgctctcactcattcattcagcaatcctggccactgggtactcaggagagagtaccctaatgagggaggcagattgtcaacaaaaactacaattactaggagccccaactgggagaagcacaggaggtcacaggagcccaggaaggtgactgaccaagcctgcagggtcacggaagcctcccagagggaggtagcagctgagacacaaagagtccctg

SEQ ID NO: 154391 - DNA, 668 bp, Homo sapiens
tgcaggggtgccccagggctcttctttctgttctacactccctgggagatcttatacaacctccaggtttaaacccatctatctatcgatgacgcccagatttatatctctagtctggacctctgccctaaactccaatttatatatccctctaaacaggcaacagctcttctcaaacctaacatgcacaaagcctgttccctgattttttcccacctgcttgccaacctgctcttcctgtgttagttctattccttgcttcactcaagcaaaacaccttagagtttctttgtctcccctttctctcacatcccacatccaacccatcagcagatatcttcagttctgccttcaaaagtatgtgaagtatatgatcggactacttcctttcaccttcacaccctcaccttggccatctctctcctgggttattccaggagcctcctacctgttcttcctgcttcctctttgctcttcttcaatctgttcacatcactcctctgcctaaaaccttctaaaggttccccatctcagaggaaaagctaaaattgctgtcatgtcccatggggctctacacatctgtcacagcagggcccaccctgatgctgtgctcccatctcctccctcagtccttgggtcacctttgtctagccacacctgcctccttg

SEQ ID NO: 154392 - DNA, 564 bp, Homo sapiens
aatactgctgtgacgagatcctagaaatcctatgtactatgcataaaggagagggctgtgggttgccagacttttttgctgtagcatcttaactccaaaggtcctgggtctggggcactcaccaggcattcggtcgtccagtgtgtgctggtgtccctgggtttgagttgtccttctctcctctcccttcacataccttttatgggtctctcccaggctcataggccaagagtagaaagctctgggcttctgagttgcagagtgagttggtgttaactgaagtcactttgtctagagtgggtgtgtcctctgcctctgttaaatggcatcccctgggactgaggccaagctgttgtgtgaggtactggctggcaaaagaccaatcctggccaatatggagaagctctccaattgagaggctccttttgttgatcccagctggcagggaaggggccattgacagataactcccctccatcatttattttgagtattttcatctgaggcacgaggaatgttaacgactttgaacccatttatttcaagtgtgttggaaagcagtcg

SEQ ID NO: 154393 - DNA, 542 bp, Homo sapiens
gggacaaattataaaatgggtagccaagtgggaagagatatatttatatctacaccgcatgtcatatagaagaataactttcaaacaggtcaaaatttaaatgtaaaaaagtattatataactggtatttattgttttttgctcaatggtaagtatattatgaacacagggccatgtcaagaaataagttctatacttctgccatttcatttttaatatttgcatagtacttcacttaacaaattatcataatttgtttaactgctgttgatagacattctaggatgtttacaattttttacttttatacacaaagcttaaatgactgcttatgactatttggggattagttaacagagcaacacaacaaatttctcaaaactgaattttggttctattagtgttctacagctgctgtaagaaattaccacaaatgtggttgcttaaaacaacaggaatgtattctctcacagctctggaggccagaagtccaacatcactaccactgtaccagaatcaaggtggaggtggggccacactca

SEQ ID NO: 154394 - DNA, 452 bp, Homo sapiens
gagtcttgctccgttgctcaggctggagtgaggggcacaatcttggctcactgcaacctttcgcctcccgggttcaagtgattctcctgcttcatcctccccagtagctggggttacaggcatgtgccaccatgcccagctaatttttgtatttctagtagagacatggtttctccatgttgtccaggctgatctcgaactcctgacctcatgggacttcagtctagctccaaatctagtgctcttgcagtcaattcatattttcttctgttactgaccatatgaaataattcctctatgaaatttatgtgcaatttttataaaagtctaaatgtattttatggctaaccctcaactatggagcatattaacattaaaatgagttcttgaaataagagttgattaacatgggaaaatatccatctctttcatcttgaacaaagtagttttgt

SEQ ID NO: 154395 - DNA, 116 bp, Homo sapiens
ctaccaacccattgatattatcattatttatatgcacaaagcttccagaacttcactttgccagactttctagctaaggaggtctcaagaagatgctaaaagaagcttccagtaag

SEQ ID NO: 154396 - DNA, 218 bp, Homo sapiens
tgtggcagtactggggaggcctcttagcaccagcacacagatccaagcaagaccccataaacaagaggctggggcaagaaaagctgaagtgtacacacggtaaggagacaaccctgtttttccaggccccctgggccttcagggcagttacttgacttcttatggagaaaatcacatctagaaacacttttccacccagacttcactcccccatacac

SEQ ID NO: 154397 - DNA, 334 bp, Homo sapiens
agtgagcacgagagtttgaggaggcagtgagctatgatcatgcccactgcactctaggctggacaacagagcaagactctgtctctccagaaaaaaggtctcaaattactaatctaagcttccacattaaggaaccagaaaaagagcaaaatcaaaccaaagtaagcaaaaacaacaaaaagaaagcaaaaatcaatgaaatagaagaaaaaatagaaaaaaaatcaaggaaactaaatgctgattcttcaaaacgattttttaaaaactgacatacctatataacaaactcacaaagaaaaggaacatataaacatataaattatcagtatca

SEQ ID NO: 154398 - DNA, 263 bp, Homo sapiens
gtaaagcccgagcctgactgtctgatctcccacggcacccaatcagctgggctcctctgagcaggaagcgatgtcagatttaagtgagttttgtaggatccctgggaaaagcagagacaggtggcaggcagtacagcctcagagttcaatagagcatgcccaaatctccatccaactaccctccagttatctggccacttgattccttatctagaaacacagtgaagagccaggcgcagtagctcacacctgtaatcccagca

SEQ ID NO: 154399 - DNA, 384 bp, Homo sapiens
ttggccatttactttctgtgtggccttagacaagttacctatttttctgaatctcctttcttgaacctttttgtaaattaaaaaaaaaaaaaaattaggctgggcgtggtggctcacgcatgtaatcccagtgctttgggaggctgaggtgggtggatcgcttgaggtcaggagttcaagaccagcctggccaacatggtgaaaccccatttccactaaaaatataaaaattagccaggcatggtggctcattcctgcaatcccagctacttgggaggctgaggcaggagaacccgggaggcagaagttgcagtgagctgagatcgcactactgcactccagcctgggcaacagagcgagactccatctcaattaaaagaaaaa

SEQ ID NO: 154400 - DNA, 269 bp, Homo sapiens
ctcgggtgatcctgttgccttggcctcccaaagtgctgggattacaggtgtgagccaccctgccagccagtgctgggatgaatataagcaaaaggtgtaacctgggggcagagaggaaggagcctcactaagcctgggggtagggtagtgataatgaggaggagcatgaggggtcagctgttgaacaatgaggaggggatattcaaggtggagaggacagcgtgcaccaacacatggctcttgtgatttagaaaggagcatcagcaaca

SEQ ID NO: 154401 - DNA, 215 bp, Homo sapiens
ggaaaatgcaagagacgtgaaggcctgttcttcctatccctagaggttgagattgcctggggagaaggaactagaatagggaatggccatagaatgaacccgcattggcagacacatgtgaacacaggccttggcatagagccactgggcctgggcagtctggaacatggactatggtgctcaggtcaggtggttgggccctgaccccacccact

SEQ ID NO: 154402 - DNA, 315 bp, Homo sapiens
atacatgtaattgttgcttaatctattccttgtttgctaagaaagcaggccaccccaggccctccttgccctgaccagtctgggttcttgccactgccagggaagttggtctttgaccattttcaaactgctgcttcctctctgcttccagctttgaaagccaacacatcctcctgtgaggggacaagacaagcagggatatgtgggccactggatctttgccagacttcccagctgcagccaagttcttagggttccgtcagcgctgcatccccaggagcctctgcctcagtgagtgtcctctggagcccccaa

SEQ ID NO: 154403 - DNA, 397 bp, Homo sapiens
atgcttacctagcatagatactctggcaggcattgctcaaagcaatttacatcaatggctttataagcctgtaagaatcattcccattttacagatttggaaactgaggcatagagagagaaaacagtgataacataaccactgcagttgcattttaggaatctgaaacatattaaaagatgtaataaattcttgcattatatgcaatatttgaaatagggcaaactgtctctattttaaccatttttccagaagagcctaatttcatagaggttctattttcttggcagggtgcggtggctcatgcctgtaatctcagcactttgggaggccaaggcgggtggatcacctaaggtcaggagttcgaggccagcctggccaacatggtgaaacccca

SEQ ID NO: 154404 - DNA, 170 bp, Homo sapiens
cattagggaagagaaagcaggtgacctctagataatactagagattggaggtgactgggtggagccacatgaatgattattagacacgtgggaacttcaagcagcaggtttgactgaagccacggtgggggcggtggaggaggagatagagaggatctcatctgttctct

SEQ ID NO: 154405 - DNA, 347 bp, Homo sapiens
ccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggagg

SEQ ID NO: 154406 - DNA, 274 bp, Homo sapiens
ttctttcttctcaatgatctttaaattgatcttgaaacttttctactgccgcttggtcagcaaacactatttctcctattatcttgacatttttgaagccaaatatctttctaaaattatcgaaccatcctttgctggcattattctccagctttagatctttcacctttcttttgttttaagttgttatataatgaatttgctttttctggaatcatattggattctatatgcttttcttatagcaatcctgcattcacataaaagatgcatt

SEQ ID NO: 154407 - DNA, 123 bp, Homo sapiens
agaactaagatggatcttctgacttgcttccctggcagcctatccagtgttctttctactagattggccactgtaataaaaataacatcctaacgtaaccatttcctttattagatcttttgg

SEQ ID NO: 154408 - DNA, 310 bp, Homo sapiens
cctggcttataatgtcattcctaaagatgacagagctggtgagataggtcacacttcgaggagaacaaagtagtagtttcaactggtctgtggtgcgacccagacattagcccacatgtaacactccccaggtgattccaatgggcagccagggttaacactgccctgtctggtaacatccgccacatagataaaaccttgcctgttctcatttaaaaagctcatcacttcctactcccaagacttgttcaaaatcccattagtcccagcatcctccataggatgaaggggggcggaggagctggggtcc

SEQ ID NO: 154409 - DNA, 362 bp, Homo sapiens
  misc_feature (74)..(74): n is a, c, g, or t
caccggtttactggacttctggcatacctggaccttctggcatacctggaccttctggcatacctggaccttcngtatgtgtcctgctttgtgccagtactggagatatggtgaacaagtaggccgagtttagagtttaacaggctaggcagccaacggcatggagcaggaaacatacagaagggttcgggcttggttttctggaagtcgtgagtattcagaagaaacctgaaagattcatgcgggtttagacagacggttgctagacagcatgcgtgactaggaagaatgagacaagagcagtcgatttcccaggaactgaacctcagtgaggtcagatcatggaatagaaggtccaggta

SEQ ID NO: 154410 - DNA, 315 bp, Homo sapiens
atctctctgaaaaacccatcaaaatactttcctgcctcagcaagaatgacttaaatataatttaacttgttacccttattatgtaaccattttaactttctgaaatgtaacttaagcataatctaatcaatcccctaaataaccagtgtgtgtggagacagacagacatgggccaacaacattttggtcaacaatggactgcatatatcatgagggttccataacactgtaatagtgtatttacagtattactatatttttccatctttagatacacacctatttgccactgtatgataactgcctacagtattc

SEQ ID NO: 154411 - DNA, 514 bp, Homo sapiens
ggtccattcatgtaacagtatttacatggtattaattgttcctaatgctgcataggagtgtgtaaagtgaatgacccacattgtactcccatgatggacatattgttcctacccactatcagccaacactaagacacttgaatttaaacattctcttacgtgctttctaaggtgagaatttatgtgggagtgggattgctagacagaggtccattttgacttagtcacttacatttgttcatttgactgagtactgtcagatggcataacagaatgtctgccccgggccacactgccaccagctgtgcacaggattcttccccaacatccctaccagtagttgaccttatccatttttctattttcttgccagtctaggtataaaagatatcttgttgttataattttcatttcaggggggttactaagaaatttgagtattagtttaaatgcttggtatttattttggttttcctttttgtagaatcctattcatgtcctttgcctatttttc

SEQ ID NO: 154412 - DNA, 418 bp, Homo sapiens
cttcctgatccaccctcctcggcctcccaaagtgctgggattacaggcgtgagccactgtgtccggccaaaaccacgtttttttagagcagttttaggtttatggaaaaatcgagcagacagaatagagttcccatatctccgtcctccctgcacacagtttccactattattgacaccttgcattagtgtggtacacatgtgataattgatgagccaatattgatacactagtattaactaaagttcatagtttacattcagattcatcctttctacagttctgtgggttttgacaaatgcgtaatgtcatgtctccaacattacagtaacatgcagagtaccttcactacactaaaaatccattttgctttacctatttattcctcctcaccccctccctcgcccccagttcctgg

SEQ ID NO: 154413 - DNA, 439 bp, Homo sapiens
ggctctcaaggaccaccaggtagggaaacaattcttggagaatctcttatgtgaacacagtagagagaaagatcctgtaccctgaactagtactgaaaaaagaaagattagctgtccttcattatttgcgctgtagggtatacaggcaacaaaacccagtgagaacatttaataaaacattgtcactttcatatccccaaatttcttccttgccctttatcacttcccagctgtctccagattttattttgtatccacttgagctatgaggtcagagttaagccttcaggaatgtgtctctctataggcagaaacctgactcttcctgaaaaaacccttagtagaccttgggaaaactgcagttgctatcacatgtacagagagagcttttgcagtcactggactttaaatgttctttttgttggactgccaaaaggtt

SEQ ID NO: 154414 - DNA, 421 bp, Homo sapiens
aagcaagcaaacaaacaaacaaaataaccagaaataagtttaaaattcaacatgcgttttaaagatacggaaatcataaaagctgagcaaaaggtcaataggcttttctttgaagcagggaaggggttgaatcagatttgctctttggagccctgcctggagttagggtaggcacaaatggggagggactgaggctggggcccttcaaacgtggttgcaattgtccagtctagagaagacacagcctggactgatgcagtcgaggtggggtagagatgaagaccagatgcagtttgggagacagtttcgtgatctcattttcttgatttgtttgtacatgcctcttaattgtttccattcccgcccttctcatcccacctctcatcccatctttggtccaccaccgccatcgggaacatcc

SEQ ID NO: 154415 - DNA, 236 bp, Homo sapiens
gggtgcagggaatagaaacatatagattagtttaagctggaatcagcgagacaggaatgaatgattgaatgaagttaaacaaggatttatcggaaggatatggaatacgtaatagaagccaaggcttgaaaaccagatgggcattaggagagactggaactggcaaatggagaactactgggagccaagggacttagcgtattttattgcatctaaggcagcagtgatcgtaaaag

SEQ ID NO: 154416 - DNA, 349 bp, Homo sapiens
cctgaacttcagaaggtgctcacgggcacccctgaaagagaaaccttatgctgccttaagacgtctcagtttctgcttataatgaagtagcatcgggaaagaggacaggtcattagccttggcccctttgtttggttttaacctgtgtttttgcattctgagctggttttcttcactggcagcaggccctccggtgtagaaggttctgccctcctctttgaaggcaggcctgaacagtgtgtgcgtggtggggctgttgattcactctggctcacgtcttccttaccccacattctgttgaaacccacattccaggagggccccaagcccctcccgcagctctaggcac

SEQ ID NO: 154417 - DNA, 458 bp, Homo sapiens
tgggtggaacagagcaaaatggtgagagatttcattatgctactcagaatggcatgcaatttcaaacttatgtttatttcaggaattttccgtttaatatgtttggacctcggatgtccatgggtaactgaaactggaaagcagaactgtgaatgggggtactgtgttaagaaaaccgatgggtttccttttagttgcctttatgtaccttcttcttcccattctgattctatgcttgcatggcatatttggcttcatgtattgcattctatagggcaaacatgccactgactgatccactttgcttttttcgattctcagagtaaataattgtgcatactgattttattgtttagtctctgaggttgataggtttgagcctgaccctgagtgatggctctgtgctgggtatatagaaaagatcaggctcagcttaccaggcagaagcctaaatccct

SEQ ID NO: 154418 - DNA, 476 bp, Homo sapiens
tgggtggaacagagcaaaatggtgagagatttcattatgctactcagaatggcatgcaatttcaaacttatgtttatttcaggaattttccgtttaatatgtttggacctcggatgtccatgggtaactgaaactggaaagcagaactgtgaatgggggtactgtgttaagaaaaccgatgggtttccttttagttgcctttatgtaccttcttcttcccattctgattctatgcttgcatggcatatttggcttcatgtattgcattctatagggcaaacatgccactgactgatccactttgcttttttcgattctcagagtaaataattgtgcatactgattttattgtttagtctctgaggttgataggtttgagcctgaccctgagtgatggctctgtgctgggtatatagaaaagatcaggctcagagactaaacaataaaatcagtatgcccaatatgggggtaccgag

SEQ ID NO: 154419 - DNA, 270 bp, Homo sapiens
aaatatcacgagtatgccccaaaccacagaagttcattaagaagaataaaaaggtgatctagatgaagaataaatcaaccaactaagcatgaaacaagtttcttcagaatggaagttctttctgactgccatgatgaaactgtgaatcaagagagattgacaaaatataactgccaggattaactatgctgtttttacctggatgggagaagggcaggcaaatctcccagaggtaattatttctcacaatgaactgagatttatcagaat

SEQ ID NO: 154420 - DNA, 400 bp, Homo sapiens
tgtgttgttactgactatgccaaacaaggatgaactgggtttgggaaggtaaaaagagctattgaaaaggaaggccatagaaatcaactcatctcgggacatttaatctacactggaacttttttcactgagccacagtgagattgcaagatgatggctatgaaagtgatttagaatagaacaaactttatgagcattaaagcgggctaattgtgaaacacttttttcagtaagcatttaattttccaggcctctatttgcctctttgaggaataccaagatgaaataataagctaacttcatggccttaaagagcgtttattctccgggtgaatatattattgcaaagttacctctcctcacccttcactctactgccatctgcattccacccaccact

SEQ ID NO: 154421 - DNA, 179 bp, Homo sapiens
ttgggattacaggcttgagccacaacgcccggccctgactgcatttcttatgaacttcattttgtatggagaacatccctccatcccacatagaagatttatagtatgaaacattctacactagctgacaaatggcatggagccctactcccatatttgtgataagcaggaagtcagca

SEQ ID NO: 154422 - DNA, 573 bp, Homo sapiens
aaggatttaatggtcaaagcttgtgtgaattattatcatgaattaaactaatgaaaggatgaagatattgttaacagaagttctgaaatgctaaccttgccatttctgtcatgagatgagaaatcaatgtccaaataacatgtgcagttaaagctttaacaggaaataagtgccacagaatctacagaaagaggtttttcctatctctcaacaaaaaatatatgaatggaggtaaggtggagaaaggggacaatagtaaaaatcatgccccaaatggaaatgaaattagcaccctgagaatgaattgagaagagtaaaaattaacgttcagccatttgtagaatattgtgagcccataggtgtgtatatatataaaatgtgtatatatacatatatataacgtgtgtatatatatgtgtgtgtgtacatatgtatagtgtgtatataaaacacatatatgggtgtatatacatatataatgtatgggtgtatatacatacataatgtatgggtgtttatacatacacatatataatgtgtgtgtgtgtgtgtgtgtgtgtgtgtgtgtgtgtg

SEQ ID NO: 154423 - DNA, 472 bp, Homo sapiens
ctgtagatgagggtgttttgagcctgggactgaaggtgccacaagcagtgtctctttcctagtctgtcttcactttccactccctataccagcctgatgtctcggctctctccttcacaactgtatggtcacctgtcctcagaaaactgagtgctttggcacaggggcaccttatgagaaggggtggttaggccagaggaacctccactaactctcccactagttttggaaatatacctgagaagcacacaagaatttagggagggcagagtctggttatggcttggagatggagatctttgatgtttcaggcaatgggtgattggtaacagaggtgcgggaaggggattatggctgatgtggtagggtgatagggagaggccaaggtggccgtatctatccagtctgtgtggcctcaagcttgcagatgggtggggagagattgtaaatgctgcaatctttttgaggcaca

SEQ ID NO: 154424 - DNA, 383 bp, Homo sapiens
gttcaagcaattctcctgcctcagcctcccgagtagctgggattacaggcacatgccaccatgcccagctaatttttgtattttaagtaaagacaggggtttctccatgttggccaggctgatctctcaaactcctgacctcaagtaatccacctgccttggcctcccaaagtgctgggattacaggcatgagccaccatgcctggccaaaagatatgtttacttaacaagagggagtaggctggcttaaaaacattggtgatagtacaggtggtattaggatgtggcaggaaacgtgggggcggagctctgggaatgtaagaagcttagaaaggacccacctgacccattcatgccccagtctatgcaggaccctttgctgc

SEQ ID NO: 154425 - DNA, 644 bp, Homo sapiens
tctcatgaaacacagggccataaccaggagaaagaattctgaaaaaaaacaaaaaggtatctcaatgcctccaaatattacttggattaagttatagggataaaatagaccctcctacattttcagttttttttttgagactgagtctcactctgtcgcccaggctggaggttgcagtgagctgagatcgtgccacagcactccagccggggtgacaaagtgagatccatctcacaaaaaagggaaaacctttttcagtattctcatgctaggggtacctcacgggagacggtgtgcaagaaagaaaatttttcagctatgtgttttattggacatggaccaacggatcattgggctcaaatctgaagcaagtgaaccagaagacaggatgtgggccactaacagggaaccagggatataactgggttccaataggacaccgtctcgacatcatcattaaattagatcattaacgagggatgaccgaaggatatacggggtccgaatactgttacaataacgcaacaagggccatgggcaggtccaccacctgggaccaagtggacacccactgattgagccgccacggcgccaacttcatttctcagtccaagatccaaagcctggaagaaattccaaacatg

SEQ ID NO: 154426 - DNA, 176 bp, Homo sapiens
taggctctggaaatagtgcggtgattaaaacagacctctgaccttggggagttacaatcagagaagaaagatattatacacctaattgcaaaaattaagttatcacaagcatacaatattttatgaagaaaatgtacaggatgccaaattcttttttttttttttttttttttaag

SEQ ID NO: 154427 - DNA, 718 bp, Homo sapiens
cgcatttccggcctttgtagtttatcattctttgggctgcggttgtcaaggattcagagcagatgtgatctgcgctaggtggcatctcctctcacggatgcctcggtgagcttcggagtcgggctaccgctgaggggcttcggaagggccagtctgtgcactgcgacctggactgggtgtggggatttggcggcagggtcttcttggccagagatgggccgggcaggtgaagggcagaggaggttgctccgcagcctggaagggctttgttaaccaaaagtcagcgtcgttgcccctacccctttcccccaccctatgtctgttcctgagctcttcaacctctctgccctgtactgatggcactctgaactctccgtatctgcatcttaggattcaaatagattcggatatgaagaaatgtttgtattttccgatgtcttattctctactgtggacttattttaaagaatgagcagggatagttttaaactatgccacagcctttcttagtctaactcacatagtataaaggctcttgctgctatcgaattttttaaaagaataaatagcatctactatgtgccagcccagcactgttctaagcactttacaaatattatctgcttctcataactctatgagatagacactattattatgtagactacaccccacctctctgtcccgcccctttttaaaattaacatacaagaagaaa

SEQ ID NO: 154428 - DNA, 669 bp, Homo sapiens
cgcatttccggcctttgtagtttatcattctttgggctgcggttgtcaaggattcagagcagatgtgatctgcgctaggtggcatctcctctcacggatgcctcggtcctgagccatgctcatgaacaggaagagtttgtaaaggagaaggcaactccaggagcagctcaggagtcatcaaatgaccaattccaaaccttggaagagcaacttgggtataatttgcgagaggtgtgcccagttcaagagattgatggcaaggctgggacttggaatgtggagttagccccaaagagggagatttctcaggaagtgaaatctcttatacaagttcttggaaaacagaatggtaatattactcagattcctgagtatggagatacctgtgaccgtgagggcagattggaaaagcaaagggtgagctcttcagtggagagaccctatatctgtagtgaatgtggaaaaagcttcacccagaattccatccttatcgagcaccagagaacacacacaggtgagaagccttatgaatgtgatgagtgtgggcgggccttcagccagaggtcaggcctattccagcaccagagactccacactggggagaagcgctaccagtgcagtgtttgtggcaaagccttcagccagaatgccgggcttttccatcacctc

SEQ ID NO: 154429 - DNA, 451 bp, Homo sapiens
ctatcaagacctaactaaatattttgcagacataggaaaatctatcctaaaattcatatggaatctcaagggacccaaaggtccctcgccaaagcaatcttgaaaagttagaacaaagttgaaagagtcacactttaagtcaaaacttactacaaagccacagtaatcaaaacagtgtggtgctgacagaatgacaggcatatggacccatgaaatacagtagagatcccagaaataaacactttcgtatgctcaaataattttagacaaaggtgccaaaaccattcaatgaggaatggacaagcttttcaacacatggtgctggaaaactggtctccacatgcaaaagaatgaagttgggcccttaaaccatacacaaaaaattaacccaaaacaaatcaaagacctaaatgtaagacctaaaactataaaactcttagaaaaaaacagg

SEQ ID NO: 154430 - DNA, 561 bp, Homo sapiens
gagactgcctggacgggaagtggttgtgaaggtacgaatgcttcatttccacctgaaagaccccaacttgaaaatcaacaaggaacaatatgataagcagaatatttacagatatggggagtacataaccaaaagatcggctaaaagaattgagcaggaaatagggagaggtgggctggagggccactgtatttcacaaaggcttgagaacccctgactctttagaccacaggcatcccaatgtcgataaaggaaaaatacatttaaaactataaccaaggctggcgtggtggctcatgctggtaatcccagcactttgggaggccaaggtggacagatcacctgaggtcaggggtttgagaccagcctgaccaacgtggtgaaaccatctctactaaaaatacaaaattagctgggtgtggtggtgcatgcctgtaatcccagctacttgggaggctgaggcgggagagtcacttgaacctgagggggaggttgcagcaagcttagattgcaccattgcactccagcctgggaaacaagagtgaaattccctctcaaaaa

SEQ ID NO: 154431 - DNA, 551 bp, Homo sapiens
  misc_feature (60)..(60): n is a, c, g, or t
gtgtcgaaagattctggcgggtgcggtggctcacgcctgtaatcccagcacttcgggagngcgaggcgggtgaatcacttgaggtcaggagttcgagaccaacctggccaacatggcaaaaccctgtgtctactaaaaatacaaaaattaaccaggtgtggtggtgcatactggtagtcccagctacttgggaggctgaggcacaagaatcgcttgaacccgggaggcagaggttgcagtgagccaagatcgcgccactgcactccaggccgtctcataaataaataaataaccaatccagtttcaggtatttctttacagcctgtgagaagggactgacgcacctgtattgcacaagccctgcctccctcctccctcccgcaatatctgttcttctccccagtgtacagtggaggtcactgtgactcagggaggccacagacactgcccaaggccagagagctaagaaagtggtgggatgggaattgaaaacatcgatctcagcaccgtgctccccaccttgcccccgacaatgctactgattctgaata

SEQ ID NO: 154432 - DNA, 491 bp, Homo sapiens
ctatctcatcctgtgactaagaacgcctaacctcctgggaatgtagccccataggtctcagctttgttttatcaagtccctatttatgatggagtcactgtggtttgaacacttctgacacagtggctcccaaacctggcaaatcagcaaaatttccttaaaatccatctgtctatcaatctatctatctatctatctatctatctatctatctatctatctatgagacagagtcttgctatgtcgcttaggctggagtgcagtggcgtgatcatagctcactgcagccttgaactcctgggctcaagccatcctctcacctcagcctccctggtagctgggactacaggtacacaccaccatgtacagctaatttttaatttgtttgtagagatggggtctcagtactctctattttcccagactgattttgaacccctggcctcaagggatcctcctcccttggcttccctgggtgcagaggttacagg

SEQ ID NO: 154433 - DNA, 615 bp, Homo sapiens
tatgttaccaaaaaaactcagtaaaaaatgctttcttaagaaggaaataggaaaggaaagtctttacaagggcaactgatcatcttgtggattaccaaatactgcagatttcaggtcagaaaacggagtcatggagaataaaaagaaaaaactaacacacaattgagcaaataattcataatttagagaatgtatctactcattaaaaatgtgaagtgtaaatgtataacagttatgtgacctgggaattttgaatacaaaattatgtaagcaactttattattttttaatagaaaaatacttgcaaatattgaaacaataaaacctgttgctgaaaaatctagaaaacaacacacgaacaacaaacgaaaaaacacaaaatataggtgggccgcgcacaaggcccagtagaaaagagttttcgtgaaaccacgctgtggggccgacggcggccccagcatcggtcaaagccgaccgcgggccacagcgggtgtccccagggaaaagccgccgggcacgtcaactaagggggcgggattacgccacgaattaacacgcgcgggggaaacacaacgggtgggaaccaacacgaagggagtcggagaaacgaggaac

SEQ ID NO: 154434 - DNA, 681 bp, Homo sapiens
  misc_feature (681)..(681): n is a, c, g, or t
atgcctgaaactcatccaaatttgatgaatactataaatctacaaattcaagaagaataaacacagagtaaaccataccaaggtacaacataatcaattgctgaaaacaaaattaatgagaaaatcttaagtgcaaggagacatgggggaagacatattaaataaaaaggaatatggataagagttatcactgactccttaatagaaacaatacaagccatctttgaaatgccaaagggggaaaaaaacccctgttcacatagcatctatattaagtgacaatctctttcacaaatgaagcaaaataaagatattttctgcctaacaaaagcaaaaaaaaaaaaaaaaaaaaaaaaaaaaaaaaaaaaaaaaaaaaaatgtggggtggcggcgcgcgccgctcgggcgccctaagaaaaaagtctttcataaaccgcatctcgggtggggggggcggcgcgcccacaggtaaggatagtaaggagcacacaggcgcaacacagcggggtccagaaaggaaagcccggggggcacagacaaccgcggggggggctcccaccaaaaaaaaaacgacccggcggggaccacgcgcgctgtgtaggaacacaccccacaggggggctctgagggggaccacggggcgcttctacacaggggcgcccagggagggctgattaaacn

SEQ ID NO: 154435 - DNA, 233 bp, Homo sapiens
acctgccattacttcagtggagcacctaggaaatgaattaggtttggagatcattttgaggcacctttgaaaacaaggggagaatagaaagtgggcatttgtaaattagtcatttctacaaatgataactgaaaccctaagaaaggaattagagaaatatgtgaccactgagatgctggtggcaaagaagtattaggatgaagatgcaggagggaaaggatgataaattaaga

SEQ ID NO: 154436 - DNA, 215 bp, Homo sapiens
tgggattcgagcctctggtccacagcagggtttctcagtctcagtgctgttgacacttggggccaggtgcttcttgtgatgttcagcagcatccctggcctctacccactgatggcacttgccgccaccacccttgtgacaaccccagacgaggaccatatgcacatccacattgagaacccctggcaggagggagggaagggggttgaggctgg

SEQ ID NO: 154437 - DNA, 509 bp, Homo sapiens
tcctgaccacaggaacctgagaatgtgaatacagttggaaacagcattgttatcacagatataattagttaagagaaggttgtagtggaagtagggtagacccttaatccaatatatgcccttttaagaggaggagaagggacgcagagatacagagggagaacacgcatgatgacaggggcagatactggaggaatgtgcctataagccaaacaaaactaaggattgctgctgacaccggaaactaaaagaaaggtatgcctgttccaatactgttctctgacatcaactgggtgtcctaaaattcaactcaatgctgacactaattacctagacttaatacagacccaacaaggaaagaatatttcacaaaactgccccatttcagacgtatatacagctggcctttgaacaacacaggctggaactgtgcaggtccacttatacacagactttttccaataaaagttacaccaaatatgcctgcctgtcctgcctcctcttccacc

SEQ ID NO: 154438 - DNA, 467 bp, Homo sapiens
aggctggtgctagcagcttgtatgctcagggaatgaaatatgcagaaatagtatcacaggtcattcttactttgagaaagtgagaagaaaaggagcctaactctgtgaacatcataaaggcctaatttataactgaaacattatcactttgcaaacgaaagcattatttaaaacttgtttataaaaaatttagcataagtcctcgaaaatacttggagaattactcaaaagatttttttttttttttttgagacagagtctctgtcacccaggctagagtgcagtgacatgatctcagctcactgtaacctctgcctcccaggttcaagcgattcttgtgcctcagccttccaagtagctgggactacaggcacctgccaccatgcctggctaatttttttttttttttttgagacagagtctcactgtgtttctgttgcccaggctggaatgcagtgacatgatct

SEQ ID NO: 154439 - DNA, 331 bp, Homo sapiens
ctcccacagtgctaagattataagcatgagccactgtgccaggccctaggatttttaaaataaacaaatttattcatgtcttcagcatccaggtaactgatctagaaagatttagagtcagaatattcttcttcaattataaaatgattactgaataaattatcaactacagaaggaacttgagacacaatttttcttttctttttttttgcagagacaagtgagcatttatttttgtgcctttcttcctatgtatatttcaagcctttttcaaggccccaggaatctccggattcaattatgtccccgggcttggtcgactgctgcagga

SEQ ID NO: 154440 - DNA, 592 bp, Homo sapiens
aaaggagggagaaagggggacccaaatttgtccaaatgagacagcatttgggcatgaaagagactagagttagaataaggaattaaagcatttcatgaaggagagtcgggggtaggacaccctgatgggcatcctctgctcagctgaaagtgcactgaaatgtacatgtgataggaacattaccaaaaggatgccatggtacagcccttgaggagcaccatgtgaagacgcagaatgcattagagctaacaggaagctactgggggccaaggagtgaccacctggaagcccactctcttctgcctctacgcacgtgagagacagtgaagagtgaagcatacgttgatgcagtgaagcattctgttctgcacagcacttgttccaggagaaactccagaggcatcagacttagacgtgattctggaaggaagaaaaagctttctactagtaactgagctaagataaggatgttgggggtctagtaaggagagatcatcagtgaaactctcagggaagagagcctggtaaaggaaggggaatatgtctagaagctcaggcaagacaaggtgacaaaacatagctgaaacacctg

SEQ ID NO: 154441 - DNA, 467 bp, Homo sapiens
atgagaaggtagaagcaatgaatataaactgcctttcttcaaaggaaaacaaggtgtatagtgcctaacatgtatacgaaattacaggctatatgttttaagtgataagggatagttgggtggtttgtagacttagcaaaagagctagtagggaaatgaaatattgacatggggacttggggagcaagaacaagaagaatatctttttttccttatttttttttttgaaggaaaaatatttttgttcttcttggagaccgagtttcgctcttgttgcccaggctggagtgcaatggcacgatctcggctcacagcaacctctgcctcccgggttcaagcgagtctcctgccccagctacttgggagtctgaggcaggagaattgcatgaacccaggaggcggaggttgcagtgagctaagatcgcgctactgtactccagtctgggtgacagagcaagaatgtctca

SEQ ID NO: 154442 - DNA, 216 bp, Homo sapiens
ggaagaggtgaggagcaacagaggcaccaaagtgggactatacaaggtatatctagaatgtgaggaatcctggtttgacttgtttgaacagggaaacaatattgacaaagcaaggcaaggccctgttgtggaggtggtgtgacagatgggcagagtcaagagcccatctctaccactgcctagctgcatgatcctggtgacttactgaacctttcc

SEQ ID NO: 154443 - DNA, 401 bp, Homo sapiens
cagatgtttgttacgatgatgctttatatacatgttcatctccagctgacatgggagacgaaaaccctacttttatttttttttaggttccacgaagaagttgtaagttgccattctctaatttttaacatacatactaacagtatatttggtacacaacaccccacacgttatttggctctggtgtcatctcacagaccaccttacatgactatttttattgcgcaaatcacaatttcaatgtttttgtggcacccattctgctttgattcacaccatttccttaaagctactcagcaaacagtcaaatgaccttccagtgactgcgcaaaatatagaatgcttcaaaaatttgtgtggccgccttatgcaagggccagctccttgggaggctgaggcag

SEQ ID NO: 154444 - DNA, 162 bp, Homo sapiens
aagtggtgggattataggtgtgagccaccacacgtggccacagtttgggcttttgaaaaaagttaggtggaggaagagaggtatgagtactctagttttcactgcagtatcccatttgtgtgtgtctgtctcttgagggaaagatagactactattctaaca

SEQ ID NO: 154445 - DNA, 559 bp, Homo sapiens
caggtccctcccctgagatgatcaacagcctcagtgtctctcccacccagcgccttgcttttcctggctccatatgctgagggaaccaccaaatgcttctgccactcctttcatcttcctcttcaccaccaccctctcccagccaagcttccttccacatcctgctgagcactccaccagaatgtcttcattctccaccacacgtgagacctggttctggttccagctctgctgccagtcagatctggtcaaatcaaagtctgtttcctcatttgtaaaatgggagtgggggaatgggcccagatgatctctcaagtcgtttatatttcccagacccagtaactcatcagaacctgaacaagattcagccaggcagagccatctgcccttcttcccttcctatctactatctactgtctgtctacacatgtaccaagatgtggttctataatgctcagatgtcctgtggtgttatctcttcaggctgaccctacattaggcactggtcttaaactatctccggagactctctttaaggaaagggatcaccatgtgtcta

SEQ ID NO: 154446 - DNA, 419 bp, Homo sapiens
tcccttctctgcatgttttagtcctactttcctaacacccaagaaaaccagacgagaggctcgccaagttaatctctgcttctgggctgaaaaagatcccaggaaatataataggtcaatggtattattcccttttttaaaaaacagcaaaatgcttaggtaactggccaagctctcaacatggaatatatcagaatcctccttggagactgactcataaaacacatatgcagaacttggtggaattgtttcatccattgaattttatgcatagcacaacccaactccaattcttattactataactcctcccaaataggtaaatatttattccttggcatcttgcctcatcacacagaaaactttgatcaagcttctatgataggctattagaatgacatcagaaaataaagtctaat

SEQ ID NO: 154447 - DNA, 143 bp, Homo sapiens
tgtagggggcacaagagtacaaacaagccatttggaggctctttcaagcacttaggcaaaagatgatgaaccaaacaaaagcaatggaagtggtgagaagcagtcagattcttgttgtattttgaaggtagggggacggtgca

SEQ ID NO: 154448 - DNA, 174 bp, Homo sapiens
acatggttcctggcctcaaagagaatctggtaaaaattaatatagttttatgtcatctggtgaattacaacctggtagaaaaaaaatcccatgatttcccctttacgtggagatggcatctgagattttcacttcaattctcaggaaccacccttggtctatcctgtgtgtgtg

SEQ ID NO: 154449 - DNA, 165 bp, Homo sapiens
actggtcccctgaagatgtccctccctgggcctgtactatcttcatatttgctcactagtcacaacacttaccaagtatacattcttcagtttaccactatgcacctcttcatttgaccttcaccattccttttaccatttaatggttaaacctgtgtgccatgt

SEQ ID NO: 154450 - DNA, 364 bp, Homo sapiens
cgatatttgtggttctggcctgttagctctgctagctgtctttcatctctcttggaccactgagtttgtaatccagtgtacactcaataagcccccaggagacttgctaggatgtaagccagcagttggtgaggagaggtgaactcatcctacccttccccacctcttgttccctccacattgtcctctgggactttgcccagtctagtttaaagggactctagagatccgattcttccactgttccctcaagaaattggagcagatgattagtcagtatctttaataaaagcatctcattatgtttaattcactcagcagataccaaaaccacctctgtgccagaccaccagttggggtgcac

SEQ ID NO: 154451 - DNA, 360 bp, Homo sapiens
aaggatggtatgaggagagggctgtgagacccagtatctagttccttgtaattctatgggaaaaagaaagcctctgaaatactttccagataggaaaacagtttgctttgtttctgtttttgtcatttaaaagatatactttcaaatctgtatccaaatttgttacgtaagtcaataattgtaaatttcactgcaatcatatgtttcctaaaagagttgccttgaacttatggaactgaaccccattttgctaatcacttactccttgcagtctatttcttatacaaatcaatatccttagagtatacatttttacacctactatttagttctgtcatgccgacagaatggctaatggct

SEQ ID NO: 154452 - DNA, 316 bp, Homo sapiens
gttgagtgcaggcccaaaggggcaagtggaatcagattccagctcttaaggcaggctcctttctgttccctgtcttctccgtctttctcttccgttggtggatgggcctccagggtcaaggagtaattgagaataagccaattttctgaatagctcaggaaagaaaaacactcaaatatcaccataaagaaaagcatctagtagaaagctagtcaacaactgtttattctgcagtgatgattttccaaacatcatttttctttggagtagttgaactcatgtccccaagacatctttgaatttgtcaatcccagca

SEQ ID NO: 154453 - DNA, 383 bp, Homo sapiens
gaaccccaacatccaaaggcagccaagccgccagagtgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtagggg

SEQ ID NO: 154454 - DNA, 341 bp, Homo sapiens
ctactccaccacattggccatcatcttgtccttccttaaacaagccacttttcttttaccttttctcccatcagggcttttgtatctgctgctctttctaccaggaatgcccttcccttagacctccccaaggctcccccttcccttcactcagggctctgctcagaaaggccttctctgacagctgacggaaaaaactccccgtctgtccatgccaagcaacacacacccaattcaggactctttcccctttgcaaccttcactgttctcagtacttcggagtctctgaaattgttttctaggtttttaatgcctctcagtcctatgaggatgtaacctc

SEQ ID NO: 154455 - DNA, 702 bp, Homo sapiens
ccggtcactaagtgttataataaagagatgctgagtgcatgaggcccaagtgggctgcatcacatttcccagagaaacgctgctcacaccattaccccatttcacagatgaggtaatcgaggctcagagaggagtccatagctagctaataagaggtggagacagaattgaaacccaggtctctgactccagggctgtgtgcttcctctctccaagcacacagcactgggagagtcttgtctccaagaaggaatgatattcgagatatgtaacttaaatttttggtagtatttgatgtctgcatagtttttctgtatgtaatattgtaaagccttaaaagaattaatggcactgtttttgtgtagctgggttacttaagatttactttgcgatcagtttagaaagtttaattacaggcttacctctgagttatgtttgacttgctgatttttgagaattaaactagtatggaggtacgattacctattccactgcttctaaatttagactgtttcgtgactggtttagaaaacaaaattgggcatgttttagatgaatgctttcagactcctacaaatgaattaatgagtggtcttattaccatattgtaatacttttttttttttttttttgagacagagtctcactctgtcgcctaggctggagtgcaatggcgcgatctcagctcagtgcaacccctgt

SEQ ID NO: 154456 - DNA, 509 bp, Homo sapiens
acaggcgtgacgccgtcttgtcactcttccatcaacattatccattgttagatgaaggaatgatattcgagatatgtaacttaaatttttggtagtatttgatgtctgcatagtttttctgtatgtaatattgtaaagccttaaaagaattaatggcactgtttttgtgtagctgggttacttaagatttactttgcgatcagtttagaaagtttaattacaggcttacctctgagttatgtttgacttgctgatttttgagaattaaactagtatggaggtacgattacctattccactgcttctaaatttagactgtttcgtgactggtttagaaaacaaaattgggcatgttttagatgaatgctttcagactcctacaaatgaattaatgagtggtcttattaccatattgtaatacttttttttttttttttttgagacagagtctcactctgtcgcctaggctggagtgcaatggcgcgatctcagctcagtgcaacccctgt

SEQ ID NO: 154457 - DNA, 986 bp, Homo sapiens
  misc_feature (359)..(359): n is a, c, g, or t
taagaccaagcgagtcctccctcccaattggaaatatgaatcatctacagcctctgccctggtcgcataaatttgtctgtgtactcaagcaataaaatgattgtttaactaaaataaaacaaaaacaaaaacaaaaaaaaaaaaaaaaaaacaaaataaaaacaacagaaaaaaaacaaaaacaaacaaaaaaacaagaatatgtggcggcgcgcgcgcacgagcggcacccaaagatagagttgttacaacaacactgtatggtgggaggaggaggcgagcccacagtgaggagcagaagcaaacgaggctggccaacgacggtttctaccagagaggaagaccctcgtggcacacgncaaaaggtgcgtgggggattcctcccaccaaacaaaaaacagaccccgggggaacacacgaggggttgcttgtaaacaaacccaacaaagaggaggttaaggaagccaacactggggagcacctaaaacaacgggagtcctacacaagacggcggcaagcaataaaaaaaatatacccccgcggtggtggaggggtagcaaagacaacgcaacgacacgaaagacagaggacaagctaacacgaccacaccaacaagccacagaacaaacgacaaccagcaaggaaaacacgaggcgagaaggagcaacagagacggtgagagaacagcaagagacataccaaagccaagaagagaaggataaccgcaagaagaacatgaaggcacggacatacaagacacgcaaaaaagaaaccagccagatagaacaagcaacaaaagaggaacggaacagagaaacacgagacaacatagaagacaacaacaaacgacaaacaacacgaaaaaagcacagcacaagagaaaccaagctgcccacacagacaacacaacagcgcaagcaagcaagaacgaccactacgtagacgaccaagaacaaaacaagcgataggaccagcagcagacaacc

SEQ ID NO: 154458 - DNA, 392 bp, Homo sapiens
aatttgtgtatgtgagcatgtgcagtggcatgtgtgtgactgtgtgcatgtatgtgtgtgggagtgtgactatgcatgcacatttgtaagtgtgagtgtgtgtatgccctggtatgtgtgtgattgtgtatgtgtgggagtgtgactatgcatgcacacttgtatgtgtgagtgtgtatgtgtactggtgtgtgtgactatgtatgcacatttgtatgtgtgagtgtgtatgtgccctggcatgtgtgtgactgtgtgggagtgtgactatgcatgcacatttgtatgtgtggctgtatgaacatgcgcattggcatgtgtgactgtgtgtatgcagaagtgtcactgtgtgggtgcacagtggtataccagaagatatttctaacgttttc

SEQ ID NO: 154459 - DNA, 383 bp, Homo sapiens
agggtcctcaggagacagacgagggcgtgtggggaggcaggggacagtggccaccctcaggagacgcggcgcccctgaattagtgtcaaggagggctggcagagggttggggcagtgccaggactcactgaccaggagagcacagcatgttctgagacctgaggtgcttgtggcttccacgtgacgctcatgtggggagggccatcttctgtgtcaagatgaggcatttggacaagcccccagaccacaacctggcaccatcgtctgtcctcacccagcctgtggtgccagccatgctgaaatggctccaggagttcccactccagcctggtgtccaggggctgacttggagccagctgtctgcccacatggcttggggcaag

SEQ ID NO: 154460 - DNA, 199 bp, Homo sapiens
acactgtgtcactgaatcaaactctcatagcagtaaagaaaaaggaaatgacttttcccaaccaccctgggatttaattctcttcttctgggcctggtttaggacgaggaagctaaggaatcaaaggaatgatagaggagttcagtggttcctgaaaccaggtgggaggctggtcgacgcggccgcgaatttagtagta

SEQ ID NO: 154461 - DNA, 452 bp, Homo sapiens
tgtctcagcctcctgagtagctgggattacaggcatgtgccaccatgcctggctaatttttgtatttttagtcaagacagggttttatcatattggccaagatggtctcgaactcctgacctcaggttatcagcccacttctgcctcccaaagtactgagattacaggtggctcacgcccagccttttttttttctttattatcattattattattatttttagagacacagtcttgctctgcaagtgcagggccgtgatcacagctcactgcagccccaaactcgttggctcaggcaagcctcccacccaaacctccctagtagctgggactgcaggtgcatgtcaccacacccagctatggttctcaatttttattctagcctaacacactggaaagatacagtacacctccatcagtggcagtgacttgattcagcagtggttttcaac

SEQ ID NO: 154462 - DNA, 283 bp, Homo sapiens
caggtccaatgattccccgtcgccacctgcatgactgacacttccagggtcttgtcccacaaatctctggctccctggcccctgacccttcactctggggagccccactgccccccaggaatgccaggacttcctggctctccctggctcacatccctgtccctccatctccctacccccgtagcctttcctgggatcacaagctcctcttcccagcccagctctggccgtgccaccggacttgccctgctcttttctttgcttcttcagtttctctacattg

SEQ ID NO: 154463 - DNA, 458 bp, Homo sapiens
taagcccaggagtttgaagctgcagtgtgccatgatcatgccactgcactccagcctgggtgacagagtgagaccctgtctcttaaaaagaaaacaacaacacactgtaagcagaggcctctggagaaagactgaagacagcctgatggaggggaagcaggtgctagaagcaagggagatttctggaagagccttttttgtctctctgagctttcatttgcttgtcctcttaccttgtccccatagaatttaaggcatactcacaatgcaacagcataaaataaatcaaataggtactatgtgtgaagaaatggagaaaaggaaaaatcagtgtagaaaaataagaaaaagcaagagtgaggttggtgcctacagttcacagcatgtgataaggactgagcatttattctattatttggtcataaaaatgcaggctgtaagggcctacacacaccagc

SEQ ID NO: 154464 - DNA, 291 bp, Homo sapiens
gagggttccctgaggtcagaacccttcaccctacttgggcctttcaaagtggggattacaggggaggtattcagcacattcagggatgcctggacctctgtggatcttgtcactttgtaacgcagccaaatgacaggacctcagtgagcctgaggacttctacccaggcagctccctgtggagctggtgcttccatcagcatggtgccttatacctgataggtatcagtaagaatgttttgggtttttttgttttgtttttgtttttgttttgacacggagtctcgctctg

SEQ ID NO: 154465 - DNA, 559 bp, Homo sapiens
tgccatgtgggaatccactgctatcattcactacacattcacctgtattatgatcagaacctaaattaaattagtggttgtggaaaagaaaaaattgaagagatgcaacaggattcaaccagggattaggagagatggaggtcctggtgatgctgaatccctggttccatatattccttgtacccaactacactttcatataccttctaatagtttatttttacacaacgttatttttagatgggctttatcacatggaaaaaaaatacccttacttattcaatcaagaaaatgcttacttatgctgggtgcagtggctcacacctgtaatcccagtactttgggagactgagggggaggatcgatggagcctaggaagttgaggctgcggtgagccgtgatcatgccactgcattccagcctgtgtgatggagagagaacctgtctcaaaaaaaataaagatgtgcgtaggatgaatgcacaaataagtgagctttgtttccccatccacacctgtaaatggcgtttctttaaccctttaaaggttaggttgaccggt

SEQ ID NO: 154466 - DNA, 582 bp, Homo sapiens
caaccagccccagctaccccagccagcctcagctggagctccgaaagccaagaagtgcccagtgctttgcacctgagtctgtctttgcctggctggctagcatacccctccctgcatagcagcctgtgctgtctttctgtggcctacacaggagggcctaaggggtctagctggaactccctgcccagctggaactccctcaccctccctgtgtatctgctcagtgagatggctctgcttccagcatagaactcacctggttcacaccacgcctcacacttggtcacactgccactcgtgttcagtcccactgccccacctcttcaagcacactgcacccatgatcttccctttcacagctccgtccacatgtgcaagtgcatggtgcctccctaaatggggacagaactggctggtctgtccaggtccctgcagaccaaccagctgctgccagggccagcagggccttggagcagccatgcacaccctgacccagagcatcatggtgaattgcctgagagctccgggagaactttggtttctctttatttgaaactattgtctgtccactcattccgcctt

SEQ ID NO: 154467 - DNA, 557 bp, Homo sapiens
cgctgggattacaggcatgagccaccgcacccagctggtcagcttctttactataacctacctgttttattagcagggtttttgtgtcctgcattttgtgctgacttcctatttcattctgtgattaagactgccttaacttactgggaatgtagcccagtaggtcttagccttattttaccaaacccctactgaagatggagttgctctggttcaaacgcctctgacactatgatacagagaaaaggtagaaaataggaaattctgctcttaagaaattcatatagtttgaaaaaactaatttcagtggagtgtaaagttataatacgagcacttgtttctgcagttatacccttctttgttgatcctttgcctcccagccatccgctgtgccattttctctgcctcttcacaacaaaacttatccagagtattgtctcagtgtctttgctttcttacatcctattccctccttggcatactccaatctgtcttctgtcttctttactctgctaaaatcgccagggtctccagtgattgatgttaccatatccagt

SEQ ID NO: 154468 - DNA, 422 bp, Homo sapiens
catgtgggcatcactgctcacatgaataaaggtggactctaattctacccaattaatcttaaaatgtattatttggagaaccaagtctttctcctagctaagtacatgaaactttaagtacttttggggtttttgtttttttttttttcttgagacagggtctcactctgttgcccaggttggagtgcagtggcacgatctcagcccactgcaacctccatctcctgggttcaagtgattctcctgcctcagcctccctagtagctgggattacaggcacgcaccacagcacctggctaatttttgtatttttagtagaggtggggtttcactatattggccaggctggtctcaaattcctgacctcaagtgatccacccacctcagcctcccaaagtgctgggattacaggtgtgagccac

SEQ ID NO: 154469 - DNA, 319 bp, Homo sapiens
actctgtctcaaaaaagaaagaaaaagagaaaggacaccaaatctgtttttatcactataggacacagtgaacacagcacgttgattatttgagaataattgtttacatgtcatttcccactacgagactctgaatatcttgaggactagaataccatttccttggcacctagtacggtggaaaataaagtcatgaatcctagccaggcatggtggtacacacctataatcccagctacttgggaggctgaggtgggaggatcacttgagcccaggagttcgagaccagcctcagtaacatagtgagaccccatctcca

SEQ ID NO: 154470 - DNA, 377 bp, Homo sapiens
gtaattccagcactgtgggaggctgaggcaggcggatcacgaagtcaggagattgaaaccatcctggccaacatggtgaaacactgtctctactaaaaatacaaaaattagctgggtgtggtgctgcgtccctgtaatcccagctactcaggaggctgaggcaggagaatcacttgaacccgggaggcagagattgcaatgagttgagttggcgccattgcactccagtctggcgacagagcaagactccatctcaaaaaaagaaaaagctgttaccaaaagctataattttaggttttagggcagtaagcaagaaaaggcaagaccaagagtccgctagggtgggcctccaacctacaatcttagaagaaatgtca

SEQ ID NO: 154471 - DNA, 392 bp, Homo sapiens
ctcatgcggctctcccatgtgaatattccatgccacctgaagtcctggcgccacccgccgggcgagggccggcgtgccctcacctcctcgccactcttctcctccagagacctcgctcggcccggagtgggcagactcggagcctcccgcgccggagaccgcgagccgctcggccgaggaggcgcggcggggcgggggcggggcggaggggccggcccgcagcccccaatgccgggagcccgcgctggagacccagggagcccagctcggggccgcggcacggagaacgaaccatccgtggcctggagacgtatcccgccgagcggccagaactttccccatttagcgatccggaaaggaagccaacactcccacccagagaggcctcggcc

SEQ ID NO: 154472 - DNA, 862 bp, Homo sapiens
ccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccaggtggtcaggctcaggatggaccatgagctttcaaaaaggaaaaaggtggaaatcctcaactatgctgccatctgaataagtgtttctttgtagatgcacagagtcaaggaaaattacatccctgcattatgtaatgtaccaacaacgcacttacccactgttttaatctaggttattcttgaaagcagagcctgagacaaaggtagacacattctatttatgagtctaacacccaggagcaggaatgagagataggggagtgaactggggaaaagggaaactaagtccgagcaaaaccagatactgctcttatcaagtggtccacccctattaatggctacataatgcagaactttctcaggattcttcttaaactttatctcagaactgtctgcctcagggagaaaggagaagtatttctccatcagcagccacctcctgtgtgttgagggctgctcctttggggcattaacccacttgctccaccaccccaaccctctgggctgcaa

SEQ ID NO: 154473 - DNA, 698 bp, Homo sapiens
ccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccagaggagaaaatgagacactgagtgggactcagggattgctccaggccacacagtcagcaggaggcaaagcccagattcaaatgcagattactcagctccacaatccacatcctcacaggaggctgcactccttgcccaagcgtcagacaggagcaaagagaaagaaggcaaccagctggctactttcttcccttcttggatgcctccaacagggtgagaaggactaaacaaatgaccaagtgtcatcccattttggacatacttaaaacaccccatggaatttttattctgactttcttctgcctgtgtggcatttatgtttaaataaaagagaattcaactcgta

SEQ ID NO: 154474 - DNA, 758 bp, Homo sapiens
ccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccagataaaacactaactcagagaagaaatttaactgcaaatttggttaatgaccatggattcctaatgagaagaaaagctagacactgagagtttagaataaactcaagaatcttaaaaattttcccatggaactgcctttgcacctctataaaaaattaattgaccatatgaaccgcctgaagtctgcatcatgacttgatggttacccaggggtttatgtgtgtccaactgaacaccgtggttctgggattgaggatccgcacaaacacaggcaggagtttggagggaagaagggggcacagcaggagtgtatctcaagcccacctcaaaggcagcagagcattccaagttgctgaaaacctgtgcaaatggggcctctaaaacaaacattgtactgtgagctctc

SEQ ID NO: 154475 - DNA, 881 bp, Homo sapiens
ccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccagataaaacactaactcagagaagaaatttaactgcaaatttggttaatgaccatggattcctaatgagaagaaaagctagacactgagagtttagaataaactcaagaatcttaaaaattttcccatggaactgcctttgcacctctataaaaaattaattgaccatatgcttatttcaccaactagaacttccaataaaacattgaatagaagtgatgagagtggatatatttgccttgttcctgattttagatgataaacattttgtctttcactttagatatgatgttagttctaggggctttttgaagatgagcattattatgttgcaaaggttccatcctccttctagtttgtgaggaaatttttatcttaaatggacattgaattttatcaaatgccttccctgcgtctattgatatgaccacatggtttttcttaagtctattagtatggtgaattacactgaagatttttgaatggtgaaccagacttgcattcccccaaataaactctacttacttatga

SEQ ID NO: 154476 - DNA, 243 bp, Homo sapiens
acgcagagcaagaaatacctggggagaaccctagtgcccggacccctttgaacacaagggaagatagtctcccctcagccagccctccagggctccttcattttccacagctgcccaagggcagcaggctcccccggacaagggaccatgtgtgttcagtggggcccacagcgaccatcaggacccagcttagggcacagaggtgttctgaggaccgtcagtggatctgtaccagtggctcta

SEQ ID NO: 154477 - DNA, 519 bp, Homo sapiens
aaagggagcgagcatttagactttggtggccccgccaagttgcattccagaaaggcttcaccattttcactgctggcaaacagcagccggagcttttgagtggctgttccatgccaggcctgtgccggactctggggaccttggcaggagtcagcctggggctggctgcttcctaattctcagtcctcgagtcctacctccgatctcaagaaaaggtgaggatttcagagaggccataaaaaggagaagcaagagatgattgtgggtggctgaaggcggcctggcacatcccaggtgatgggagagctggctgcatccgatggtcccaccgcagggagcgtgaccaggaggtggagtgtattggactgggaaccgcacgtgtgggctcccatcactgtgtgccatgttggggtgcagttgaggggtcaaataatagtaccgccctcatgggacttgtttgggaggattcagtgagagagcagagagcacacagtcagaacttaaggatccgggttgtca

SEQ ID NO: 154478 - DNA, 491 bp, Homo sapiens
atgccaacctttggaaaaaaggtaggtcaaggaagaaatcagaacaaaccctgtgaccattccagcctccttgcatcttgggcttgggtttggaaactgaccagcaagctggagctgccaccacagagaaacatcaaagcaaaagggttccaggaccagagattaggtaactagctacaggccagaggaatgcttccctctctagatcaacaagcccctcctttcactctgaaaaaaagtaagtacctgagggtccgtccttgcaaagcctccgctcttcatcgccatccctgaacaccgtgttccttcctccttgtgctccttttgccttttcatgcatccggtgtctgtcatcaggctgccaccggtatcgaagtcaggacagttcactgcgtaagaagtcaagcatcatgggatgttggctgtggcgtctggtcattgtgccagcctcaccacagacatgtgaccactgtcccaaggagggccgtatg

SEQ ID NO: 154479 - DNA, 237 bp, Homo sapiens
aaagacaaagaaacaaacaaaaaaaaccccacattctaaagaagcatttattatggggctgtttattatggaggctgatagcgcttcactcttactaactgccaggatagagatttggtaggcctagagaaaagaaaggaaaatcctaaaaaagaaaaaatttcccttgtgttttctgacattggaaaaagatttttttttaatatattgaatgattattgttacacattgaatggg

SEQ ID NO: 154480 - DNA, 357 bp, Homo sapiens
aagagtgttttgtattactctggaatatatctctacattcgtatcaaggtctttcgcttcacctgaaactccttaaccttaaatcttttctgcttctccaaatcatgttgtctggatatttaacctgtgcactaattttctcatcagagagataatacttgctttaaatcacagaatctttaatacagttagttataaagatgagcccatcagataaaatacagcttttctttaggacagtttatttttggaagccttcctgatttcccaactagaaaggactttacttcatagtatttagtgccttctcaaacataatttgctcaagatcagggactgaattatttaaatttttct

SEQ ID NO: 154481 - DNA, 526 bp, Homo sapiens
cagaagaagaaagctagagtaagggtggaggctgaaacttatgaggaaggtttatgaagaacagtcattctgccagttgtattttccaatcattggtgccaccaatatatcccatcccatatactcttctcacactatggagctgacactccttcctcgactgtggttggagtggaagtgatgccatgggacttccaaggctaaattgtaaccagtgaaacagcttcctctggaaatgcacacccctgggacccagtcaccatgctgtgaggaagccatgcagccacaggacaggccatgtgggagtgttctggccaacagccccagctgaagccccagccaacagcagtgtcaagtgccagccacatgagtgaatgaggttcagacaactcctggcccaggctttgggccgccccagctgaccaaaatggagtggagcaagatgagccctccccactaagcctcaccgaaattgccaatttgtgaataaaataaaagttgggcttgtttttaagccccttgaaat

SEQ ID NO: 154482 - DNA, 156 bp, Homo sapiens
gctgtcctgattcgaggctggggcatggctggggtgacctcgaaagcacactgctccattggagaattggcccagaaaccagtcctggccctccccccgcctttcctgttcgcctcagctaaatagatcagaaggaaaaagtctgtttgattttaa

SEQ ID NO: 154483 - DNA, 223 bp, Homo sapiens
aaatgtgggagtgcggaatggggtgggtgagaagcaaaagagagcagcagatactttgactcaccttgttgggtagaaggaagaaaaaagaacagatgtgaggacactgagcttttcaaggaataagtctgaggaatgataattaagtttttatcattttttgggtggtggcagggggatttttattattattattattatcttgcctggttggcttcaggtc

SEQ ID NO: 154484 - DNA, 328 bp, Homo sapiens
aaattggagaggtgcccctctcaccctactatgcattagaaaagcaaaaagtgttcctttacagaccagtccacatttgcattgcatgtgagcatgtattaatgcaatttgcctctgtggtcagatatgtagcttttttcctatgtttctgttccattattattgtttgaaattccataagtactaaaaaaaaattcttttccatctctaaatgtggtttgcatcgttgttccctttactcctcgatgcgaattctttaaaaacttttttttaatctcatagaacatcaacccttctgtactcgacaaagacaagtttaaacagattc

SEQ ID NO: 154485 - DNA, 355 bp, Homo sapiens
ctctatgaggatcccccttgaatttgaactgaatggaggaaatttctaagcaggttcagagaaaggatatcaagctgtgtttggagaaaggggtgggaattctaaacaatatctgtggaagcaggacatctagaaccacagatgtattcagaaaaatgctagatctcagtactactctagaataccagcagttttctgttgatggtatgggaagggtgatatcttccgttggtgggctttgcctttgacattctctgtgacatatctacactgcattttaaacgtcaatattattgtgaattgtaagttaaaataaaatgttatctcattcagttatttatacatttaacttcca

SEQ ID NO: 154486 - DNA, 338 bp, Homo sapiens
agaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagaggacctgtttctctaggatgaattgaggtaattctgctgcgatct

SEQ ID NO: 154487 - DNA, 878 bp, Homo sapiens
aggtacaaactaatccttagctatcaaaagcccaagtggaagaggcaggctgttgaaagcttcacaagaccattgttaagaggcgaatgtcccatgtgagtggaggaggacccatagatctgtctgacacagactccctacaggcatggatcaacatgactggcttcctttgtgcccttgggggagtgtgcctccagcagagaagtaattctggcctgccaacctatagcccacccgtgggtccggtcagtgaacataagggttccatgatttcagtgatgtcctcagagggaaacgcagatacacctgtcagcaaatatatggatcagctcttgtcgttaatggtgtgtaaccttgagaaagtgggacttcaaataccgaccaatgataaggacctggtgggtctagaattgagtcctgctctttatctgatgctatttaacaaattgaagaagacccatcagcaagttttttgactcctaaggacaggttttattgactgataccaatactcaatttgtagagcaaaccctagatataatgaagaacttgctagataatcatactgaaggcagccctgaacatctagagcaagctagcattgaaacaatgatgttaaatctggtcaggtacgtttgtgtgcttgggaatatggtccatgcaattcaaataaaaacgaaactgtgtcagttggttgaagtaacgatggcaaggagagatgacctctcattttgccgagagatgacctctcattttgccaagagataaaatttagatttccctaagctttgtgcctgtggcaagcctccctttttctaaaactctgctgtacttgagctaagaatttgattctgtttccaatctgatagcataactaa

SEQ ID NO: 154488 - DNA, 582 bp, Homo sapiens
aagtgaactttcctcattatcatgctaaagtcagcaccctgggggggaactacagcttcattaccataacacgtgacctacctgctgacatagtgactcactgcatttgcaccactgggacccctcctctacatgtgatgtcacaccctctcccctctccatcaccccataaaacctccctgtcactttccctagaggcaacaatgctctaaagaatactccaagtattctccttatttgtgacaagtagtaaaactcctactgaccaaaacctgcattctcttgaagagttgtttattactcaccaggcaactaatcctggttttcaagtttttggcgggtaacaaatggttcaggtatgctgcatatcctactgtcacagattgaagtttttctcaatctttttggattaacagcactttagcattaaaataaattactcatatacctctatgggcacataaatctgaaggtataccctttccattaaagcttaaaaatgccaagaattctaaattttaagtctcttcctactttttatagaattccagagctaaaacattaagcattcatgcaatccag

SEQ ID NO: 154489 - DNA, 532 bp, Homo sapiens
gagtatctaattgtagttttgttgttatttttcaagagacaggatcttgctctgtcacccaggccagtatgcagacacagtcatagctcagtgcagcctcgaactcctggtctcaagaaatcctcccacatcagcctctcctgtagctgggactacgggtacatgccaccttgctcagctaatgtttattttttcgtagagacggggtctcatgatgttacccgggtttctaactcctaaccttaaggaatcctcccaccttggcctcccaaagtgttgagattacaggcatgagccactatgaccggccttaatgccttaattagttttgatccgcattttttttaatgatcagtgatattgagaatatttttatgtgcttattggctattcatatatcttctttggagaaatgtgcaaattctttggccatttttcaattgagatgtctttatttttgagttggagtattctttattttggacaaaagtctctcagataaatggtttgaaaatattttatctcattctgt

SEQ ID NO: 154490 - DNA, 465 bp, Homo sapiens
atctcctgccttccaattccagacatgataccctgtcagtcagttgccctgcaagactcaacaaaagggtttcctccctgtaaatgtttttatgtctccactcaggaaagaacatcctctccctcacttctctacattgtattctatatggaccacctcagtgatagctccgtgagccctacagagaaagtcagctacagtgaataaataaggcttgggtaactattagggacttttaagacaaaatatgcatttgacaatgaattaattaacattatgtaacacttgattcaattgcattgttttgcatgtagcatatatcaacctccctgtattgcagtgagtcattccagatgtagggaacacatgtactcatcccatccttgaatcccacgttcttccataataagtgtttattagtagatgtgtgttacatgaataaattaataaattggtgaatgaatg

SEQ ID NO: 154491 - DNA, 474 bp, Homo sapiens
ttagatgtgagttaattgctgaccatgtggatttagaatctgttttaaactgggtgtatttagaagacagtgggtcttcattggttgtggttttagtatctaatgaaaccagttttagtttttagaccagtatagctatcttgagaattaactttggagtctatgtggatacctggggctgggctttgattctgtcatcttcagaagtagtgtcactcttccaggtagggcacatgatctgtttgtgagcctgatttttcatttgggggaaatttttcttttcctttgcagaagagagttggtttatatcctgagaaaagtagttgcccaaataattaacaaatatggatactgctgattcttctttcacttctttttttatttaggctaattttccccagcatcctttgccatgtggctactttaccagaacaaaggcaaattcctttgcctcattcttgcatcatttgagtt

SEQ ID NO: 154492 - DNA, 293 bp, Homo sapiens
ttagatgtgagttaattgctgaccatgtggatttagaatctgttttaaactgggtgtatttagaagacagtgggtcttcattggttgtggttttagtatctaatgaaaccagttttagtttttagaccagtatagctatcttgagaattaactttggagtctatgtggatacctggggctgggctttgattctgtcatcttcagaagtagtgtcactcttccaggtagggcacatgatctgtttgtgagcctgatttttcatttggggggcaggcctcagaagggatggggtg

SEQ ID NO: 154493 - DNA, 331 bp, Homo sapiens
tgcaacctatgtgaatatcacatacacgtttctgtgtcttactagaaactatgatttcacatccatgccttcggttacagcccagcatcccaggggtcactcttgctggtctgtatttgtatctcctttctctggctgtgggagccattcccatcatcctcaacacacacacgaggtcaatcttggtgtgtgatgatctccctgacaacactggtggccttcttggctgcgccgtgcctagtgaccctgtcagtgggtctccctggccctgcagaatggtgactcacccttaaagatttttatgctaggtagcaatgcctaggaactgttt

SEQ ID NO: 154494 - DNA, 266 bp, Homo sapiens
acacttcagaacccaagaagtttggacaagggatactaaacaggtacagagttttatgaagcacattttaaaatccatgaaattggaactttaaaactggtaagtcacaatttaattggtagccctgttcttcccttcctgttgttttttgaaatggagtgtcttgctgtcacccaggctagagtacagcggtgcaatcttggctcactgcaacctccacctcccaggttcaagcaattttcctgcctcagcttctgagtagctag

SEQ ID NO: 154495 - DNA, 727 bp, Homo sapiens
  misc_feature (1)..(3): n is a, c, g, or t
  misc_feature (719)..(719): n is a, c, g, or t
nnncagatccagagaacactgcacatgtagaaatgggcttggcctgggtcagggcattgagattggttacataatcttttcaaggattggtgaatgagttggagtatgtgtagaaacctacaaagatgacagtttaatctcatgtcataatttttagacaaataatgtattttaaaactgggtgcagttcctaaagctgttctaaaagtcaatgcaactgaatttggaatgtaagcataggacaacagatgggaaataagtacatgacctctgtgggataaagtgagagttatcaaagaatgtcagtgtttataacaaggaacaagcttgttttggagaattactagatattatggaaaatttttttcttttctacatttggttaactatagctgaactatagcagatcatatgacttggcaaaaatagaaaacttgataaaaatcttctaggccccacaatgtcaacatgaacaaacttctgaaaagtaaaagtagaccgtgttttctcagtatgtgttatcaaatatatgttgaacatataatttttgcccctcagccaggttgtaatattttcctttagtttatctctttaataattgtttacgttaatccattttattttgaaaaaataatgagctagaggatacaaagatgtaaatgaatctaaaagagagaattaaactggcataaagataaatataattcaagcaagatacnttattccc

SEQ ID NO: 154496 - DNA, 1359 bp, Homo sapiens
gcagacctttgttctctgaccacttgataatgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctcatctatgaggagacccgcggagtgttgaaggtgttcctggagaacgtgatccgggacgccgtgacctacacggagcacgccaagcgcaagacggtcaccgccatggacgtggtctacgcgctcaagcgccagggccgcaccctctatggcttcggcggctaaatggcattttgaagcccagtcattctctaaaaaggccctttttagggcccctaagctttcaacaaaagagttgaaatgactgcaaactgagtctcttaatagggccattgtcagtgagttctgtcatcctattttacaagattaactcgacgccgaaaatgggctgatgactacaggtgaccttgggccgagatttttccaaggccagaagagcctctgctggccagtaacttctggcggctgcctggaaattgcctgcagccggtttaccgctcggattagtttagaaagccaaggggtctgcggtccaaataggggcgggctagataattaacttccctctggaccttcaaatacgtctcaggagataatgagtttgatgggctccactaaatgctagaacctccaggaaaacttcgtggtggctggtttaagaggacttggcgggcacagagctctgcatgggggggagggggacagaccatgcttttactactgtagaacagtagggcagtcttaagagtcttagtaataatattcctttatatgtttgccttttaaatactggaatatatcaagtatacaaaatgcgctggtgaccacaccacttattcaagtgcatctaaaatccttatgtccctttctcagtagcacagccctccctttttcctatctagaattaactaatattctaggataaactgatattctaaatttgtttactgttcccacgcgttttaactttagatgcacatacccctaatctattttaatcgtcatgaatttttacatttgctcttgaaatatatccgtgttgaaatgtgcagttctaggttatttttaccattaatctagttttctaatgtgtcagtaaatactttattcatttctctgttgattttttttcctcattacaaaacagcactgtatacagctgtgcattttctggttacatggaagtggaattatttggtaaatgtgcatattcaacatgaataaaaatgaacaatttgctttc

SEQ ID NO: 154497 - DNA, 353 bp, Homo sapiens
caaagtatgttcatttaaaacattttaaattttggtcccttgaaaagggttatacttttgtttctggaaaattaactcaggaggaacatttcattccctagtgaggctggataaatgacacacagttgaaatgtcttatctccgaagtacttaaggtgccaccaagcaccttaaatgacaaagcagaaaatgtcagagaatgacagttaagaagaactaggccgggtgcggtggctctcgcctgtaatcccagcactttgggaggccaacacgggtggatcacgaggtcaggagatggagaccatcctggctaatacagtgaaaccctgtttctactaaaaatacaaaaaatt

SEQ ID NO: 154498 - DNA, 79 bp, Homo sapiens
catccccattacaccctcgggaaagaggagccagccccctttcaagccttagcttccggctccaagcggaccccctccc

SEQ ID NO: 154499 - DNA, 516 bp, Homo sapiens
ctttatacaatactcaatgagagcagaacatgccacccaagcccttggtggagcgccccgtaaaaggaacctacctatttgaggttgagaagaggctaagggagaggtctccctgaggagaccgactttgacaccccaagacagcagggaagggggagcttaagaagaaacaatgctggcatgacattcctattgccttgtcagggacaccgccagagatgaactgggataaagcaggagaggagacagagagtgtcagaccacattccaccaagcattgctgtgattcaacctggggaagctgattggaaaaaaaagaaagaaaagttttgctgtgaagcaaccctgtctgccaaaaactgaaaatgaagaaaagatgtattccccaccctctaccgccaagtaccatgaaagcccactacacttcactccactctaccacagcacccttcagcagataactagccccactccaagtaaataataatcagaaaggaattaacttgggaactttgc

SEQ ID NO: 154500 - DNA, 524 bp, Homo sapiens
tttgtaaacttatcattcagcacctgacacttggtaagtattcaaaaaacagtagtgcttattattatttcatgaaataatgcctaaggtggtgtcccttcttggaaacacaggcccatgaaaattcatccacagtggcaaaaatacactaatttatatccactaagcaataagatataataaagggaaccctaagcggaggtttgaaatggatgatctgtgtattcaaatactccgtatcatcctaaaatgaaggtggcatttacaacagctgtgcccatgcaatcctgcgaatgaatttgctacatgatatatcctaaagctgttgttaacccaagtttagcatccatgataacatacccatgcttctataagcaggaggaacctagagttgattttagggaaatgaaataaaagtgaaggggggtgacactcggggcagggcagaacaaatgcactgcatcctggagatgagctggaggggaaggggcccaaggagaggtgtgagatgggatatgagaaag

SEQ ID NO: 154501 - DNA, 239 bp, Homo sapiens
accggtatagggcactatgtgtactgttgatgagcactccctacccacactcctttgctgctctccctctctcctccactctcctggcactgacatgggctagtctgctctctctcattggcacagcaaaatctatttgattcgtgccaccacctcttttacctcattctttcagtggcaggcaggtacccaggatgtaacagaggatggcagagaagagtgaaattctacacctgtgg

SEQ ID NO: 154502 - DNA, 434 bp, Homo sapiens
gtctgccgcgatctagaggatcccgacgtagcccactgctcaaaacaggagctcttgtttatgtgggctatgcctatcaatgtttaccttagtagtcagtaaaactgggatttttttttcaaaggaacaccattatgaatagatgatgctaacattggtgtatccaccactcagcttcagaaatcaaactttactgatatccttgaatccccatatgtgtccttccctgaatgcattcctttgtcccccagaagtacagactatccaggattcagtgtttatcattcccatgtctttctttatgggttttctaaatttagaatatccccagagacagtttaaaatttttaagccaatgcagccataacacagtatgtgtattattttggaacttttattgacttggttcatccacccctccaggtgccattggt

SEQ ID NO: 154503 - DNA, 416 bp, Homo sapiens
tgaaggattctggttgtggtacagggatctgtaaatggggtggttgatctctaacccccaccccccaccccagctctgcaattctatgcttctagactctctggaagggaacaccaccaggaactgtggctgtcccactgccagaggatacctcacctatgccaggtgtcaccaattacctatttccagctgtagggcctaggaccttggccaacattggctccttccaccaggtaacagggccagttaggctgtacaagggatccatcttccactggagatgcctccagtgcctccaggttcactgatcattggctgcagtgtgtgctctacttagccaactcccccttgccatagcctctttccgtctccctgctgtgtgctgttccctttcagtgctgactcttgtccccttg

SEQ ID NO: 154504 - DNA, 433 bp, Homo sapiens
agtggcggaataaaaccaacttagtacactgaaccagcattttaaaaaagaaataagtaaaaaagtatcagaatgaattgcacaaagagtaaacagtgtttttaaaacttctttttcatacatataatgtatggactgggtttcaaggtttaaaaaaaagtacatgttactatgtttcacaaaatttgaaaaacaccatcctagagcaataagtctttttcttttcttttttgagacagggtctcgctctgtctcccaggctggaaagcagtggcacaatcacagttcactgcagcgtccacctcctgggcccaagcaatcttcccacctcagactcccaagcagctgagactataggtatatgcctggctaatttttaaattttttgtggagacaaggtctcacttggtttcccaggctggtcgtgaactct

SEQ ID NO: 154505 - DNA, 428 bp, Homo sapiens
gtgtattttacactggagcccacccaggctcagtccttcattacatctctctcagagagatggtctctgaccacccaggacaaagcaggtttttctgtgagtccctgtcagaacactctcctttttccctccattgtacatccccacattttggaattagtagtttacttattcgtgtgtttttctgctctcctgactagcccatgagctccctgagggtaaggaccaatgtgtttaattcaccactgcagccccattgcccagcacaggatctgacatgtacagatgggcaggggcaacgttgaaagaatgaagagcatttttgtagacctaagaacaaaaagatcagctgtcacctgcaatcaggacactttactcttccccctgcatgcatcactcatcttcccagttgtgtatcaaaagctgcc

SEQ ID NO: 154506 - DNA, 160 bp, Homo sapiens
cccacataataatatctgtagccaccttgtggggccctgcttctgcagacctgtaaatgtcttctctttcctttcatattttgggcatcagatggggaaaattatgcttctggctcaaggaatatccgtattaaccactgttaaagcaattgctgggcca

SEQ ID NO: 154507 - DNA, 364 bp, Homo sapiens
ttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttg

SEQ ID NO: 154508 - DNA, 455 bp, Homo sapiens
actgaactaggtcaggcaagagaaattcattcagctgcacttcagtttgtgctggattaggcttttcagttctcactttcttccttcccgctgttctctgtctccctcatcttctgcagtgttctgcgagtgtcttagagggcgatgtaagttttacaaagctttttgaaattagaatgttctaagtttggaatagtagattcattaattttccaaaggctaactactaaggaaaagtgtgaggtttttttcttatcaccatcatctgattaaccaacaaagattaagtgggcaatttaacatgtcgtgatatctgccataactatcagttttcctgagttatttaaaaagaaaaacaaaacatctcatttgtctggtacgtccaagaatgaattaatagtttatatcagtaaattttctggattatcaaagcttactacagtatgtgtcaaaac

SEQ ID NO: 154509 - DNA, 107 bp, Homo sapiens
ctccgtctcaaaaaatttaataacagcattggaggctgtgtcaccacttacacctggcatcctataataacacacacccacttgcctgttaactcacaacttttaag

SEQ ID NO: 154510 - DNA, 465 bp, Homo sapiens
tgagaagggaaggaattccagaatagagcaacagactaagttatgacctgggtgggggttagcatgactggtgggaaagacagagaagagagcacaatgtatggagtaaggtggccttattttgaagtcaaggaggacaggattggtgagagaggataggccagatcatggaggaacaaaaaacttaggaaggcctagcacagtggctcatgcctgtaatcccagcactttgggaggccaaggtgggcagattacttgaggtcaggagttcgagacgagcctggccaacatggtgaaactctgcctctattaagaattagctgggcctggtggtaggtgtccgtaatcccagctacttgggaggctgaggcaggagaattgcctgaacccaggaggcagatgctacagtgagccaagatcacaccactatactccagcctgggcggcagagtgagacttcgtctc

SEQ ID NO: 154511 - DNA, 572 bp, Homo sapiens
gtgactagaggatcccctgcagcagatcatttcatattgctccgtggagtgtggcgagtcagcatcaatactttgcccttcctcctgtccccagctgtatcagtttgagtctgctggtgagtatgttcactgcttctcatggtccttctgcaaagtgctgcccagccctgctggccgctttgtgtctagttcacgactggctcatgggaacaaccttcccgagttcttgcttgttcaaaacggcctggacccttcaccatgaaggtcggtttggctgaagatgccagtcttaactccacttccttcccccagtgctttttagggccctaccgggcactgtctggagggtgggtgtgtgtgcagaagtctggcgatgtctgagttctcgatctcatcagtgactcactgtcattgccgtgtcttggtgttggccgttacagggcattttcgccaatactccgggtgcttgttgaacgtgttgctggacttcagggaagttgtctgtttgaaacgtgtgtttggttctgtttggttttctgcttctgggctgcagtgtggcgtgaggtggcttt

SEQ ID NO: 154512 - DNA, 508 bp, Homo sapiens
aagttgcagtgagctgagattgcaccattgcactccagcctgggagacagcaagactccgtctcaaaataaataaaataaaataaaataaaatactctttcccagacttaaccttctttcttttggtaccttaccttgccaaaagagggttttgttgttgttgttgttgttgtagttgaactagacggtcctactgaaatgttgggcatctctctcagatgtgtcgcgtctgaattggtgctcaattctgtaccgcataactcctcttccagttttctctaacatggatggtggactcaggggaactgtactctgtcggtttccagatagtagtggggaacgagatgctgtgcgaagatggctgtcctgttgaccatccaagagtgtcttctacgcccaagatggatggcttctggaaatgtacagcctcatctgtagtaaccatcaaacggtgaagcatcctggtgaagttgagtggactggggaacactcagcattcctcgcaaca

SEQ ID NO: 154513 - DNA, 452 bp, Homo sapiens
ggatacaaaagcagcaaggacagagcatgaacacaggaggcacaaagttctagcacatttgaagacacgcctaaactcttgccattagaaccttcaacatttttccccttttcccaaaatcgtccctttgcttactacatattgtcagtaccgccttcaaccaaaagcatagttaatggatttgatatcaacgctctcaagtcttaatacaccgtgttacctgtgacttcgactgacatatcctttccaggggatcagatgggaagggtgcctgacaggaacactggagaatttcagtcctgatttgaaatgaatgatttaagccaactgatgccgaaacgtggtgtgttcagaggacccgctggaggaatgcagcgttgtgcctctccccatttatcatggtgtttacaaatcctgttagaagttgaaagtaaattatcatcctgctctta

SEQ ID NO: 154514 - DNA, 381 bp, Homo sapiens
attcagaactatgaaaacccaggagcttctcctgcctctcactttagcttttttaggccctttttattctagtcactggaggctaagagtccaaaacaaggcccccatgttcatgctcccctgtctgggcaaccagcatcaggcctttgggatagcatcttagctcctttccttcctgcaggtacccattcttttttattcaatacccaaacaaaactatacacttcatcacagtcttctaacttcaggagaataagattattcagaactctgccaaacgccaaaagatcacagcattccctacctagccctcgcttccccactaaagcctctaggatgtggccccacctcagctctcatttcttctagcctcaccactgg

SEQ ID NO: 154515 - DNA, 412 bp, Homo sapiens
gcactcatccctcatctgtcactcccagacctcctcttctctcagcgtccacactctggtggatcctgaagcctgggagtcattctgcattgccctccttctctcatggcctccctcttccgcctacaggtgatgagtaacacacaccttctcaacatcttggttccccttctccatcctgaagccccgccaggtgttgcccgccctaccctcatcatgtcctggtttctcagtcttgtcctgggtttttcctatccagcctccaagcagtttccggagagtgcttctacgacaatggaaatctgacactatactcctcagcttcaaatagaccgcggctaacactccctatagaggaggaagtcctcttcgcagagccttcaagcctccaggagcctgcaggccccagccc

SEQ ID NO: 154516 - DNA, 279 bp, Homo sapiens
ggggtgggatcagtgaccatagttctcagggggcagtgatgaaacagggctttgtgtctattcaggaatagtatccagaagctcacttatttttgctttccaaataagtaaatatcagaaaggatagctgaggtcagtctagaaaattagaatttgcttgggggaaaaatatgttctggaaaagataaacagtagcttgcagtttcactgttggaacatttgttacaaggtcctggtattgatcttttatcacccaatttccactgggagccatgatgt

SEQ ID NO: 154517 - DNA, 551 bp, Homo sapiens
ttcgagctcggcaccccagtttaccagggaatgcatttaaaataatgagaagaaaaaataaacatacttttaaaaacatcaaacgatggtgttttctccagaaaggagcaaaaagatcaaggtattagagactgtgaggcagttctgttctgactttgggatggactttgggtttattctaacatgacccctgcttttctaattatagccagttgtgctcaaacagacaggaggtggaggagttcgttttaaatctatcttcggtttcagtagacatacctcctgaaaatccctaaaatttcaagaggagattttcttttcttttcttttcttttttctttccttttttttttcctcaagcaattgctgttttttgagctccaagggctgacagctgttctagttttgcttggggactttttcacaatgtggattaatcaatgttatgaactgggtccgtggggttttgcgaatgtaattggtttcagatgacactttgctagtcaatctgtgaaacagccgaatgttgacacagctgaacaattccagct

SEQ ID NO: 154518 - DNA, 609 bp, Homo sapiens
tactttcagtctgtgtgctgacttttcaggtatagtgagtttcctgtagagagcatataagtggatgatattttttaatccatagagtctatatattttataaagtgtggaatttagtccacttatatttaaggttattgatatgttggtatgtgaggttctgtacctgtcatactgttgttttttgattttgtgtattcctatttctttccttttctcttattgctatggtgatttggcagttatctgtagtggtaccatttgagtcctttcctatttgtatgttttcttataattgagttttataccttgatgtgtttttatgatgacaaatattgttctttcattttcagatttagaactcccttgagcaattctggtaggattcatctagtggtgatgaattccctcagtgtttgcttatctggggaagactttatttctcctgcatttatgaaggaaaattgaactggatatagcattctgggctgacaggtgttttctttcattactttggttatatcgtcttattctaacctttcctgcaaggtttctgctgagcagtctgttcgtctactgggatttcttttattgataacgagacacttt

SEQ ID NO: 154519 - DNA, 190 bp, Homo sapiens
agaaatgagataacacagaagaacagcagcatcaacataacatatgcacagttaactgtgtgctggcaaagagagaaaggtgagggagtgtagaggcagtttaaatggtacagatatttctttctgcttgcactcagtatgtgcgctgtgaggctgaagatgagatgggaaacaagaatctgccatgctc

SEQ ID NO: 154520 - DNA, 470 bp, Homo sapiens
agtactttcctgatggatggatgcttctctcaaattatttcttcactgacttgagctatgaacttttttctctatctttattcccctccttttaagttagattagtagatttgcatgccaccgttactgagaaatcttatcagttagataattaataatttcaaatgctgctttttagatactgacatataagagacctgaaatacattgtttggaggtgtgtggctttttttacttttaaattttatttatttatttatttacttttcttgaattctgtctataggcctacaaatactctttatttttaagctgtctacaaaaaatattctcttggatcagctcaacctatttcttcaatattttgctaatatcatagtagaccccctctagtaaacagcttttatttttgatctggtcatcctaatatatctactgtcatttcaaatgattctttttttttttttcct

SEQ ID NO: 154521 - DNA, 259 bp, Homo sapiens
cacatttagagaccgtgtaattgaaatggagagaaaatcttccaggactctcatggagagctgatgttttcatgaggattcctgatccaatattgaccagaagttaactgcatggactgaactaacagacaattgaaataatcttttatgactctttgtttaaaacatttgctgattttgtttttcagagtcaagaaaccttttttatcttttaagctatttacagcttttaacatttgagtaaagtatatatatatat

SEQ ID NO: 154522 - DNA, 527 bp, Homo sapiens
atgcctgcagtaatgtttcatgaatgaatgaactcacaaagagcagccactcaaatacatgtcatcatcatcaccactaacattagcatttaggtaatgcttattcctatgtctatgtgttaaacactttacatgtattaccttatttaatccacaaacatgataaaagtgctattaacccgatgataaagattatgatataggtgctactattaaccctatttgcaaatgagggtaccaagtgctaggagagtaaataactttcccaaggtcacagaggtattatagtaagggcagaggcaggatcaaatccaggtctgcgcagtttcaaggcccatgcacttaagcactacagatgtctttttggagactgctatagtcttatttactagtcacgcatgaataactgtaaccctcaccctacatgctaccatctttgtcacaaagaaagttcctcccccagagtatacacctggatggacccgaaatcttttccctcttgaccagaagaactaaaaacaagcttg

SEQ ID NO: 154523 - DNA, 545 bp, Homo sapiens
taagaggccatggggctggggagcagtgaatgggagaggaggtgagtggaatgacagtcactggggactttcagggtcttgaggggcaaagagcagactttaaattttgctctgactttgattttacccttaatatgtgaatgcttcccttccaagacaatattcagaggcttctcactagtgtagggtgagtgaagcccttcagacagtaagggagtctcttcacacactgctcagacactgcactgtgtgtccacggccactgccagcagtggctggggctctgccgtcttcagctgcaggagggatgtccttccatccttcctgcctcctgagagaagtagggttccgaacccagaacttgctacataggtaaataccggttgaacaacagcctcccttggaacctggaagagcaacatgtttgcaagccagggaccatcactacttgagcagagtgtagatgtcatccgtacctctggcccacattaacatcatttactcaaggttcctaagcccttggttgttcagtattccagccctcc

SEQ ID NO: 154524 - DNA, 116 bp, Homo sapiens
acctcaaagtgttagcttccagtaccgctactactgatggtgtttgactctgccttcattcctgaaatgcttctccattgactgggtgtggtggcttatgcctatgacacttatca

SEQ ID NO: 154525 - DNA, 604 bp, Homo sapiens
gcatgttgccatttctggttagcatctgtccccaaaacgattccccccctccaaaactaccttttattattttttccaccagattttctctccaaaactatcatgtagccacacaagcaggaagagaaagagatccctgagatcctccatcaaggctggaaaattggttataaccaatttgctaactccactctgttggaagtggctgagtagaggagaactggggaaagattggtgcacggggtgagcaggacctgcctcctgcatgggatgtggggaattgcacttgccattgttggagcccaggccaaccctcctcatcttacagatgaggaaactgaggtcttgagaggggaaatgacttctgtgagctcacttagttggccaatactaaattagagctagaaccctatttcctactcctagcactttttccacactgggtcagggaaatagggtccaccatatacattcttatcttgactgcaatgctaccacctccaccaccaactcctcaaaggaagcaccatcctgactatagctgtgcccatttttctgtctgtcaaaagcctgttgatgtaattgaataccagcaatgcagtac

SEQ ID NO: 154526 - DNA, 380 bp, Homo sapiens
cataattaatagatctgggagacatgttaatgggatgggtattaagtccaacaattggtttaattaagagcaactaacctagctgggatagagagatctcacggtgacttcatatgggaggggatgccctggtgtgacaggaagccaactggggccaccagtatgtccacccccacccaccatctatcagtgggtttctcggcctccacgtggtgtctggggaagactggggcttcatttaagtgggttgagagaagcagaggttcaggggctcatctccgcaggacctgtcctgaggcaccgttggcactccagcctttgactctagttagaataggtgggcttctggccgggcgcggtggctcacgcctgtaatccca

SEQ ID NO: 154527 - DNA, 199 bp, Homo sapiens
cagtggtagcttgaagctataaaatagggattgaggctacagtctagaaataaaacactaaaaacaatacattggtaataaagataatttaggattcttaggtttgtgggctatgcactattttgtatgacatcatttttcagagaacagtatttgactgggtgtgtgtgtgtgtgtgtgtgtgtgtgagcagcgtggg

SEQ ID NO: 154528 - DNA, 320 bp, Homo sapiens
cagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgct

SEQ ID NO: 154529 - DNA, 163 bp, Homo sapiens
acagtatgaggtagaccgaaaacagccacctgcagcaactgctgccaagtcaatttcttcactgttgaaagtaagtgctcagtctccaaacacacaaattcaactaaaagcaaataatggctgggcacagtggctcacgcctgtaatcccagcactttgggag

SEQ ID NO: 154530 - DNA, 303 bp, Homo sapiens
taactgtcttttggctctgccttcacatggcttggcattgtataagcaagggtctttgggactcccagggaaccccgttctgacttcctttcaggatgtgctatgtgctgagggctctctgatggggacctcaaacctgaggggctcttcccctcaatgtcatcatcctcagcatagtcctcaggcaagtgaggctctgggtgaagatcagcagaggtgatgagaagcaatgagaagatgttttccagaagctccaggcacagagagtcaggaatactgcacagatactgttgacacctggcc

SEQ ID NO: 154531 - DNA, 301 bp, Homo sapiens
agtacttttccaaattctgttttccccctaatttaatgacacagatttattacttagcagacatatctataaaacaaacatggggttcatttattaatcagtagaaggatgtgctattgggctttggctgttagttacatttaaaaaccacaaagattaaggcaatgaaaaaatacactgtattttatttgtgttaatgtcaaagcacactgatgaattgagtttctcaggctgtacaactgaggaaaaccttatgtgggatgaggggctcttgctgagattagccttgctgagatgagat

SEQ ID NO: 154532 - DNA, 393 bp, Homo sapiens
gagtgatctgaggatcccctcggatgcaagtgtcgtgacagaaacagagaagatggacacagtggttcacacaaaaaatgacaacttcactacaagtgatttagcagtgataagaattaacattgaataggaaatattggggttaagcagtgcaggactcagtctgttgggccacatagatcaaacccaatacctatgctcattgacatctcttcctttacctgcggttccttaatcattactcatcatcattattcatagaatcactcattcattcactcggtatttactgaggtcctactatgtgccaagctttatatcaagtactcctgcaaatctcaattttcctttcttctgtcttaatttatcctagcttttcttaccaaagtaaaa

SEQ ID NO: 154533 - DNA, 182 bp, Homo sapiens
tggacttctgtcccaagttttttttccagctaccccttactactagatggagccctttgggatcccaactcaatgtagggggtttatcagagatcctttcttgatagatttttttttcttactgtctagccctatagtgctgccaaacctctgctcaactattccttgaatcacgttcctag

SEQ ID NO: 154534 - DNA, 517 bp, Homo sapiens
gaggggtttgtggttagatgggaggaaggactgcctaagacaggggcatctcctcctctggcagtgttggcacagaagtgggagcagcagtggggaaaggggcctgggaagcatggaattataaaaagtgctttgggctaccttggtagggagtggggatagatggggcctagtctttttaaccctgacttctctctgtcagacgatgctcagtgaatctctgttgcttccctgccttctcagccctgatccctctctcgtcccagctcccccagcatgaggcgggggtggggggggcggtgtaggagatcagccagggagctggttgccaggcgacagttgcctaagcaaccccatcctctccatctccatgtgctcagggctgctccttagaagactttagagtctcaccctctgcaccaaccaacctgagggtggggagggttgaggactgggataccaggggtggttggagggtaggtggtgtccaaatcttcaggggcagttgggagagcaa

SEQ ID NO: 154535 - DNA, 383 bp, Homo sapiens
ctaaaagcttattcccatagaataagaagttaacacagggcaatggcctggctaagttttttgcatttttagtaaagacaaggtctcactgtgttgcctggactggactggttttgaactgctgggctcaagtgatcctcctgccttgacttcccatagtgctgggattacaggtgggagacaccgtaccctgccacacaccagcagtctgttttaacaagccataataggtgactcggatacacatgcatgattgagaaaccctaatccatggaaaagggcctaagtgacaactattaatagatactgcagaatttctccttatacactggtatttcttttgcagaaaattgcaaccagcttaattggccagtagagggcag

SEQ ID NO: 154536 - DNA, 131 bp, Homo sapiens
cgacgaaagaggacagccatgtttctccagccccacattgcacttatgattcgacgtcgaaagaatttattttaaatttcccagataacctgagctctgtggtttctgttgctatggaagtggggaagagg

SEQ ID NO: 154537 - DNA, 562 bp, Homo sapiens
ccccttctctcctgggttcccatggaaacttatatttggtgacgcagctgcaaagtcatgaggcatgagccaggctggggccagcaaggaaaattttgtcctggtctcttgcccctttgactgcctctcccactagttggttctgtttctggctgcaggcgcagccatgcccttctgcccgggggttttagggtgaaacctataaatgaaatcactggcgagggcctacagtggcctcttccctaacctaactccgatgtgccaaaggtttcctgtgttggacccagggtggggatctcttcacggggtttctcacacctgagcccccagccaccacagaggtgcagcttgaagtgcatccagccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgca

SEQ ID NO: 154538 - DNA, 316 bp, Homo sapiens
tttgccgtgatcagttctgctgtgaaagaatgctcactctagctgcaaccatgtagaggcaggcatagggaggtggaggttacaattgaagctgaaagacaggaggatcgctcgaacccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgca

SEQ ID NO: 154539 - DNA, 221 bp, Homo sapiens
gtcactaataccaattgtttctacttggcactgcagacttgttttttgagggggagggcagcttgtgtaaagttaaaaaaaacaaaacaaaacaaaataccagaactcttaggttattctatacccctctgtttatagctattaagttcgccaggaaattatacacttgaactcctttcttccacaggcatgattaatgtacctccagaatatgtgccagg

SEQ ID NO: 154540 - DNA, 496 bp, Homo sapiens
gactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaagg

SEQ ID NO: 154541 - DNA, 225 bp, Homo sapiens
ttaagtgtcaagttcaccacctggctttcaaagtcaagaggataatgaaaattattatgccttgcatttacatactgttctgcaatttataaaatgctttcacagcaaccagttcattattccttgtacttgccattctggatgaagacaaatcagcagagagctgtgaaccttgtgtggattattgaatcttccaggatggctttgaatgtatcacaatatggc

SEQ ID NO: 154542 - DNA, 370 bp, Homo sapiens
tcagcatagctaatgcaagaagagagtaactctgggaactatgaagagtaattaacatggtggtcccattctctgaaatagtctctcttctcacctctcctagtcaagcacatatattggtcctaaatattgttttctctttgaaaacttctcaagttctcttcaggaaggaccagtagcacatatccaagcatcaccattttaggacatgagccatcaatctgtgattatttgtttgcaggaagcacgagatttcagactccaggcactttgaagtggaggatcctgagttttgcattcccattatcaaagacagtaacaattggttattaggttctcaaacatgtttattgagtcaatgaatgcgtaa

SEQ ID NO: 154543 - DNA, 99 bp, Homo sapiens
agaggtgaagagaacaggctttggcgttagcctggatttggacaccatttctgctcttccctagctgtatcaacttgatcaatttgcttaatcacattt

SEQ ID NO: 154544 - DNA, 604 bp, Homo sapiens
aagagttcgagaccagcctggccaacacggtgaccccttgtctctactaaaaatacaaaaagtaactgggcgtggtggtgggtgcctgtaatcccagctactcaggaggctgaggcgggagaatcgcttgaacccaggaggcagaggttgcagtgagctgagatcctgccattgcactccagcctgggcaacagagcaaaaaaactctgtctcaaaaaaaaggtattatcttggcagggacagcagttcctatttcttaattgaagaaatccagatttcttctcattccaagagtctgtcaggtaactttcactgttgatgttgctatttccatgccaatcaataatcctgatcatacctgtatcccttaaggaaatcaaataactgaaaatgaagatctgtggggcagataaattcaggaatatttcttcgtttatagaggattcacctcatgaatttgaaatatggcttggcttataaaaagttgatctgcctggagcttgtagctaacacctctgtcgggccaaacaataaatgcttacactgagaaagccaggtttgggatttcaaattaatgtgcccttaacataaactgcagagcccc

SEQ ID NO: 154545 - DNA, 285 bp, Homo sapiens
tctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcagattcatttggcggcatgctgaag

SEQ ID NO: 154546 - DNA, 316 bp, Homo sapiens
aaaagaatgcaacagtttgtctcttatctacctatgacctggaagctccatccttgcttgagttgtcctgcctttctggacaaaatcaatgtacatcttacatttattgactgatgtctcatgtctccctaaaatgtataaaaccaagttgtgccctgaccaccttgggcacacgttgtcaggacctcctgagggtgtgtgatggacacgtgtcctcaaccttggcaaaacaaactttctaaattaactgagacctatctcagatattcggggttcacacttcctattccattccaatactggtggactagctgta

SEQ ID NO: 154547 - DNA, 395 bp, Homo sapiens
tccggggcgtgggggagcagggcgaccctcgcggggacgccggcactgccaggcggggcgcagggcacagggtctccatggagcagcctgaggggtgcccactgagcgggtccaggtcccagcggcgggatgccctggctgcccgaagagcccacgggtgaggggaacatcgccccccgtcgacggggaggtctctgctcacgggcgcccccggcccgccacccggggccgcagagctcgggctccctcttcgctctcctcacgcggccctcccggcggccggactcctgggtccctgtgagtcccggcggggtcggccgcccttctgccgccgcgtccccttcgcaaccccggcgggagaccctctcgagtcgcccgaagcgcagaggcagggg

SEQ ID NO: 154548 - DNA, 535 bp, Homo sapiens
gggatacacgtgcagtatgtgcaggtttgtttcataggtatacatgtgccatggtggtttgctgcacctgtcaacctgtaatttaggttttaagctccgcgtgcattaggtatttgtcctaatgctctccctccccttgccctccaccgcccgacagggcccagtgtgtgatgttcccctccctgtgtccatgtgttctcattgttcaactcccacttatgactgagaacatgcagtgtttggttttctgttcctgtgttagttggctgagaatgatggtttccagcttcatccatgtccctgcaaatggcatgaacttattcttttctatggctgcatagagggttttcaaaatgcagattttctggtcattacaaagtatattggctcatagtcagggatactttaccacaaatttgctgtttcttttttttattcatttattaacaactctgggaataaatcagtggccctgtccatctcagagctgaaaggtagagtctttcatgttcttaatggtatgattttttttgtt

SEQ ID NO: 154549 - DNA, 295 bp, Homo sapiens
ttggagcgagtttaggagcaggcagaagtttttggggtcttctccctcatttcagccagaacatctacacttttatctgtttcatatagtgggctgaagatgtcctgcacaaaagtcttcaaaccattggacgaactgcatttctgtttttgaactggctctttcagagccaacacttggtcctgtaagcacttaatcagatcctgatgacacgcacgcaactcactttttatttcctgcttttatttttccagtgcctggaattttttcacgtattcaattttggtcttttggt

SEQ ID NO: 154550 - DNA, 313 bp, Homo sapiens
aaccacgccggccactgtttaggggcctcctgggggtcgtttcccttgccccctcgggttggggagctcctctaggccaaggaagcggccccctaaaaccgcttccgggactgcagcttctctccccacactctcaaggagcagagccttctcgggccacaattctccgcgacccaaaaataactacacagatgtgaggaaaagggccaaagcctacagcacaaggtggttctcagttaaagccttatcgcttacggccaggaagctcgaaacctaacccagcgccagccttttatagccggtccctcgagcc

SEQ ID NO: 154551 - DNA, 427 bp, Homo sapiens
tgaatgaataaacatcttctgagaaccaaggaactatgttcttatactgacataactttagcttcaaatatagatggaccatgcatgggttttattaattaaaagaaataaagagatattccgttttactctttgaaactagccgctggcatcagactgttcttttgatgaatggtgaagggagaatcaactaacaaccacctctgaagtgggatgcgatgataccttgcttaaagattaagaaggcacaagtccaaacagccttctgcaaacacattttctccaattctacaaaactgtcttctttgttactgttactgtccaaagactgtgcaccccatccttcaaaatcctattttggctaggcacagtggcttgtgggaggctaaggtgagagaatcatttgagctcagaagttcaagaccag

SEQ ID NO: 154552 - DNA, 186 bp, Homo sapiens
gaccttcaaggttaagcagtgcaaggagactttccacgcgggcaggggtggtcagcctcattgcctatctgccttcgtggagttccactttactgtggggttctcgggctccactcctctggttcctcgagggcagtccccggggctgctgctctgtgggatgctgtggcccgtgtggggttcatg

SEQ ID NO: 154553 - DNA, 465 bp, Homo sapiens
gtaattttagtagagacagggtttcaccatgttggccaggctagcctctaactcctgaccccaggtaatccacctacctcagcctcccaaagtgctgggattacaggtttgagccacagtgcccagcctatgattatttctttaggatgcttttctgtaaatggaattgccaagtcaaagtggatgcacatttacaattttgaaattgccaaactttgccagggtgtatgagaattcccatttcctcatggcctcataggtgctgtatggatgattctttttcatctttcagtctgaggagagaatttcatctccagcttgtttcagttgtatctctgcttattgatgatttgtatttcatttttttgtaaattgcctacctttcttttagagtgttcacctttctcttaatgaattgtgaaagctctttatattttaaataaaatacccctttatgttataaat

SEQ ID NO: 154554 - DNA, 121 bp, Homo sapiens
cctggatctagaaacatggaacgcaatgacgaccttgacaagacgtgtctcagtggcacagtggggaagggattctgattagagtgagtggaagagagaaggtgtggaaacagggaacaca

SEQ ID NO: 154555 - DNA, 435 bp, Homo sapiens
  misc_feature (17)..(17): n is a, c, g, or t
  misc_feature (96)..(96): n is a, c, g, or t
tagaggatccccgacgntctctctgtgggggctctgtggggagaagcagtgtgagggcctctgaagagccaggaagctggccctggttctgcaggnatgtggcgacactatagtctagctgcagggttgagaagcagggagggcctctgactgcagaggcaggaagtccaaggttgagtctccacagatctccagctgtttgagtgcaggcttctctcctcaccagaccctgggctccctgaggtcagaaattagtccccatgcctggcacatagcagacaggcaggcagtgcccattcactcttgtcctgcccctcttgtcccaatcccaccatgtcttgctgatactgcacagggcattagccttgagcgggtccgcttctctccagcccgtggccactcacttcctccccacagagagagcgtcgggtaccg

SEQ ID NO: 154556 - DNA, 536 bp, Homo sapiens
atttctgtctgaaatttttttctattcctgtgatcattcttctgttgttatgtattgttcatctgctgttttcttacattctttgtatttcccacgctacacagatgtgttttatacactcattatttcatcagtttatacatcatttaattaattggtaccataataatagtggtgcagttgtataaataggtttgggaacaaacccaactgacccatggtaagcataggaacagaaatgcctggtgactgaaggagtagctggcctgtgacgtggagagaagtcagtatgatagatctggggattagggagtagagatggatgagtcatttaggtggaggctaattgagcttctgcagttcagtatggtgtctcgacatattctcccaatttggtggagattttactgtatttagcagatattaaaataaggtttttaaaaacccattatcagcaaaattagataatttcctcggtttatgaccatttcctaattttttgatgatgtttctaatttttttaaaaatatttttta

SEQ ID NO: 154557 - DNA, 496 bp, Homo sapiens
gctataaggacagatattctgaggcaggatgggttagaggtagagtgctatgggctaaattatgtgttccccacccaccaactcatatgttgaatccttaacccccaatgtgagacagtacctacaaagaggtaattaaggctaaatgaggtcataagcatagggccctgatacaatagaactggtgtccttataagagataccagtgcatagcctctcccttgcactctcttccttcctctctccctcactccttgccatgtgaggacacaaagagaaggtggctggctgtaagccaggaagaaagccctccccagaaagcaaataagttggaaccatgaacttgaattttttagcctccagaaatagggaaaataaatttctgttgtttaagtcatatagaatatggtgtgttgttacacaacttgagcaaactaaaataacatacagttagtactctatgactgcagaatgacgtcggtaccgagctcgatcc

SEQ ID NO: 154558 - DNA, 365 bp, Homo sapiens
aggctggctctgggtggcgtggagataagaatggcatgtagtgaggacacaaagagaaggtggctggctgtaagccaggaagaaagccctccccagaaagcaaataagttggaaccatgaacttgaattttttagcctccagaaatagggaaaataaatttctgttgtttaagtcatatagaatatggtgtgttgttacacaacttgagcaaactaaaataacatacagttagtactctatgactgcagtggatttggtatttaaggatgaggggtgatatcctttggctttcaaattgctaaattctaccactgattttttttttttttttgatatgttgtcccactctgttgcccaggctgga

SEQ ID NO: 154559 - DNA, 453 bp, Homo sapiens
gctgaggcactctagaggatctaggctcattcagatctaatctcatttcatttatactgattcttctggtaaaatagtagtttcattcacctataattttctttaagaaacagagggcaccaactttggaagcgtgtttgcttgatcaaactatgtggaaggtgtgggatgaagaggggaaactatttcctggaagcgaatctggcaccgggaggagtaacgcttctctcctgtactcccttggagttacctactcagtgcctggcatccctcgtcagggcttcattccgtgcctgcttctgactcaaagcaagcagccaggaaggggtgcgaggggatagtccagatttgacagtattgaccccagggctgaggagcattagcgaattccataatgagtttcatccggcagttcttggcttacaaaggtcactgcaatgcaagacccaaggg

SEQ ID NO: 154560 - DNA, 345 bp, Homo sapiens
tctatgattcccctttgtcttctctatttctctgttggtatctgattgtttgtattatattcagaacttgcattatgggtaattaaagtcctttggaatgtgctttaagtttttgaggcttttctttacccttctagtgtattggagcagaaatgcttatactgcagcatggtgttaaggaaagtgcgcacactgttttttgtttacggtattccacggaagttaagtgctcacactttgaacttcctaactgcctacttcctcagtttacttttgcattttacttatcattgggccatatatatatatatgtgtgtgtgtgtgtgtgtgtgtgtgtgtgtgtgt

SEQ ID NO: 154561 - DNA, 260 bp, Homo sapiens
tttatgtttgataagtacattattcataattattgatacaaattaaccctaaaccaaagcttgtatcacattaaaagtgcaaaattagctgcagatgaatatcctgacccaattatgcaaacactctggtaaatctgtgtagactaaaggctctgagaagaaagttgaacttcagaggggtagaggggaggagtatttcagaaaagggatttataaaggaatgaaaatatttggaagacattggtaaaaaggagatactt

SEQ ID NO: 154562 - DNA, 768 bp, Homo sapiens
ttgtctaggtaaagcaaatttttccatgaaagaaagcttggacagaaaatacgcttggtaaatcagtcttctaaaagctgctggagatctctaagggacgtacccagggcctgcaatattatgggtcaatacttcatgaaacagaaggtactcttgatgcaaggatggtaagggatagaaactgtttattgaatgagaaataagctcccactctaggatgagatgcatcattgaggagcagccccctggttttggtgacagaactcctactgaaggacagtgccctgaggatgctgtggtgagatgatgtcttgctgaattgcccaggctggagtgcaatggctgttcatacgtacgatcatcatagtgcactacagcctggaacttctggtctcaaatgatcctcccacatcagtctcttgagtagctgggactacaggaaatgtatctgtatcagaaatcatccagaaaaaaaattgctggcagtcaatgtaactgagcagcaagaatatggtttgcatcatctaggcattgaggagaataataaatgaagtcctcagaattctttttaaaagttagagcatagttgtatgatgtagaagctaactgtacagactttgtagagaacctatccagttcatttaccttgtttggggatcacgagaggatgttgacttccgcgataaatggtaccagggcctttcaccaatggaaaaaaatttctaaaataggcctttaattctcacctttgcgcagactaacaaacgg

SEQ ID NO: 154563 - DNA, 490 bp, Homo sapiens
ggcaagatcaaactatgaaagccagtctgaaggataactaacatatttagactttcagaacctggttccttgggttcaagagctgagtagaaagcttttgttaagtcaaaagatgtcctgttttgatattacctgccacctattggtaatatgcaattgcccttgacgaagaaataactttctgaatttctgatattttaactccatccattataaatatataattttgatttatcttagctacttaaaaggaggccctggttgagaggacttctgaaagttactcccataatttcctattactgtctaatacaaactctctgcctagccaccatctcttgggcgcccccaaacatgccatacttgttcctaattcccaacttttgctcttgttcttctttctagtgagctctttgttctctgccattctaaatctgagtctaatcccagctcttccacaaagacttctttagtttttcaggcccacacc

SEQ ID NO: 154564 - DNA, 468 bp, Homo sapiens
ctgggcagtggtggaaagtaagaggccagatgggaacagaacaagcttttcttgttcatcttctatgtgtcagacatggtgctagttgccattacatataatccactcagtgagcaaatgttctgtccctaccacatgccaagaaagggtctgggaatgaagccgtgtacaaaaccaagtccctgttctcatggggcttacgtgtgagtgagggtgaaaagttgaaaagcaaataactatgcaatggcagatagcatggaggaaaacaaagcagggtaagaggaaatatggcggcatttcagaaaggccagttaggaaagggctccccaagagggtggtgtttgagcagagagtagggttaagtcatggagagtggggctgtttgactttagagtccacactctgggcactaacatgaagggaaagtgcataacagatggctccaccttcgaaagctgtggtctttca

SEQ ID NO: 154565 - DNA, 487 bp, Homo sapiens
tgtccacattcaaggtaggaaaaggagtgaaataacagtactagctacctttgcccctcttctcagaggagcaaatctttcttggaaacccagcagaattctacatgaacctcctcagccaaactgtgtaattttgtcatccttagctgcaagatgctgtgacatatttaactgggcacactgtcacagaaaacaaaactaggattttgtccgggcactgtggcttacacctatagtcccagcattttgaggcactaaggaaggaggatcacttgagcatgggggttctagactgcagtgagctatgatcatgccactgcattccaaacttggggacaaagagagaccctgtctctacaaaaagtttaaaacatacattaaatgggtgtcgtagcatgcacctgtagtcccagcaactcagaaggctgaggctggtggaggatcgcttgagcctaggagtttaaggctgcagtgagctatgttcatg

SEQ ID NO: 154566 - DNA, 292 bp, Homo sapiens
tctttggactttggttcttagagtaatggaaaactcattggagggttttaagcaagagggtttgtgattaaatttgtgttttgaaaagatatttctagctatattgtaaacatgttcacagcagggggtaggatggaagcggggaatcagtgggaacagttaggatgcttttgcatttgtccagttgagagatgatagtggcttggcctaggatgatggtggcagaggaagaaaggggacagattgaggagttacttggaagccggagcccgcagaacttgattatggatag

SEQ ID NO: 154567 - DNA, 517 bp, Homo sapiens
agatagggggtgagcatagggtctctaacactacatgcaaatctttcaagggcaactcaagtcctggctagggaaagtggaaatggggtaaatccaaagactggcaagaaaatattaaaatgttacagttaaggctcactcacactgattaaaaataaacaaaactctaagtgttcaaactgaacacagcattcattatctgtaaccacataaacttaaactcccgaaaggaataaacagacagagggtatttttagtaatacttaaataagttcatacagacaacccagcctaatatattgcaagatctaaagtacctttggaatcattaagaagcaaattacattcgttgagttttactgttaattatatttcttgtactttgaatattggtatctcacataaagaatcaggtcttaacatgtggcctgcctgacatacacctcaagaaaagggctccacaatcaactagtttaggaaatgatgcacactctaaaaaccacttggagactcacag

SEQ ID NO: 154568 - DNA, 478 bp, Homo sapiens
acccactgtgctctcaccccatgttagcccacctagcctcgtactcaaggacagagtgctgatcttccagcttcttcatgtatcctttctacaaatactgagcctgcatgttgatggctgcactgtcttaggctctgggaacaaaagagtgaacaaaagtcagcacaggttccgccctttgggagtttacatggagtcctgagtcctgcatcttttttttttttttttttttttttttttgaggtggagtctttctctgttgcccaggctggagtgcagtggtgcgatctcagctcactataacctctgcctcccaagttcaagcaattctcctgcctcagcctctcagcctctggagccgttgggactacagtgcactaccatgcccaactaatttttgtagtcttagcagagatggggtttcgctatgttggccaggctggtccctaactcctgacctcaggtgatctgcccacct

SEQ ID NO: 154569 - DNA, 344 bp, Homo sapiens
caccctcaccctgcactttcattgtcactgtcattggccattccaacattgtgcttgcatcctgtggaaagtcacatttggggtcaagtggatggtgttgtttctactgtttggttaaaagtgtcagggtgtatttggccttcaagggaggataaggcaggggttggattcaggtgcacccaactcttgtttttttcattttgagacagagtcttgctctgtcgactaggttggagagtgcaatggtgtgatctcagttcagtgtaacaaccacctcccaggctcaagcgattctcctgcctcagcctcctgagtatctgggattacagggattacaccacgat

SEQ ID NO: 154570 - DNA, 242 bp, Homo sapiens
agtgcagctatgagaaggactcaggctgccaacaggaagctaaaaacatcccaccaccaagtgacaactttgcagaaaacctgttgcagcccacgcttggccccacttctaagaagctgacacaggagacagctcgaaatgtgaatcaagatttaaggcggggaacaattatgcatacaataaacacctgggaataacctaagtttccaaccacaaagaattggctactagattcaccaatc

SEQ ID NO: 154571 - DNA, 491 bp, Homo sapiens
ttcagagcgacctggctgtttgtcagtttccagcggtgtgaccttgagtgggttccttaccttcccctagcctcagtttcttcacctgtaaaatggggagaatggtatttgctagaatgaggatgagaggagtgtgtggtatttcagtaaatggtgtcatgcttatattcaacaagtacatttcacgtttactgtgtgttagggcgctggactaattcattgctttacatacattctctcatttaattctcccgcattactattaaccacattttacggaggggcaaactgaggcgcagggttgtaaaggtcacacagatagaaagtggtggagcttggattttacctccctctctcagcctgtgtctcagccacagatctctagagtgtcttgctgtgacagctcacagtttatttctcctttttttttttttttttttggacgggtctcactcggtcccctagggtggagtgcacgggggtgatctcag

SEQ ID NO: 154572 - DNA, 219 bp, Homo sapiens
ggggctgaattctcagaaatgctcggggaagtgactgggtgaggggtacagccattcgcagtgtggggctctcggctgtggggttcttcttaaaagcaagtgtcagccgggtgtggtggctcacacctgtaatcccaacactttgggaggtggaggcgggcagatcacttgaggccaggagttcaaggctggctgacatggtgaaaccccatctctgtt

SEQ ID NO: 154573 - DNA, 570 bp, Homo sapiens
acctctctgctcccagattccaactgttaggtaacaagcgacagcgactgtgtctttgttgctcctcattacaggccaagcacctaagagaggggctgcacatagtaggcctcaataaacattcaccagacgggccaggcatggtggcatgtgcctgtggtcccagctacttggaaggctaaggtgggaggatcagttgaggccaggagtttgatatcagcctagacaacagagtgagacctaatctctacaaaaaattaaataaattagctgggtgtggtggcgcatgcctgtagtctcagttacttgggaggctgaggtgggaggatagcttgagcccaggaagttgagcctgcagtgagccatgagcatgccactgcacttcaacctgggcaagagattgagaccccatctcaaaaataaaaaaaagaaagagaaaaaaatggatggctgattatgaccattggtatgaggaacagtagagagtccaaggtagagagtaccaatgcagagagaggctgaattaagacggaagtttatgtagaaggtgagaaggaaaacttctgatga

SEQ ID NO: 154574 - DNA, 512 bp, Homo sapiens
tccatgagagtcaacaggggaaagtttggctaatgttttctatcactaaagacttaaaaaataactggaaacattcccataggctttgtttgtttgtttttaagaggcttgtttctcgtttttccatgcaaattaaaattcctagtgtggcttctataaatttgaacttttgaaaactttcccttagcatttggctcaaagtgtagctggcacttccgtgtgacaacagagaaatttcagttctgcttttcttcagagctgcgtgttatgggttagataagtaaacttggctttctctgttctaacgacagtgtgtccagggaagctggaagaagaatggctccagggttcctgtcgatgccagatttcaccagcgctaccctgcttttatcagttttccatatagagctttcataaaggttttctttttctgttttttaaattgtggtaaaatacatataacataaaatttaccatccgtgacactaactgcatttaccatgttgtgatgc

SEQ ID NO: 154575 - DNA, 530 bp, Homo sapiens
aatacccaatgaaaatgtaattttttaaaaattatggccaattggtagttttttaaaaatctgttatgccttgtcatgataaggataggtgaaaaggaactttcataaactattgctaagtatatgggtgaaaccttttagactatttgggtctacctaataaattaaaatgttcagtcttttctaattttagcaccgtatttctacagatacactggcatatctgtggagaggggcacttctgcttgtcacctgatatcccttactactactaatatttttataagcattattacctttaaaatcatgttaaagggtaaatgatgtgcaacagactcagtttccccttctctgactcctgtttagtttacatctcttttctctctctcatttgggggctcaatacccttaagattatagagaaattgcagtaggtaatgttggctggaaatgctaacttgtaagaaacttgggtggaaatggtttaagccatcagcctaaacgatcagtgaaaatgtcagacattctcc

SEQ ID NO: 154576 - DNA, 387 bp, Homo sapiens
tcccatagtgaagatgactcttcacgacctgaacttctttatcatctgaaccagtttttctgggccacaatatttactgagatgctaatgatgatgctgctgtagtccctctctagaccaaagtactactggttaggttagcaggcaggtaatgcttccacagccactcgtttcagctttcattctaatcagttctcaaacattttaacatctgaatttgttgatggccctgtccttaaagaaattatttttgctcacggttaggcaatatcgtctaagtcattttacttctgtctatgccttctttcatctctccccaccaacctcctagagcctaaaagaaggcattttccatgtttcttcttaatacacacatttttctcctcc

SEQ ID NO: 154577 - DNA, 480 bp, Homo sapiens
gatctcactgcttccttgtctatagaacctcttgaataaggcccagcttttcctcagctctttatccagagcccctggcagagtcattgggagtgatgcttaagagaggaagggaagaggaaggaaggagcaaaggacaaaggcaggcagatgggtttccagtgggtttccgattcactggtctgtccatgtcctttgaaaagctgtgtcttttctttaacttcaattctgtgtcagggccttccgagccttctgagttttccccaaccttatcttagagtaggttaaatgaagtggcttcattttcatatgacacagttgcacaaattcactaactaaaaaatggaatggaggctcacaggccataaaggtgttgtgaagttattgcaagatacttaacagaagaaagactctagtcatctgttccttatatttatccttttttgtctaagtcacatcaaaactctttgtcacattctt

SEQ ID NO: 154578 - DNA, 331 bp, Homo sapiens
cttctactactcccttgcttgcttactccacttcagtcatatgggaattcactttatttccactttaggagcaccagacttgctgtttctctgcctgaaaagcactttccacagatatctgcttgatcccttctctcattgcacttcttcacttgaggttctgttcacatattacctcttcagtatggcctttgccgaacatccaatatgaagtattccacactcttatgtttctctttcctcctgctttgcacttcatagcacttaacttatttaatatcatattacatgttaacttactctctattcttattagaatgtaaacattcat

SEQ ID NO: 154579 - DNA, 507 bp, Homo sapiens
agggaaatccattctaattgcaatctgcctcaatctgcatttactggggactatatgaatacatttacccacctttccacaagtcacctctttgaacacttaacaagctgcattacaacatcttggatttactcagttttctgccccactaaaatgcaaccatcatcaaaggaagaactatacctagttactatggctattctattaagatttggattgacaaatcttcgagtgcctaggttagctctaatccttatgatgaccctccagattggtattattacttttccccagttttaatggtatggaaataaactaagaggaattgacttcaccatgctatcaaaactactaaatagtaaaacccaggatagaatctagatctgattcctatacttatgttttaccttcctaattaacctcttttagatatacaatccaatttgtcagttttccttaatatgtgtagcaccccaaacagaatccaatattcaacaaacaatccaa

SEQ ID NO: 154580 - DNA, 760 bp, Homo sapiens
caaaaagcatcattaatgaggcagatgactctgaaagaaacatttaaaaaagccatccagaggaatgcttcttcctctctacaggacccacttcttggtccctcaactgcttctgatgcttcttctcacctaaaaataaaataaaatacagtgtacagtaaccttttagtcaaaacagcatcatacttggaaactgaaagcctactgttatttgttattgttgcttaacagctgatacaggtattctggtgacactactgtgctggcttacttaacctgaatacactatttttttcgttgtattactggtatgtcattttttttactgttaagtacttatgtgtgaataagtgtaaaaaaatgattgcttatcggtaacatataaattcagaatcaggaatgatggtgatgcccaacaatcacagatcgtccacatgggtggcggagatgttaacacctttgctttctgatggttcagtgtatccacactttgtttcatgccaaaattatttaaaatattgtatgaaattaccttcaggctatgtgtataaagtatatatgaaacataaatgaactttatgtttaaactgggatcttatcctcaagctatctcattgtgtatgtgtaaatatttcaaactaaaaaaaaaaaaaatctgaaacacttctggtcccaagcatttcagacaagggatattcaacctgccctgcagtcttgattactataactgtataataaatcttgaaatcaggtagcctga

SEQ ID NO: 154581 - DNA, 533 bp, Homo sapiens
ccatcaattagaactattggcttcggtaacataatagccctaggaaacccacttgggaaactccctggactcccaataaaggttttggcccaggattctctctctctcctctctgggatcagtaagtaataaaaatacttctgctatttcatgtgtcttgctgtgctgctctgtgtctcacctgaccaatgcattcaaacctattttcctgggcagggctagaatctatagccactctcaagagagagaccttaggaccaaattagaattgacatttgcaaaagagccaggaataccaggaggtggggaatcactgggggtcatcttagaggctacctcccccaagcactattaaaagaataaactaggctgggcgtggtggctcacacctgtaatcccagcactttgggaggccaagacgggtggatcacctgaggtcacgagttcaagtccagcctggctaacacggcaaaaccccatctctactaacaatacaaaaattagccgggcatggtggcgcaagcctgtaatcc

SEQ ID NO: 154582 - DNA, 314 bp, Homo sapiens
cacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggcc

SEQ ID NO: 154583 - DNA, 345 bp, Homo sapiens
acagaggatgcagagaaccccatttcacttcaagtctgtattcaactcatagctgatttttctaagagactaaacctggttcatccataaatcctgatgtcagaagtacattaggccacagttgtgtgaattaccttagtctggaaacctaagccatcatcacatgggtcatggaattctttctttctttgcttaaagatgacaccagaaacaccactactcttagggtacaaacgtcccaagtgagacaaagaaagatatttctaacaaccttctaggtaaagctatcctcttgcctaaaactttggatcatttttggaatttttttttttttttttttttttt

SEQ ID NO: 154584 - DNA, 1243 bp, Homo sapiens
gctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtgggatcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagcca

SEQ ID NO: 154585 - DNA, 494 bp, Homo sapiens
gcctgtaatctcagctacatgggaagctgaggcagaagactcacttgaacccaggaggtggagggtgctgtgagccaagatcacgccattgcactccagcctaggtgacaagagcgagactccatctcaaaaaaaaaaaaaaaaaaaaaaagggaaagctgagacctgaagaacataaataacttatcctagattacttaaaggataatctataccacatacccagatctgtgatttcaaaatccatataactaggtttgaagctaagtttcttattaagattaccctcaacttactattttcgcttttcaaataaaactttttggctgggcactctggctcatgcctgtaatcccagcaatttgggaggatgaggtgggcaaatcacttgaggtcaggagttcaagaacagcctggccaacatggcaaaacctcatctttactaaatacaaaattagccaggcgtggttgcgcacgtttgtaatcccagctac

SEQ ID NO: 154586 - DNA, 434 bp, Homo sapiens
accatagtaccactcactatgaatctgagcaaatctttaataagttttctgttttctcatttataaaatgataataacagtacctacctttatataatggttttgtgaggattaaagaagacaaattatgtagcatacttagaaataatgcctagcacaccatccatgctgtatattttagctgctatcgtcatcatcattgtcatcatcatgggtttcagtttatgtggattgacaggattcattcactcactccataataatagacagcttgtgtggtgggagctggggacgtagcagtcaacaggacttgcagacgtccaagtctaggggcataaagcaagatggcaacagacgctataagggaaagactcccagcactttgggaggctgaggtgggaggatcacttgaggccaggagttcgagaccagcc

SEQ ID NO: 154587 - DNA, 402 bp, Homo sapiens
agtctttctttccactcgtgacatcaaggttatgagtcctacaatcactttagttgatggagttctccacaatgtgttgcagggcctggtggttaggactatgttcctatattagcctctctgcgtggcatgcttactaaaatgtgcaccagtggctctgacctctttgatcacatgacgaaagggaaggggagagagagggaaggctctgtgattatctgattcccatggaagttttccttgttttgttgctggagcactacaaggcaaatgctactcacttctttcaagaaatcccagctgcagaggagttgctgaccacaacaggggctgttgccaaaacactctactggagtgctgctgtggcctagaaatagctgcaaataatgagaagttctcaga

SEQ ID NO: 154588 - DNA, 173 bp, Homo sapiens
gctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctcca

SEQ ID NO: 154589 - DNA, 666 bp, Homo sapiens
tatgtaaaaaggtcttaatgtcatttttgggtatacatacatgtagaaagccctcctgatataaaatccagtagctatttgacagactacccattaatttattactggaacttaaaaataattactgtacttttaaaagaacaagaaattggtcaggtggggtcgtcacgcctgtagtcctagcactttgggaggacgaggcggatggattgtcagagctcagaagatcgagaccagcctgggcaacacggtgaaaccccgtctctactaaaatacaaaaaattagctgcatgtgttggagtgcacctgtagtcccagctactcgggaagctgaggcacgagaattgcttgaaccaagaatcacttgaacctgggagggggaaattgccgtgagctgaaatcatgcccctgcactctagcctcggcatcagagccacactctgtctcaccaaaaaaaaaaaaaaaagcaagaaatgtaaaaaggtgttttaataggacagattataggattcagtgagataatggagaagttttaggaaaaattgtctgatagtcctttctttctattgacatggcccctgtataagaatgctatgtaaatttgtgaaaagtttaatattttctctatttttacgggtagtagtaggcgcgagcgggatcctctag

SEQ ID NO: 154590 - DNA, 582 bp, Homo sapiens
  misc_feature (30)..(30): n is a, c, g, or t
cacattgtatcccccactggagccaaacangaggatgcttgagcccgattcaagcccgattgatctacatagccagacctgggcccggtgccatggctcactcctattatccccgccctttggaaggcccagacggctggagaacttgaggttaggagttcgtgacccgcctggcccacgtggggaaaccccctctccacttaaaataccaaaatcagccgggcgtgttggcacgcgcctgccatccccgctatttgggaagccgaggaaagagaatcacttgaacctgggagggggaaattgccgtgagctgaaatcatgcccctgcactctagcctcggcatcagagccacactctgtctcaccaaaaaaaaaaaaaaaagcaagaaatgtaaaaaggtgttttaataggacagattataggattcagtgagataatggagaagttttaggaaaaattgtctgatagtcctttctttctattgacatggcccctgtataagaatgctatgtaaatttgtgaaaagtttaatattttctctatttttacgggtagtagtaggcgcgagcgggatcctctag

SEQ ID NO: 154591 - DNA, 660 bp, Homo sapiens
agggccatgatttgtactgattttgttcactgttctatccccagtggttagattagggtcaaccacatagtaagtgcttggtaaatatttgttgaatgaatgaaatggctgggacactgagtttcaccctctgcttggaattcttttacttatatgattgttaccactataccacgttggccagggatgctctgttccccctttaatgaacaaggacaaaaacatcttctcttgattctttcttagcataactgagataggctggagagttcaaggaagtgttttgagtactaagaacaatagagaaaccagcatagagaatgcaacaagtattacaacagtctggcttaacagtgtttcactcttggagctgccatatctagcttgttctcatattttgcaggccccatcctaatctacccacttaggagaaatctaattccagcttcataggactagtcctgaccttgccttgatgccctgcatgtggcaccatctcataatctgttactaaggagctcccttttgtacatcatgacagctgccaacaaggccaagagaacccagcaaggctcattttctagtttgagtgttgtgttagtctgcatgggctaccataacaaaataccatagaatgagtggcttaaaaagcaaacattt

SEQ ID NO: 154592 - DNA, 242 bp, Homo sapiens
gggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacag

SEQ ID NO: 154593 - DNA, 657 bp, Homo sapiens
tgcctttctgcacactacttaatctttcttatatacctaatattataaagggacataaacaaagactcagaacaatggaatatgcctattataggagggtacagttcatacttgtttaaaaataaatgtggaggctgggtgcagtggctcacacttataatcccagcactttgggaggccgaggtgggcggatcacgaggtcaggaggttgagaccatcttgacaatgtggtgaaaccccatctccactaaaaatacaaaaattaaccaggcgtggtggcacatgcctgtaatcccagctactcgagaggctgaggcaggagaatcgcttgaatccgggaggtggaggttgcagtgagctgagatggcaccactgctctcccgcctggtgacagagcaagactccatctcaacaaaaattaaaataaaaataaaaatacacgtgggggttttgttctggttatttctcatgcttaaatacagttgtagtaccaaaaaaaggtggagtgacatggaatttccaggtaggcatcaaagaggattaaactagctttccaggataaagaggaaatatagtagaataaggctactaattggagctaaattggcaatataggcaaattgaaggccctgaggggcaaatggaggatgtgacatg

SEQ ID NO: 154594 - DNA, 451 bp, Homo sapiens
tatgaagcatctgagtcactccgagcaggttatggacgaataaacgggccaatgccctgtttttgttgtacccagattttttcctgcgtgttcttgtctctgtagtcctggataccatcaggtgcttgatgaaaatcaaatacaatatgagctctgtcagatataataagcgtttttgcccagccttctagtccttttcctttctgaacatttttctctgtcttcttcaagcagtctaggaagctgtgctttaggatgtcagggtgagttttaaacactggcccttggttcattgtcattcttcctatttcgtccatctttggtaattcccttgtttgcctggatgaaccatctaaaatgattaagtcatatccatgaaaccagggtaagcctgacacaaaacacttgctcatgaagggagcatgtgtcctgaggataaaggttgagaatc

SEQ ID NO: 154595 - DNA, 796 bp, Homo sapiens
acttgcactggttccccattgcctttatcagtgcattcacacactttcctctttgggcctcttttcctcttagtattagctccttcttattaactctggtaggcagaatactagcccctcaaagatgtccacagcctgaacaccagaagctgtgaatatgttagcttgcatagcaaatgggaattaaggttgttaattacctggtgttgaaatagattatcctggaatcgctttaaccagggaggcagaggttgcagtgagctgagcagctccactgcactccagcctgggcgacagggcgagattccatcttaaaaaaaaaacattatcctggattgttccagtgggctgattgtaatcatagggcctccaaaactgcaaaagagagtcaagagtgacaagtaactatgaagaatgattagagagatacaacattgttggctttgaatatagaggaagggagcctccagcattgtgggtgacctccagaagctggaactggtaaggaaacattcccctgaagcctctctaatgctctgatgacaccttgattttatcctcatgtgatcaatgttggacttctgaccaacagaactgtgaaataatctgtgtcttaagtttgtgataacttgttataacaccaataataatgtacggtatacccttcaagacattctttattccatgtgagcattctcctaaaattatgccctttcatgtctgcagtgctcttgcctatgcttcaacctgaaatattctatccttttgtaaaccaaaaataaaattataaacccca

SEQ ID NO: 154596 - DNA, 740 bp, Homo sapiens
acccctggctaattttttttgtatttttagtagagacaaggtttcaccatgttggtcaggctggtctcgaactcatgacctcaggtgatccacctgcctcagcctcccacagtgctgggattacaggcgtgagccacagctcccagcctagcaattcttctagaacaggtctgctgacaatgtagtgtcttgttttttccattatctgagaatgtctttatttcactttcaatacttaaagatatttttgctaaatgtagaattataggttgaaagttcttttttttagcattaaaaaaaaatgttgttccacttccttttggcctccattgtttctgatgagaaatctatagtcattcaaatcattgcttccctataaataatgtattatgtttctctggctacttccaagagtttttcattgtctttactttccaacagtttggctatgaggtttctggatgtggaattctatgggcttttcctgtttagggtttgctgaacttcttgacttttgccaaattttgaaagttttcagccattattccttcagatatttttttctgcatcactgtctttctctttctccttctgattatccagtgacacaaatgttagactttttgatacagcactccaagtctctgaggctctgttcattgatttttctgattcctctctctctctctctctctctctctctccccgtttctccctcccttcctctctctctgtgcgtg

SEQ ID NO: 154597 - DNA, 319 bp, Homo sapiens
agcatctgctaagacattccatccagccaatggttggtgggctcgatgctccctcagaaggtaaattctgtgctgtgcattccctgggttaggagtgactgtcctgggcatcagggagggcttccaggaaggaggtggccccagagccatggggaagcctcctggggccaggactgggtggggaaagcattataggagtggtataaaggaagtgtaattcttcttcttcttttttttttttttttgagatggagtttcactctgtcgcccaggctggagtgcaatggcgtgatctcagctcaccgcaaccttcgcctca

SEQ ID NO: 154598 - DNA, 697 bp, Homo sapiens
tactcctaatccccatccttgagacctccccttctttccccaacttctcatacctaatagttctcttgttggacctagccttccaaggactttaattcagttgtaaacatgacttgttcattatatgacatgttcaattacaattcgattgtatccccttccctcctgattgtcagttgcctagtcatttctaataccaactcttagggaacgctcagctctatctatctttggagaaactcattcctttctctgccagttggtttctgtagtatctccaatgacttgcagagatttccttagtcctctctacagttaattcctagttctaggctcctccaacattttcgtttgcttctctaatctctggattcctccagcatttttctttgcttctgtagttcttggttttggggtgggggggtcagttgggttgctttgtcactttgtgagtggagggtaggtgtctttcccttaattcatgacttccagaagcatggtggccagaaagccttgtcagaactttgaaatgttatagacgtgctcactatggcacattttgtcaggaatgctagaccatgaccacaacacatttactgttagagaactggggttaatctgctaatcaacatttccctagtaactggcagcaatgccacaagatctgtttaccctaccaggactcgcttggaacctg

SEQ ID NO: 154599 - DNA, 558 bp, Homo sapiens
tagcaggaacaccaatttggaagtctaacacgtcccaagaaagtcctgggaagttttcaactttgttacagttgaaacctaatagtgacttctaagaaaatttgtgggctctgcctgctttatttactctggtatccatatattccaatataactgatgtatatagacacctgtagtatgtttctgcctaaaatgtttatttcttgataagaaccagactcacatgttgggatattttatgcaaggggatagtggctaaggtgataatggtctaggctttggtcgtccaacttgaaaccacagaagacaaaatcaaacagggttcaagatggaaaagtaacattagggatcctgcctgtctgataattctggtatagactctgttcagtgtaataaagccacatgatcaccgcatatgctctactaacatgcatgccagttagaaacaagcatggatgggctgttgcctgctagcttttagagggctttataagatcaacttgctttggttgacacttttatttttacttgtattccagaagtgttattgagaaaaac

SEQ ID NO: 154600 - DNA, 137 bp, Homo sapiens
gagagaagtctgaatacccaaaaagacagaaagctgtgactatcagtttgaaggatatggcctaggacttgttatgagtctgcttgctagtaaaggtatgttcataatgtgtattgcagaagtgcgtgttggatcca

SEQ ID NO: 154601 - DNA, 136 bp, Homo sapiens
taagtatgagataccataagggaggatcaggaaagggaaaacaggatttttaaaaatattggaacagggaataaatagcagagaggaacatccttttttttttttttaaacagaatctaaccaggtacccattata

SEQ ID NO: 154602 - DNA, 268 bp, Homo sapiens
gctgagaaactctaatatacagcaatagtttgaggttaaagacagacccttgatattttaagatagttctctcattttcagcacatatatgacatatttacattctgatgtgttttattatcagcctcactagaaggcagctctgtgaaggcaggagttttgtctctttcgttcacagccatttctcctgcaccagagttgtggtagatactcagtaaatactgactgagggggccaggtgtggtggctcacacctgtaatctcagca

SEQ ID NO: 154603 - DNA, 137 bp, Homo sapiens
ccaccttcatctacccctactaacacacatcattaactgaggggcctgctggcttttgcctctgtggaaccacaacccttcactgggcctatgactctgtgcaactctctgtttccacacaacacccattgtcctcg

SEQ ID NO: 154604 - DNA, 480 bp, Homo sapiens
ctttggtctccaatgtttacttaacttcctgccttaagctcatggcagccttgaccctatgtgggacatgatttctaatgttttctccctatcctttcaagggtaatcgggataaaaggagaacacctgtgccatttagacccagtaatctcggggcgggagtggttacttggggcagtggcgggggccagtcagacaccaggaaggaaggacaagaaaaaaaaaacctgtgacacatgcatagaaattactcagggatccttcaaagcaacacagaaatacatataaagtaatcctctttaaaaagaatcgtaaccctggttctaaactgaagacttattctgaaatattctgatgtcatagtctcaaaaactgaaactcttgtaattggaaaatgtaattatctagagcttttgtggcttctgtacatatctctctgttgctaaacagagaataatataattaataaatggtaaaagg

SEQ ID NO: 154605 - DNA, 361 bp, Homo sapiens
  misc_feature (301)..(301): n is a, c, g, or t
tcgggagcccttaaccccgggagcccttaaccctcctctctgggcatttgcctgtgtttgctgaatggttctcatagttggacacggaagttgctcccagttttttcactattaatattagtattagtattaatgctgcagttgatgcctccttgtctattgtaaccatttctcgattgggtgtttttcccctggaactttttcctttacgattgtaatttgggtccggcgtggtggctcacacctgtaatcccaaaactttgggaggtctggcaggtcgggagttcgagactgaacctgngaggcagagatgacagtgagccgagattgcgccagcgccactgcacttcagtctggtcaa

SEQ ID NO: 154606 - DNA, 325 bp, Homo sapiens
gtggaggggtgggggactatagactgcaggccaaatctagccttgcccatcattttgcgaccatctaaggctgctctcacgcttcaatggcagagttaagcacctgtgacacagaccagctgtcccacaaagccaacaatatttactatctggccctttaaagaaaatgtttgcccctgttttaggggaaagataagaaaaaggtccaaacagaaaaagtggataacaaagacgagctggaatgataaaaaagctatgcaaaactagaagaactggcaataattctccaaagtgaagggaaggacagggagttgaaatttgaacc

SEQ ID NO: 154607 - DNA, 337 bp, Homo sapiens
ccaagttcagacagacagtcctaacattagaggtgaacccactggaagcttaataactgacagtttccatactctgtcttccctttaatctctagttatagagcaccaggctggaatgctggtctcatcttggataaaaattctttcctccctccctcattttttccttccttggtttctttctaccttccttcctccactgctgccttagcatttcacatctcaaagcttttgtgtatattaaatccttatattctatattatatatcatgtgcatttcatttattgaagggagaacccctcatgctttatttgactctgtttctttagtggctac

SEQ ID NO: 154608 - DNA, 444 bp, Homo sapiens
catgcatttcaggagtaaatcccacttgtttgtggtgtataatccttctaaaatgctactgaattcagtttgctagtatttgtagaggatttttgcatcattgtgcataagggatattagtctgtggttttattttattgaatgcctggttctgatatgagggtaatactggcctgttagaatgatttaggaagtatttcttactctccacttttttggaaaagttttgagaagggttggtactactagttgttgtttaaatgtttggtagaattaatcagtgaagccttcaggtccaggacttttcttaggagatttttgattactgattaaatctgcttactagttacaggtctcttcagcttttctgtttgtgatttagtcttggtaggggttttttaatttgtttttttgtttttaaaacagagtcttgctctgttatcc

SEQ ID NO: 154609 - DNA, 693 bp, Homo sapiens
acaaaaatggttgtccttgtggagttgatggcacagtgataatattcttctctggaagtagtactatatcctaccagcaacatggcatgtgtgttttcagtcacagctgaaacagggagagagagatttgggagatggaaggagaagaaacagcataccttctctactgccaactctggcatagctgactgtgtgtttatgactctgagactccagaaaccaaagggagatgcaaagaaaaagatggaagaagtaaaatacaaggaacacaagacatgcagccagcaggctcttgagtggttatcatccaggaagatgttgggggatgaagcagaagtacaaaagaacatcactacggcataatagaaacttggccactgagtaatggtgttccagcctacagctacttactgggtccctattgatggcaaggcgtgctcggtgccaagaaagccactgagaatgtgaaatgagatagcttcttctggaatcttgctatctaatcacagtccagattaggagctggcacgagtcacatctatattactcaggaggcactgatgtcaccattatacaaacagctcctaagtggtagccaatttattaagtactgggggtcatgagaaattctgagtggttatggttgcctcagaaggaggaaagcaaagttgtacataaattccacttaaggtc

SEQ ID NO: 154610 - DNA, 247 bp, Homo sapiens
gtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcaggtaggac

SEQ ID NO: 154611 - DNA, 325 bp, Homo sapiens
aagtaggagacactgggaagaaaaagaaaggagggggaagagcttgcaaaggggtgccatttattagccttttggttttgttttttaaaactatacaatagactgggcacaatggctcaagcctgtaatcccaacactttgggaggcagaggcaggaggactggttgagcccaggggttcaagaccagcctgggcaacatagggagaccatgtctccacaaaaagttaaaaaatcagcaggatatggtggcgtgcacctgtagtcccagctacttgggaggctgagatgaagaagtatgcttgagcccaggagttggaggctgca

SEQ ID NO: 154612 - DNA, 497 bp, Homo sapiens
taagttgttttatccctgaaacagtcctgtgaggtagggtcgcgctttttaagatgaggactcaagcacagagagggcaacttgccgaagatcatatagctaacacgctgtagaccacaactgcaacctaggcagcctgtgcatttaaccgcaacgtgatgccgcctcccggcagtgcccaatgaatgcatgatgacttagccatgtgctcagggtcccttgacaccatgcccctgcacatctcacacctccctgcctctgcacacgacactccctttgtctggaaggtctgagccacctggtccagctgacagacaccctcaccttcaaccctcagttcagacacccatgttgagtgttcccaacagtcaccccccgagtccctcaggcatatgggtttagaattctaaactccacatgctgggcccaagggagcctggacacagccctgccacagcacttactgcacatgtgtgtcatgtcttgtccctaccctt

SEQ ID NO: 154613 - DNA, 478 bp, Homo sapiens
cgactctagaggagtccccccctagacacttctcttacaaacttcatttttcttaaaatggaactttctcacatcaggaatttgtgttagttcttagaactggctgtctctcgagtattaagaggcccagtgtctatcttagacccattccattcaaaacttacaggtagcgctcaggactgtttaaggatttccattagtgattctgaaaggtggggagaaccatgactttattaccatctcatcatcctatgaaagaatataagacattatgtaactgtgtttttttttttttgagacggagtctcactctgttgcccaggctggagtgcagtggcgcaatctcggctcactgcaagctccgcctcctgggttcatgccattctcctgcctccgcctcctgagtagctgggactacagatgcctgccaccacgcccggctaattttttgtatttttagtagagacgggatttcatg

SEQ ID NO: 154614 - DNA, 187 bp, Homo sapiens
attagaaagctaaggtcacatttacagacttactctgataacatgtttgctgctaactagagattgtagtagactgacctaggagaagaccaagaatgtaccaaacaaaggagaggtaaagtagagtaaccttttttagaatgtatttttctggtctggatttcagatgtctcatttcctacctcca

SEQ ID NO: 154615 - DNA, 514 bp, Homo sapiens
actgatgagatggctgaagttctagcatctattttggatgttggggatgaaactacacattaggagtactggaatagagaaggagcctggagccctgagcactgtgtggagttgagcttctagtctagttttggactatctagtttggactaacctctggacttctacctaagagaaataaacttccatttaatttaaaccactgttgttttgggttctgctatcacagccaaaatgaatactaactaacagagtgctcaggagcatgtattctggaattagattggccaggttcagtcacttattacctggcagccttacgcaatttgcttcccttctttgcctcaattgtaaaatcaaaatgctccagcctggccaacatggtgaaaccccatctctaccaaaaaagcacaaaaattaggcaggcatggtggcacacacctacagtcccaggtacttgggaggctgaggtgagcagcttgaacctgggagatggaggttgcaatgagccaag

SEQ ID NO: 154616 - DNA, 318 bp, Homo sapiens
cctattgagaaggagtaaagggtctgggaggggtggcagggagttgctaattcatgtatggtggctagagaaggcttcactgatggggttgatgtttcagtggagacttgaaggaggaacaggaacgcagcatgagactgtcttggggaagagtgttcagcagaggcagcagtgctcagctagccttgaggggaacatccaagttggtcatgtgagtgcaaaaaggccagtgaggctgcagctgcgtgagcacgtgctcaatgacggggtcaagtgcagcgcctcttggtagtaagagtagctgagtgtaaacaccta

SEQ ID NO: 154617 - DNA, 168 bp, Homo sapiens
ggagaaaagcacactggtggtggcagggaatctggcagtgatgcctggaaacagtacatgagaaggtctacttgtactatcaactacagtaaagactttcctctggcccaaggaatcaagtttcagtaaaggtgttttagatgaacatcccttaatttgaggtgttcg

SEQ ID NO: 154618 - DNA, 563 bp, Homo sapiens
cccctccatccctggcttgccagtgcagccccaagccccagcatggagagacctccaggccctgggagcgaccagactgcggatgggggcagctctgggcgctgacattcccaagtcctgggagcgaacagactgcggatgggggcagctctgggcgctgacattcccaagtcctgggcgcgacccctcctcagagtgacctgggagtagcatcctggttggctgggttcctttcctggtcctcacatctgcttctgtggccacctcctgtttcagccctccgcccttccctctccttttcccttccatccggttgcttctccagctcttcttggggcacttgggctttagattcagagggtcctggatcccaagcccatttcttccactgggcaagtaagtgccttctgctcccagtgccccacctttctcatctgcaaaataggcagtcgtaggtgccttgcaaggtgtgttactcgggtatgaagtttataagtgcccaacagatgtatccgcaagccctttaacttgttggttgtcatattgtatgacttggaataaag

SEQ ID NO: 154619 - DNA, 553 bp, Homo sapiens
tagaaggttctcaactatatcctcaactaatctttattctcctaagtacagctagaaactagatgttctagttgggaacatgtcttctagtaaatgaaagggcaagtgagctatacagatcagcaacttgtcgccacatctgaaatgctacttagtgccttgccactcaagattttatgcagatgcttaggaagtggtaatcaaggaacacagacttcaggcaattttgacaaagtaagcaaagctgaatgcattagaaaaaaaattctgggaaagggttattctatcataatatgagaaattttcttgctcaaaagctctttgtaaggactctccagcactttgcagaatacagtacaagaagctgctcatatcatgactggggtctggtcataagcatacaatgctacattggctccccattggatccccatgttacaaataaggaagtggtagctcagaggttggggccttcccaaggtcagtaggctagtaaatagcaacctgtctaaaacgaggtgcaaagagtggccctaaaatatatctataactt

SEQ ID NO: 154620 - DNA, 231 bp, Homo sapiens
agccaaagagagaggaaatggaatttgtttgtttctaattcttggaggagtcttctccgtgctcctaaaatcataaccagtgccaaattcaggaagaagaggcgggcaggacagccaatgcagattctataaacagtgaaaactccttcatcttcatggtcagaggaccccctatgctctgattcctccacccaaccaccaccacagccttgcttcctcccaccacctctg

SEQ ID NO: 154621 - DNA, 459 bp, Homo sapiens
aacgatggtcctcagcttctccagtgcccccttcccaccagtatattttcaagcagtggattttgccatcattctgttaatgttatgtattacactgattgattttttaaaatgttgaaccctccttgtattccaggaataaatatcacttgaggatggtgtataacctttttaacctaataaattcagtttgctatcatttttttggaggattcttgtattagtgttcatgagagacattggtctgtaattttcttttcttgtagtgtctttgtatggctttggtattgggcctcataggcctcatagggtatatactggcctcataggatgaatcaaattttaaaagtttatttggaaatgtttgagaagtagtggggttagtttttaaatcatagaatttagcagtgaagctatcagatcctgggcttttctttttttttttttaattgggagatt

SEQ ID NO: 154622 - DNA, 431 bp, Homo sapiens
cagtacatagctgttcagttcccaaatttgtcctgttcccttgggccattgtacatgctattctcctccttcccctagctatcagctatttctgttcatatttggagtctgtcacttcatctggggaagcctttcctagagctcttactagcactcttatacattctcagtaacatcatgtagtttcacaactgaaatgaatattttcctatcacattacaattgcattccttaacacctgtaaacgacaagggctgctacaaatcctagttttgcttacctagggtttagaataatgcttgccatgtaattggttctctgtaaagttgttgttggatgaataaaagggaaggaagtaaagacaggatatatgagaaatgctatgaaagtgtgatcttaggatgaactctaggagaggattgggagagcaa

SEQ ID NO: 154623 - DNA, 531 bp, Homo sapiens
gtcagtttagggaggtcatgttgtaagacatggtgagtactgttagtctcaatcataccacaatctgtagagcacagccaggattgtcaatgttgagggctggagtccaggaagttcaggagcaaagatgctgaaggagtcacacgattggaaacttcattgtggtggcactcaagtcactgtgaccggtgtgtactaagcaatacctatgtgccactcacatgacagcccctgggcagactgtggggaacacagccctcctcctcaatgacatacactagatggggcagaaagggacattctcacccgaggcaatgatgtacactagatggggcctgggaatcagggagggccatgaaggcacatctgcatgacggacacggcgcaccctcatgatggacacggcacacccgcaccacagacatggtgcaccctcgtggacatgccacacccacgccacaaacatggctcacccttatgatggacatggtgcacccgcaccacagacacagctcttccttatgatggaca

SEQ ID NO: 154624 - DNA, 352 bp, Homo sapiens
tcacagtttactgcaatgcaagtgtctctgctggctcccacaccggattgtgagcttaaagtaggaatccagccaggcgtggtggctcacgcctgtaatcccagcactttgggaggccgaggcaggtggatcgcaaggtcaggagttcaagaccagcctggccaagatggcgaaaccctgtctctactaaaaatacaaaaattagctgggcgcagtggcaggcgcctgtaatcccagctactcaggaggctgaggcaggagaattgcttgaacccgggcttcagaggttgcagtgagccaagatcgtgccactgcactccagcctgggtgacagagtgagactccatctcac

SEQ ID NO: 154625 - DNA, 229 bp, Homo sapiens
agcaaaggacaattcacaaattgggcagcctctcgagccagagtaggccgagagcgactcccgtggagccacatgtcggaagaagattaacagacagaaaagggaacgtgatgtatggaaagcagaaatgaggggcagagacagccagagtggttacagtttggcatttgccttatttgaacatgatttgaacagttggccccctttggccaaagcttggtgactggca

SEQ ID NO: 154626 - DNA, 398 bp, Homo sapiens
tacctgcaccagtcataccttcacattgccttatacctgtcatatcgatgatgcggaggatagtgggagagtctgtgtaactatctttctcagccaaattattccaatcttttgcatgcaatcaggatttaaaatgagcagttagtatgtaggctgcactgtgagggggaatgacttccgacttcaggcaattcactgtggccattgttgcacagagaggcgtttcagtatttctactagagcctgtgttttgtgaagcttcgctggttttgccagatgccattggctcatcttggtgaagtgcagctgtagaattggtattttgctgagtgtatccacgtcaacgtctctgaaatactggtgacaaactttttcccaccccaatgagaaaatttttg

SEQ ID NO: 154627 - DNA, 167 bp, Homo sapiens
ctagattatatgactctccttttgtctctgaaacttgtccacagtggagattttgacataccacttttctcaggatctacataatctgaattttgttccatgcctcagtcttgcccactggggtgattgtgccatataactagtctcaattcctaggttatgtgact

SEQ ID NO: 154628 - DNA, 569 bp, Homo sapiens
caacatagaagaacttcaacaaaaactgaacatttgcagtggatcacactgaataactttgtattgcactactcataccactcacgtatataatcactgtcctctggctgattatttccgggaaagtgtaagtacgatactatatattcaatgaaatttaaaaagggtgaattgtcagaaaaaggtttttacattgaaaataggtagtctgtaagtataagattacaagtttttaacacatgatcctttcatttatctcaaactcagtacctattaagctacaaggatcctctttttctaactggtgaacacatgtacattcatcttattcatgctctgatcccattacttcccagtctttgagtgactaaactacagcatcctaaattttctgttgtagtctaacatctggattatttccgctgtccctttgtaatcacctacatgtgacctgaagatctaaaattacttcttctaaaagcataaaagtagtttagtataatatatagctctgtctatgcgcatgatgtgtgtatatatctctgtgtgttttcccgcatatagtcatc

SEQ ID NO: 154629 - DNA, 433 bp, Homo sapiens
tgagagctctctgatggctttctagggactgcagaatgaaagccatgtgcctcagttggcctccaagggcccttcccactccacacctctggtaactcctgtaacccttatttccaccacctcccctacccttcatagtactcctgactctggccagatcattccatgccctataacatctctaagacttgcttatgtccaaaggtgacctcctactcatatgttaaagcccagctcaaatgtcacagactccccttgggtctcccacttctcttgggccccaagaggttgggcaatgagtggtacattgcatttgggaagatggtatgggggattgttggcagggtaactcggttcctgaggatgggggtcctcagaatggtgggtggtcaccaatgtctagcacaatgctaggcacaggatagacacttag

SEQ ID NO: 154630 - DNA, 327 bp, Homo sapiens
atgagcaagcctggatgagagctgatggtgtgagtgggtgtaacgggtggtcccagtctggtcttggtagtggtagaggaggggagaatgaggggagggcttcccttaagaagtgatgtttaaactaagatctgaaaaaatgagtttaacctgattatgcacatagttatggaaagagcatggtaaaaacagtgtgtaggaggaactatgaaaaagccaatataaccacagcacagagatgcaagcacttgctgagtttgacttaccagattgtgtatgacttataaaccacattaaatattttggactttcttctagcagcagtgg

SEQ ID NO: 154631 - DNA, 452 bp, Homo sapiens
ttcgagaccagcctggccaacatagcattagatatgagttctaaatttctcttcaaagaatcaatatgtcagtatgttcaattctttgccttctacttttaaacttaacttccttgtaaagcaacctttttcgatcacctgctccaccctgactcattccgattacctgctctgccctgactcattctccaccctgactccttccgatttcctgctctgccataaccattttccccaccaaaccactcacccggtcactctctttaaattagccaatcggaattagtttagcctgtgcggtctaaccctagccaatatgggaatgacagcggcaggggccacctgtgtcaggaataagaacttcttcccctcttttgtccaggtgtgtgctcaccactgctccatctatgagggcgcacccttctatagaagtaaattgccctactgagaag

SEQ ID NO: 154632 - DNA, 455 bp, Homo sapiens
gcaaaacaaaaccacatgcatttccttgaaactgtgggaagggcccccaacattcctaataagcaagggattggatctggaggtcacaggatgaatgagatgtggcctctgaccccatggtgctcacagtcttatcttcactgtgcccaggataaattcttaccaagggcccccctacagccactgggcaggtgcaagggttcaggttcactcagcttcctttctttctcttaaggctccagtgcagaaaaaaagaatggttgggattactttcttctttctgcagtcttctttatttccttttcctgctcccagctcccagttccctcttctaattagcttctcaggaaaggctttctgcaaccaaaattctggctgttgaataaaaagtagactagaatttcacataaggcaaagactcctgaggttggcagatgctgtgatccttgttcttg

SEQ ID NO: 154633 - DNA, 127 bp, Homo sapiens
gtgtgagggtggcatgtagatgccctgcaatccctcctcattgctgatcttttggcactttgagtagaatctccccctacaatgcggtttgcaccgtggttgggtcaatatctgtcccctcttgtga

SEQ ID NO: 154634 - DNA, 380 bp, Homo sapiens
cctctggtcctgccgagctgtgtcattgcaggtacaagaattgcagaagcagcggcactgtatctgacatggggtcttctatgtcctgccctgatgctggcagcgggtctacccccagctgccccatctcctttattagtatcaaacagaatttggctcaagcgctggctccagcactactcaagatctgacctcagatgagctgtgcctcacttatctgagctttctcaaatgtaaaaagagcaataatggtctgtttcttgtccaggtaaaaagagctgatgtttatagagcacaaaggtcaggctgtgacacatgcagtacttggtattttaccaaggctggtgaaactatgtgtagagtaagtaaacagattctga

SEQ ID NO: 154635 - DNA, 181 bp, Homo sapiens
cgaggatcccctcggccgccggattcctgcggcgccgattcctatcatgaccccagtggcagcaaatgaaaaggctcagattctcctcattttcacatgggttgccagccttgctttaactctgtaagtttgtgttccacagagcaaaatcacaaaagagatcatgcaataggaatcccgg

SEQ ID NO: 154636 - DNA, 307 bp, Homo sapiens
gtagaaatcacagacatgacttcacagcctgagattcactggactgccacagccactgctgagtgttgctgcagcctagaccaagccctataggtattcttgatcttgctcccatctgtgcagtggaaagatgcgggtatgaggtgtggggaaatcaaaccaaaggacaaacatgaaggctcttgtaagattcaggagcttgtgtgaatgttaggaagcaaggtggttaccaggtggttgtgcccagtgctgcagagaaggggctgctgaggggtgtcctaaagtcttgtgtcatagctcctgggag

SEQ ID NO: 154637 - DNA, 542 bp, Homo sapiens
gtgatggtgtctagaggatccctgctattcatcggcacaggctcagtttcatggaagacaatttttccacccgggaagggggatggtttggggatgaaactgttccacctcagatcatcaggcattagttagattctcataaggacggctcaacctagatcgccggcatgcacagttcacaatagggcttgtgctccagtgagaatctaatgccaccgctgatctaacaggaggtggagctcaggcagtaatgcttgctggcccgccactcacgttctgctgtgtgtccaggtttcttaacagggcggggactggtacaagtccgcagcctgggagttgtggacccctgataaatagttatcctcatttcatgtatgggaaaacaaaggtggagagaacttgcttcccttctcaaaggtcaaaaacccgataagctaagcagtagagattcaaatccacaaaacctggcaccagagccaggacaatttttagtatattattttgtatctgcaagagcaagaaacacagatgttttacacaga

SEQ ID NO: 154638 - DNA, 314 bp, Homo sapiens
aatagaggaagagcgaaaggttcaagaaaacattccctcttttaaggacatgcacattgtccactctgcttccaattatggatgatcagccataacatcatctcaaaggaggctgagctgttggctttattccagataacctgctatggatgagtaagttgagaactgatgttagagtaggcagctggccacctctgtcacagtacctcctaggtaatggctttcttcccgtttccaaggtgctcaccccgtacagatgtcctctacttcctcccaatttcagagcagttcaggatataaggtacaaaatgtca

SEQ ID NO: 154639 - DNA, 147 bp, Homo sapiens
ggaggggtgagggctggggttatggtaaggagtctgtgggccagctgggattttggtcgacttgggaggtgctcccaatatctgattaaatatttacgcccccagggaagaaatgattctcttgctaccctggcaggaaagccttgc

SEQ ID NO: 154640 - DNA, 744 bp, Homo sapiens
ccaccgcacccggcccaaatgaatactttttatcaaggatgagtagcaagtaaaatggcggccaacttggctataattgattattttttcacttcctttcagttactagctatttttgcgaactgtctttctaaaaagcctactgtctcgctgttatggactaaattgtatccccctaaaattcacaggtagaagccctaacccccaatgtaactgtatttggtgatagggtctttaaggaggtaattaaggttaaagaaagtcacaagggtggggcccttaatccaatatgattggtgtccttataagaagagagagatgccagggatgtgcatgcacagagaaaaggccatgtgaggatgtaaaggaaaggtggcttctgctaaccaaggagagaggtctcaggaggaaccaaactcaccacctccctactttgaacttccagcctttagaatgaggaaagagatgtctgtttttgagtcactagtctgtgatattttgttctggcagcctgaacagacctgtactcaacccaacaggacttcctctccactctggactttcctaatctctccattttaccattattaaaacttaaatgctcttgaatccagccctacctgcttatcttacagatgggaaagccagtgtccagtaaaggaaagtgatttactcaccatgattcctccagccctgcctggactctctccaccttccttttctgacatctctgttttctagaca

SEQ ID NO: 154641 - DNA, 282 bp, Homo sapiens
gtcaagggaaagttcattctgatgttttcgggtttgacttatctggaaaatctgaggagctagcagagaggtagacaagacaaacaaagtccttcttcagaaggcagcaaggacagccacagagctgaagggagggcttgaacataaagacttcagagacctatctacgtggagagatgaagaagagcccgggagcggaagacctggaacagtgtaagaaaccccatacatcgaaaacaggctcttgggatgagattcactcatccacagaagaggcaaacg

SEQ ID NO: 154642 - DNA, 325 bp, Homo sapiens
tctactccaacggtaatttaacctctgctatgccattagattagtaaagagaaatctaaaagatcagcatctccagcccaatgagccatgtctcaatttttgaaaacttggtggaattccaattaaaaagaaaaataacagggcttcaacaaatcaacagagaaaggagcactaatgtttaccaatacttatcattgccataggaactcacacaaataacatgtttcagatgtattaataaacattaatacgtgtgattaatgaacacaaaataaggtttgacatccattacaagcaaataatgcaaacattttaaaaggcagca

SEQ ID NO: 154643 - DNA, 258 bp, Homo sapiens
gtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaag

SEQ ID NO: 154644 - DNA, 885 bp, Homo sapiens
gatatagggagcttcctgaggactgtgaggcattactccagagaaagaactcatgcttggtcccacaaacccccaagtcctaagaagctgcagcatggtgcattttgggagcctgacttttaccagactgtgtcctgacctggggctcaacagtctcagcatctctacatccttggagtcccactgacattccactgcccacaactgccatcactaggggttgctgcagggcaaggcacaagtgaagtatgcactgtcgctcctcctgctacctgcctatggctgctcccattgaccattgcagagctgcaatgcagccacagctgcccccacctgacctttctgtcagtggcctgggatcaccttgccactgcttataacagctagcacctgcaggcaccactgggggtcctgagggcaggtctgcctgagccagctccatacctccagtacccaagcatgccatccgggggcctggggattgcccaacccagttcaccaccattggcacctcagcattcctcccaggatatgctccactcaacctgcctctgccactatagctggcacccagctgtatgtgccacttgcaggtctgaggtctggcctgcacagcccttcataaccaacaccaacatgaactgcttgattcccagagaattttcccaccactggtctcaagccatgcgtgccacatcagggagggaccactatgtcagccaatgtggctccaggaccagaggactgagccaggtggggtgtacgcaaccaggcggtgaccgggcggagaaagccaggagcggcgggacacgggtgggcgaaccggccactcacggcaaccggggggaaagccgcggaggcagaagcacaaaagagcaaaagatc

SEQ ID NO: 154645 - DNA, 831 bp, Homo sapiens
tagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggagggggg

SEQ ID NO: 154646 - DNA, 419 bp, Homo sapiens
taaacagaaggtcgacatttgttgtagaacgatttggaaactaccttacgtgtccaacaacaaaggactggctagatggattatagcatctccataaaacagaatattatgtgatcattaaaaccagctctcaggatgtgtgcagtggctcacgcctgtaatcccagcactctgggaggctgaagtagggagatgacctgaggtcaggagtttgagactgaccatcctggccaacgtcatgaaaccccgtctctactaaatatataaaaattagctgagtgtggtggtgcgcgtctgtaatcccagctactcgggaagctgaggcaggagaattacttgaacccaggaggcggaggttgcagtgagctaagatggcaccactgcactccagcctgggtgacagagcaagactccatctc

SEQ ID NO: 154647 - DNA, 376 bp, Homo sapiens
tgggaggccgaggtgggtgaatcatctgaggttaggagttcaagaccagcctggtcaacatggtgaaaacccgtctctactaaaaatacaaaaattagccaggcatagtggtaggcgcctgtaatctcagctactcaggaggctgagtcgggagaattgcttgatcccaggaggcagaggttgtagtgagccaagatcacgccactgctctccagcctgggtgacagagtgagacttcatctcaaaaagaaaacaaaaaacaaaaaactgattttggacttaacattgtatagaacaaaatagttgctttggttatgaaaaggacatgagcacccagttggcctgaaggacaagactgatgggctggtttaaggaa

SEQ ID NO: 154648 - DNA, 890 bp, Homo sapiens
caaaatgaggcgggggttgggataccaagtaacctttgacttcatagtttgccttcgcacaacaaaggaaacaataaaacttgcaaacatgatgtgtacgggagaaagcggcctgctagttctcaccatacatcctgctcattaggaatgaggagtgaggaacctactaactaacccaacaaccctgcagtcactgactgcggggaaaggcctgctccatggcttccaaagccctggactctgctgactatcacttcaatcgtgctgggaacctgggctcaggagggaaaggggcttggagcccccaccaagacgagctggggcagccacacccccttccctgccaggcttgctttctgcaactgcgcttcctccccgtctctgccagggtagcaggagtccacaacgtgcctgcctctgttcctaatttccatttactgttttgagcaagaaaactctagtaatgtgcctgaagatgttctttgcaggatgattccaggtaaatatccaaatattaaaaatctcattaactatattaagttttagctatatgacagatcacagagttattaaaaatgattaagactatacggcaacatggaagaatgttaaggaaaaatagaatatgaacttgaatgcatatctgccacacaaataggaaaatatgcatgcatgtactgtggtgtgggatcacaagtaattaaaaagtattatcaggtgatgatttcaaaaagggtcaccgcaggacccagagcccgcactcactagagcagcggtgagcagagtagatcacagcaccgaagccctcccagcagagtgcagcagcttcagcgcgaggccaggcctgctgggctgcccaaagagcaccccagctccctcctcccatgttc

SEQ ID NO: 154649 - DNA, 836 bp, Homo sapiens
caaaatgaggcgggggttgggataccaagtaacctttgacttcatagtttgccttcgcacaacaaaggaaacaataaaacttgcaaacatgatgtgtacgggagaaagcggcctgctagttctcaccatacatcctgctcattaggaatgaggagtgaggaacctactaactaacccaacaaccctgcagtcactgactgcggggaaaggcctgctccatggcttccaaagccctggactctgctgactatcacttcaatcgtgctgggaacctgggctcaggagggaaaggggcttggagcccccaccaagacgagctggggcagccacacccccttccctgccaggcttgctttctgcaactgcgcttcctccccgtctctgccaggtgagcaagaaaactctagtaatgtgcctgaagatgttctttgcaggatgattccaggtaaatatccaaatattaaaaatctcattaactatattaagttttagctatatgacagatcacagagttattaaaaatgattaagactatacggcaacatggaagaatgttaaggaaaaatagaatatgaacttgaatgcatatctgccacacaaataggaaaatatgcatgcatgtactgtggtgtgggatcacaagtaattaaaaagtattatcaggtgatgatttcaaaaagggtcaccgcaggacccagagcccgcactcactagagcagcggtgagcagagtagatcacagcaccgaagccctcccagcagagtgcagcagcttcagcgcgaggccaggcctgctgggctgcccaaagagcaccccagctccctcctcccatgttc

SEQ ID NO: 154650 - DNA, 499 bp, Homo sapiens
gggagcaaataagcagctctcttgttaacaactcgtgactcacagatggtcatctgtggtcagacaggggatgagcagtaaagaaaaggggcaaggtcctcgctgtcctgcctgcacctgctcccttgctcctggggcctcccttgccttcagaaccatctcattttaggttctcctgtcctagtttcctgtggctgccataataaatcaccacaaatttagtggcttaaaacaacagaatttttttctgttatataatagttctggaggccagacgtccaaaatctagttgtcagtaggatccttccatgtttggttcagcttctggtggctccgggtgttcctggggttgtaactgcgtcacttaaatctttgctctgtcttcctgtggccttttccctggtaaccctctcatctcctgtctcttataaggacatttgtcattgaatttaggtcccacctaaataatccaggatgatctcataagatcttaaattaa

SEQ ID NO: 154651 - DNA, 237 bp, Homo sapiens
aatcagctatttgtgggacaggacatttcatcttttattaacttggcataaatgacattctgggacaaggtggtgcagctcctggagtggccactgatacaagcacagctgctggggccagagtgggaaacaggtgcctggcgaagatctcgagaaaaaagagagcaagtacagtccacttgaatcacacttgtgctgagaggctcattgtccacagatgccagcatatctggtccc

SEQ ID NO: 154652 - DNA, 339 bp, Homo sapiens
gttgcctaggctggagtgcagtggcacaatcttggctcactgcaacctctgccttctgggttggatcaattctcctgcctcagcctcccgagtagctgggattacaggtgcacaccaccacgcctggctaatttttgtatttttagtagagacggggcttcgccatgttggccaggctggtcttgaacccttgacctcaggggatccacccaacttggcctcccagagagctgggattacagatgtgagccaccgcgccctgctggaagagatttttgtggtctggataagtgatcaaattagtcacaacattcccttaagccaaactctaagccagag

SEQ ID NO: 154653 - DNA, 111 bp, Homo sapiens
tgaacttagagagattctctgggaggtttctggagccattcaagatctggcctctgagctgggaagccagctctctggccagcactttaaaagggctcaaagaagccagag

SEQ ID NO: 154654 - DNA, 383 bp, Homo sapiens
actcaggctgtttgcgttcaagtctcctgttgtgggctggagcgctgaatcagagtccagatttgccttggtgacacatgacaagaggggccattgcatttgaactacataaatattatgcttaagtgtttttcctcattttggagccaaacaggtctcgttaatgataaaatcactgcaatatagtgggccctttttttctggtctggaatttgagacaatgtcaactgtgccaaggggcctggcagcaggaagaaatggccagccatggagatttgcagccatcatgcaagttataccatttaattttataattgtagccattgggagctggactacagtgcacttctcgtggtctgctcttaccccaggctgcgggagtg

SEQ ID NO: 154655 - DNA, 406 bp, Homo sapiens
ttttttttttaagagaggatctcactgggtcactcaggctggagtgcagaggtgcaatctcagttctctgcagcctcaatctcctggtctcccgtgatcctcccaactcagcctcctaagtagctgggactacaggtgtgcaccatcacacccagataatactttattttttgcagagacaaggtctcactatgttgcccaggctggttggtctacaactcccaagctcaagcgatcctcccaccttggcctcccaaagtgttaggattacatacgtcagccaccgcgcctggcctgggcacaacattcttgagccacagatagcaaaggaggatttgttctagttccacttgacgtggaaagtgagggtgttttcgtctgacgccgagggatgttacggaaccag

SEQ ID NO: 154656 - DNA, 331 bp, Homo sapiens
cagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctaaagtgcagtggtgccatctcagctccctgcaatctctgcctcccatgttcaagcaattctcatgtctcagcctcccaagtagctgcgactaccagctcgtaccagtgcatgtcaccacatccagctaatttt

SEQ ID NO: 154657 - DNA, 176 bp, Homo sapiens
tgctgggattacaagtgcgagccactgcactcagccaatctgggagtatttctaaagaaaaaaattactttgatttgtggaggactaaatcataatacatttctatgcaacaatagcttctgagaggctgaggcataagaatcacttgaacccaggagggtgggtcagaacataag

SEQ ID NO: 154658 - DNA, 661 bp, Homo sapiens
agttgatctaaggatccctacgtctcgatcgtaaacagtatacaaagagtatataattttggtttcgagacaggctctcactctgtcacccaggctggagtgcagtggtatgatctcggctcactgcaacctccgcctcccaggttcagacaattctcctgcctcagtctcccgagtagctgggatcacaggcatgcaccaccacacctggctaatttttgtacttttagtagagatggggtttcactatgttggtcatgctggtctggaactcctgacctcatgatccacctgcctcggcctccccaagtgctgggattacaggcgtgagtcaccatgccctgcctggtttaagattaaaagatgacccaaagagagaaaaagagatccctgcattagacagacatgagggaaatttggggccttcaggtgtttccatttactgtacatccttggatagatgagttcctggaaaggaggatgggagtaaaggtggaacaataggagaagggtgaacaggattttttaagtctgatttaaataattgggatatacctataaaatatatgttgtcatttatgtttaaaaagctttctgttcttacgtgagtatagctgaaggattagtggttgaccaatagtgcctggtactgatttgtaat

SEQ ID NO: 154659 - DNA, 182 bp, Homo sapiens
tgccttttgtctacttggatgtagtaatgaggaggaagatggggcattgtggggcgtgtcctctaacttggaacagatgtaatttatttctaggtgaaagttaagaacagtgcttactcattctatttatctgccctccttttatcttcggcactttttcctacagccctgtttctgagctc

SEQ ID NO: 154660 - DNA, 298 bp, Homo sapiens
  misc_feature (123)..(123): n is a, c, g, or t
  misc_feature (126)..(126): n is a, c, g, or t
  misc_feature (131)..(131): n is a, c, g, or t
  misc_feature (140)..(140): n is a, c, g, or t
  misc_feature (267)..(267): n is a, c, g, or t
cttgaccttcttacataattgtcttagctatttctatctctggattttcctgtaaattttacagtcagctggtcatttacacacacacacacacacacacgaaaaacaaagaaaaaaatgctnganctttntctaacttncccttgcagtctgttgtgtgagcagcctgtttatttctctaatattatgtcagtttattctctttaatggactgtaaaaaaatgtaatcacaagagtgccaaatatcttgaaatgccaaaaggcatnttagtttcttttctctgtgctctgagtccac

SEQ ID NO: 154661 - DNA, 337 bp, Homo sapiens
atcctctcttctgctgtttcccttgaactctgtgttccaggcataccagatgcacttgaagtctcaggtctgaggactgggccagatgtcccctctgcccacaatgcctcttccttttctcttctgtgcaacccctgtgcatatgcacacacacgtgttacacacacatacacacacacacagcatatccatttggtgattcccacaaattctttgagactcagctctgaagatgccccctgggaagctcttcctcacactcataatcagatataggcacctattcctctgacaccaccccttcagccctctgatgaagcaaattattttttattgt

SEQ ID NO: 154662 - DNA, 448 bp, Homo sapiens
ccaacgctttaattcacatcctgatctttcccagtgcagtttccacagctctgctatgccgggtgataaaagacccacttcctacaattgggcttccatggcaaacacggccagttgacccatatagtatgatgccaggcacttgggacaggcgggagaaaaagatattttggggattagggtggagcaacttttgaagggtcccatggccctggctcactgcaagaagagtcccaggccgggtgtgatggctcatgcctgtaatcccagaactctgggaggccaaggcaggcggatcacttgaggtcaggagcttgagaccagcctggccaacatggtgaaatcctgtctctactaaaaatacaaaaattagctgggcagggtggtgggtgcctgtagtcccagctactcggtaggctgaggcaggagaattgcttgaatctgggag

SEQ ID NO: 154663 - DNA, 403 bp, Homo sapiens
agtctactgaaatacagtcgagcgtgctctaaatttccaagcctctgctcacattaaccagatacgtctctttcaaacattcaaacaaatactctaggtctcctcagacactgagttccagcatggctgctataaaaagaaagccctcacctccgaggtgttaccactttcatacgctttgtgttcagcaaacaccagagacacaacctcccctggcctgcactgaaccccgagtcccaaaagacaggggatgacaaacaccctctttattttttccagtggacataagaaaaggcagaggtggcaccctggctggaactggccctcacctcaccgactgtggtccggccatagagccacaccttggaaacaggtttccagtctctgtggggcactgacgccg

SEQ ID NO: 154664 - DNA, 349 bp, Homo sapiens
cgtccatcccccttcgtgtttgcatcttggactctgttttacttcacagggcagggatgcaaacacgaaggaaagaggtgtggcacaggcacagttttaatgtgcaaacccttcctaatgcaggatccccattgaacggcctgggacctggctgcctttgatgatgtcatatctcatctcatgaaccaagatggcaggaattctctgcagccaaccttgacaggaaatcatcctggaaatccgctgcttccttaattcatgcaagaaacagggagaaggggtatggtcctctcatgaatgttgtgccattcagttgagacgtgtcacgggttcacctgacagctcaggg

SEQ ID NO: 154665 - DNA, 660 bp, Homo sapiens
tctctttggctgctgtcttaagaatagatagggcaaggacagaaacaggaaaaccagttaagagtctgttgcagtaatcaggcaagagaagatggctcaaaccaggatggctacagtagaagggtgagaagaagtcaggctctagatatattttgaaaatagaaccaacaggatttcctgacagaataaatgaagggtttgaaggagaggattgaaggaggactccagtgctttttgcctaggcaactgggtgttgctatcagttgagacagggaaagtctttatcaggtagagtaggatttggagtaagctcgggagttcagtgtcatatacgatgagtttggcatgtctgttggagatactgagtaggtagtgggatatatgagtgtgcagtttgggagagagaagtggtctaaaatagacatttgggagttagcagcacatgggtggtatttaatgctaggactaaatgaaattgccagagactggcagagagaaaaggcagagactgtagataaagaaggccaaggcccccaggcctgggcacctcaacctgaaagctggagaaaagcaggggaagtagtaaaagaaactaaggagaaacccttgaggttggagaaaactcaagtgtgtgtgccttacaaagcacatgaagaaaat

SEQ ID NO: 154666 - DNA, 351 bp, Homo sapiens
cgggctgacgtgtgtgaatgtgcgttcctttgcgtggctccaaagccgtgctccatcgcaccaatattctgattttttagtccgttctcctgtggatggtcactggcttttccagtattctgccgttacaatgacactgtgagcgccttcatccccttctccacgcacaagagcgtgaggttctctgggaaacatctgtgacttaggtttgaccccaggtaaggcgtaagggggctgtgggcacagcattactgacctctggatatttcgagagaagtaatacagcacatgatgtaatgaaacacatagctgcaaagacgtctctccatggcaaacccacaggactgagtg

SEQ ID NO: 154667 - DNA, 546 bp, Homo sapiens
tacctttccccctctttgaatagaaatagaaaaacatattttattactatttaaatggttatgataattctgtttacttacggtttttaccccattatagaaaaaatctgtttcagaaaatcccactttaatctgagaacatgtgtaagcaaggaaaagaaatgaaaagagacccaaaacagtagtgtctggggaatgtggtagagaaagcagtgggtaaagtccttcacacgtgctcctgtgcagagcaaaccccactggggtggtgagcccagttccagtgctcacatccattcttggtggaggccagaggtactgggacatggggagtctaacccggatcttgaagtccttctttcttattctcaaatatcaagatatgtagaccagactgaagcaggaggatagctggagcccaggaattccaggctacagtgagctccaacctaggtgacagagtgagactccatctcgtaaaagaaaaaaaatagatagatcaatggaacagaatggacaactcagaagtagccccccacacaggtaagg

SEQ ID NO: 154668 - DNA, 490 bp, Homo sapiens
tccactggacaggctgaggaggacttcagaacaagtagataaaagaccgaaaaaatgacaaaaaaggaaaatacagtaagattacaggggacgatcattttctaatttacacattactgtaaatttgatttcttttcaaagaaaaaacaaaataagaatgtaaaatatctaaagaattcagataaattcagtaatgaattaaaggaaaaagattagattctagtataaaattctctagaattcttacattcaagtaagtaataatttttaattttagaactttcaggggtattttcccttgggatttttcttttagtgcactgctttgccatttctttaaggaatatcacataccatgtcctgatccaaaaaggaaaaattataggtattcagattaggtacaagaagagagattgaataaagaaacatgaattataaattgtatggaacagcaaacatataatcatggtataagagatggaggtcagat

SEQ ID NO: 154669 - DNA, 471 bp, Homo sapiens
agatcaaacagtcacagtgaaatctctcagaagaactcataaagaacaatacaagagtggagaaagcactccaataacaccgcaatctcagagtagattttaaaacaagatggttaagatggtacattttcaatttaatgtgtatttcaccacaattagtaaagtaagcctaagtctatgtgatctgcatgccctcctaaagtcatcacctgaaatgctgttccctgagacattttacaggttctctcctgttcaggcctttgctaaataccacctaaatgtccttgaccagcttaaaaaaacaagcaccagcctggacaacatggtgaaaacccatctccactaataatagaaaattagccaggcttggtggcccatgcctgtgattccagctacttaggaggctaagacaggagaatcgcttgaactctggaggcggagtttgcagtgagccaagattgcgacaactac

SEQ ID NO: 154670 - DNA, 327 bp, Homo sapiens
acgctctctctgtggggaccttggtgggaattacagagccaccatcatcagttccaaccactatttcatattctgtttagtttcacctgtgttgctgtatgtacctgtagttaattttttttccattattggtatagtattttggtgtgtgaataccaccatctatccattctactgcttttttttttcttgagatagggtcttgctctgttgcccaggctggagtgcagtggcatgatcacagcagcctcgacctcctgggctcaagtaattctcctgcctcagcctccccagtagctgagactacagatgcactccaccaggact

SEQ ID NO: 154671 - DNA, 332 bp, Homo sapiens
tgtgcatgtgcatgtgtgtgtgcataacacgtggagctgcctggtattgggccccggatgctccagagttcaagatgtgcttgtgatccctgtggcatatctctggagggggcatctatctgtcacggtaaggacgctgaagcctcccatttccgtgggtgggagctaacagaacacacctcacccgtgccaaggaagttgagctggctctgcgtagaggaacaggggagtgataatggggagtgcacagctggagtcaggtgggacccaagagaaaagctcagggctacatagtgggaataagttggcttgtgcaggcatttaggagctcc

SEQ ID NO: 154672 - DNA, 549 bp, Homo sapiens
gcatccgggaagtagttgagaggggggagaggggaacatggactgagaggaggatccacctggagctgaggaaccggacccggcagctgttcgagaacttgtctgtggacaattgcaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtga

SEQ ID NO: 154673 - DNA, 499 bp, Homo sapiens
gcgtccatcccccttcgggtgtccatcccccttcgtgtgtccatcccccttcgtgtgtccatcccccttcgtgtgtccatcccccttcgtgtgtccatcccccttcatcttatttcttaaaacaacaagaacaacaaaaatctccataaacgtggaaaatataaatgaaagacaaatttacaatctaatgacctcaacaaataattactttaatatgttagatagtagtccattatttcttatgcgcatactaatgctgggttctaaacattttaattattcttctttcgaagaagtggaggttcagagaaatccggacaaattttcctcatttttttatgtcactcctcatctcttgttttaatcacaggtttaggaggtataaaatttagtccttaaatgcagaaaagcaaaatacctacttctctttacttttctctgactccatacattggtttctgtttcaaattccattcttgccaagcctccccccgtttcc

SEQ ID NO: 154674 - DNA, 268 bp, Homo sapiens
  misc_feature (239)..(239): n is a, c, g, or t
tgcctcagttttctcatctgtaaaataggcatcctgatggtacctacctcatgacttgttgcaagggtaaactgagataacatatgtagagtgcttagtacagtgactgacacatagtgctttgtggtggcaattattattgtataggtaataacagaaagtttatgctccagactttgacagaggttacctttgagaagtagaattggtttggggggcagggactgctgtcgacgcgnccgcgaatttagtagtagtaggcggccgc

SEQ ID NO: 154675 - DNA, 472 bp, Homo sapiens
ttctatgttttggggaagctatattcaaagtacttagtaaattaaaaaatggattactatcaaatactacagttgaaatatatttaaaagacacgtgttgagtaaaccaaaaaagcacagaaacaatgaattaaagctatgattgtattcacactgcaagtatctgtatggaaagggatgagaatatttaacatgtggatttatatttatttgttttataccttcagccaacagaagaatgtaaataaaaacactttttaaacctcaaatatacttactaacccatgcatacattaatcattcataccgcatgattattgttcagtattttctgcaataacaaattggagggtgtgggggttattgtgggtttcagcaaaccacattctatttaggcaaagccaagtattaaagaaaggcctaacttgccaaaccaagataaatacatgccattattatgattacataaaag

SEQ ID NO: 154676 - DNA, 164 bp, Homo sapiens
tgcacccctccctatcctcagaactcaatttccctccatcatgcggaggtgaccctctcaggtcacccacctagggcactgttcccagtccctcaaatccaacttccacctctccccctggggagcacacagagcccgcctcggtttggcataccctctttgat

SEQ ID NO: 154677 - DNA, 424 bp, Homo sapiens
tttttttttttcaattttatccattcctttttattattgttctttattacttccttccttcaactttatttgggtttactctgctactcttttcctaacattgtgaggtggagatgtttaactcatcaactttggtcctgtcttattttttcttttccttgctctgccaccaggctggagtgcagtggtgccatcagagctcactgcagcttcaaactccttggctcaagtgatcctcccacctcagcctcctgagtagctgggacttcaggtgtgtgctatcatgcctggttaatttttttatctttttgtagagacagggtcccactgtgttgctcaggcttgtctccaactcctggcctcaagcaatcatcccacgtcgacgcggccgcgaatttagtagtagtaggcggccgctctagag

SEQ ID NO: 154678 - DNA, 707 bp, Homo sapiens
ctaagtagcctagaattccacgatcatgaagttgtgagtatatcttattgttgcattgtattttcctaggtgtccttactctcttctgtcacttattaacacaaggacattaatacatctacattttcctatttctgatatcatggtttccatgatgtcatcacttctataaccttaagtgatagggtgaccttcagtatgctgattcctggtgtttgcacaaacacatggatgtaaagaagtaaaaaatgtaaaattcacgaaattcagtaaaccacacaaatcagttaagcattctatgccttagcttgttatgagaaacataatgatttttatttttcaatttaaataagcccttctacatacccagcattactgatctcagacaatgaattgctaaaaatgacaatagagcattacactcagaatagtttgctatatttccacatacctcatctagatgtcatggcctacatttctgccatcactcaaccaacattttttgtgtgctcttgatgataaatagacagtcctcaaataataaaagaaactaataatttcttacatagagaaaatgtcaataagatattcaaggtaaccagattattttgagataagtaaccattagaaatatgtggttttaattgctgattttataaaattttagttgatggtacacttaataaagaagatttaaatgtctattc

SEQ ID NO: 154679 - DNA, 647 bp, Homo sapiens
ccagatgacttgctccagatctctgagccaaaaggagaaggagtgtcgggttcaacctcataacatcttggtatccctagcccagttctctaatgtcatattgtctgcttgggaagctcatatgcaataattacattaggattttatcctagacccttgcctcaagcaacatttaagttaatattttgctggagtgatagttaatcatctccccctttttcttccactgggtatcaattcaaaggaaaatggggaccattgaggaggaagactggtaggaaagcgctctatttattgaaatcagtttttacatcctccggtttggagagtttagtatttgatactattttcaaggctgtgatgttactagtgaattttaaagttgaccatcaagttggtgatggatctgttctggggactccagtcatgcttcctggacctctagatgtgtcaacaaagtggaaaacttagattgctctggctgtctttcattacctcttggtaaagcaaactgtatatgatacttggtaagatacctccccaccaccgccaccatcaaatacattaaaactcttgcaactcaggtggtgacaatacgaaaaaaatatacaagggtgttctgagaaggaagagttgagaaccgttga

SEQ ID NO: 154680 - DNA, 470 bp, Homo sapiens
tgaggaccctgacttctgactcaactgctctaatcctctattacccatcatgccctcaggagctaccaagcaactcgtgcagttgaatgccccagaaccattcttcacagggtatccgtggaaatcatcaccctttcaccttcagattctggctcaaagaaattgtgggcgatgagtcacctaactctgtgactcatatctggtctcaataaaggtgttttatgagttgaaaaaaagaggcatccatatagataagacaagaaggcaaactaattaatgaaaataatcctgcaaaggtggtgagattagagatctctgtgtttggtttgaaattttatttaatgcataaatgactatagaataaaaaatggataaattcctgtaaaataaaaattcatcattacaactttattcttcctctgagccaagaccagagctagaatttttttgagacaaagttcaaaatttta

SEQ ID NO: 154681 - DNA, 784 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
gncncnangtaagatgtcccttattcgtctgtcatcttccgccatgattgtgaggcctccctagccatgtggaactgcaagaattctatcactgaactaccaatgcctttggaagtatccaatattttggttgttttgctacctatgggatcatgcatatcagtacttggaaataaatgatgaaagcagcagctcagccacctgtcctcaatgatgggagggcattcacctctacaggaaagaagacagatggtcaacctgatctatgctgcttgtaagcatggtaatggcacacttcctgtcaaacaagttggtgacattgactaggcatggcttctgggaaaatgtcatgtaagctttgttaccatctgagcaaaatggagatgttccttgactgaaatatttagcatgtgtgtgtgtgtgtgtgtttaatttatgtggccacagttattacatggaagacacatattttaattttggccataaaatatactcaacatcataaggaagcacctggagagctgtgttccttttcctgaggcttccctgttccttgtgataacttacatacttggaattatagagacttaattttggttaaaatctctaatttgtgtgaaaaaaaaaaaaaaaaaaaaattcggaggcttttatggggggggggggggaaaggggggtttgcaaggggcttggtctatagttgtttcctgaacccagtttttttgtcaaagggggaaatttgggggcccctatgggagcggatattgaaaagcggttacgtaag

SEQ ID NO: 154682 - DNA, 595 bp, Homo sapiens
tgttctgaagttttacagatggttactgtattggatataataattttgcctagatttttaactgagggggtttgagaaccaagggacaaaatgtaatgtgttttcaaacttcagcttcccttctgctgtaactttcacaaagtatctcctgaaaactcctgtctttgtacaaaattcatcaaagagacagtggagactggggaatttttgaggttgtattcggattggtgtcttcaagggtccctttcagttcgcagtccaaggtgccagggactaccccgtcctccctccctcttctggctttgctctcctgagtccttttgccttctcttcccccttcttggattatcttttcattctcgatgaggttcccacacactgcggtgtgtgtctctgaaaacccactggagacctagcacaactctccgtacatcccgtggtgagaacagaatgaaagatatattgtttaaaaagcaataattaaaatctagtcttcagttccttcttcctcgtcatattttttctccgtaagcctagagattttattttcactagtgtgttcccttgtctccaaagagcgtgtgtgtgatattat

SEQ ID NO: 154683 - DNA, 194 bp, Homo sapiens
tgctgggattacaggcatgagccaccacacctggccatccagggattctttaggtatattattaactgtccaaaaagtagggagaggtaattatggctgttccctaatttatcaacaagttggattccaaatgttcattactgtgccaatgtggaagtaatggttgggttcccagtatggtttgcacttgtagc

SEQ ID NO: 154684 - DNA, 374 bp, Homo sapiens
tgggccagagagggagatggggcagaatggactaaagaaggaaggaaaggaggatccctagaagcagggaatgcaggtggctctttccataagtttgtgggaaagaataaagaatgggaagatagtaaccacaggtaggagtggcaactttctggaggaagaattgtgcccacttttgcaggctgagaggactgacccagtggagagaatttaaggatacaggagagggaggaagaactcaaggcagcctgtcctagaggccgcgggaggggacagacccttcacagagcggaatggcctactgtgcacaagatggataccaggcaggagcaaaataaggacaagcaggagcacagacaggactggcaaccaca

SEQ ID NO: 154685 - DNA, 124 bp, Homo sapiens
actccacttcctctccctgcgctcagtgatacctcattctctcctcagtgcctagtgtcccccagttcagtgcctctctggttctttttctctataaaataaacctaaagtgtgtgtgtgtgtt

SEQ ID NO: 154686 - DNA, 276 bp, Homo sapiens
tcaagctgactttctgtctacttctctatcggaaatggagcttccctaaagactacctcaatgtcggttacccacaggccatttttccatcttgtgctcctaaacttctatgatattaaatgatattaccctttctggaaattgtccttaactttgattttataattttactctaactttgtttcattccttcttttatagcctttcttttctctatccctttactgcagacatgttgtacggctttgttcttgaccttctgatctctctacgttc

SEQ ID NO: 154687 - DNA, 261 bp, Homo sapiens
caataacatatgtaaagaagagtgaataatgaggtatggattagaatggcacccagagggaaatgagactggaatcagagccgttccgaggaaataatgaaaatatgagaactttccctagggtgagataagtctgtgggaaaggtgtatgaggtgacaaaatcattcccagggtgaaagaaaaaaataagtttgagcagccacgagtaataaggcaaaaatattgagagggaaaaattgtagggcaagatgtttaggaga

SEQ ID NO: 154688 - DNA, 480 bp, Homo sapiens
tacttctactgctcctaagagctaagcaataactatgagttaaaggcaagtgagatctcactgcataatccacctaggtagagggagcaagagccaagccctaaatattcggcccagagtccttgccaactcgagtaaggataagacatacaccaatctctcctctattgcctacaaaataagttttcagaaaacttattttccccaaataaagtgctaagcagaacctcaaacacacatacatgaaggagagagtgagggaggaggctgctgtgtgggtagcacgagtgggagggcacagttccactctcccgagcctctccccactgctccaggccacgcagaacctccaaagcaccctagtggcctgcccctgtgtcatttcattgcttctcagaagatttgaaaatccaaaaataagcaaaattaatatatggttgaaattcatggctcaagtgagtgagtgtttaaaaccatttc

SEQ ID NO: 154689 - DNA, 118 bp, Homo sapiens
tttacatctttattaagcaatgatcttgttacgctatagctgctatagctgttttattaagcggacagatataggtaacctgttgagcacttattttatttgctatgatgagcactta

SEQ ID NO: 154690 - DNA, 303 bp, Homo sapiens
attagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtg

SEQ ID NO: 154691 - DNA, 562 bp, Homo sapiens
gactagtttaagcagaaaggaaatttattaaacaatattagaccacccacaggatctctggcgacccataaagcgaggccctgaagaggccagaaacaaggtgcagccatactgtgggtgcttcgctggcaaaaactccactgccactaccctaaagaagacatcaactctccacgatccttgctttccacatggaatttccaagcttcttgtatctctcttcaaacagaccccagaaacccctgccagagagaatgctgagctggatagattccagctgtttgatgtggtccctctgttgcttgttggtttctgctgtccagaatgctgatatgtcctatgttggatcccggacaacacagaaaagttttccatctattttgagtttctttcctactcaactcttcagtagaacataaaccttttaagggcagaggccagttcatcacttttaagtaatcaaatatatttattaataacctattatattcattaacaaatatttattggaagcctactctaaatttggcatagtgctaggcgctgaagatatcattatgaa

SEQ ID NO: 154692 - DNA, 333 bp, Homo sapiens
ttggttttgggaatgaggtcagtgctggtggttaaagcagcggcagtgggtcacagcaggcccactggtacagtgaacttgtcagtgactttcagaatgttgctttagtgcttcttaaacatttcctctcttgagctaggattgttacagaacccggggtgggtacaagcctgaaataggtatcaagtggtcctggctaagagaggaggaatgggagcaggaagcgaggcctgcccagttaacactggtgcccacagaggcgggcaggcagcgaatgtagacggaatggaaatgaaattccaatgacctacgctgtgtcagcttctctctcct

SEQ ID NO: 154693 - DNA, 613 bp, Homo sapiens
aggaaaacatatcagtgtctgttttagtagatctgtagcagaggacagttgtcttgatatattgtagactgtaccctatgtatcagctgccatcctgattcaacaagggggaaggaagttgtctaatacttgttaagcgtggaaggacatttgtgacaaatgtaaaacatcactgtagaacttcacattaatctgtatttcagaaagcaagtgcaaagaaaaaggagtcaaacaatgtctaagtagcatggagttgtgctcttagttgtgaaagcagcagtctcttgttcagtggttattgtaattctcagacctatgctttcttcatgtatgttgtttaaagattacttattcttttcatctaaaaacagtattttaaaaaaccaactgggtacaggtgcttatgcctatagtcccagcactttgggaggccgaggtgggaggattgcttgagcccaggagtttgagaccagcttgggcaacatggggagaccttgtctctacaaaaaataaaaaaatgagctggacatggtggcaaatgctcgtggtcccagctactagggagactaaagtgggaggatcgcttgagtctgggaggtcaaggttgcagtga

SEQ ID NO: 154694 - DNA, 223 bp, Homo sapiens
gccagggatgctgctgaacaccctacaatgcacaggatggcctccacattagcaaaggatcatctgctccgaatgcacatattgtggaagcagaagaaccctgctgtgagttctcgataccccagccaccagactcagactcttcccatcacacctctctctgcttcttcacattaatataacgctcatactccacccctagaatctgggcttggccatatga

SEQ ID NO: 154695 - DNA, 464 bp, Homo sapiens
actagcatttagggaggccaaggtgggaggatcatttgaggccaggagttcaagaccaggtagagcaacatcccaaaatcctcatctctacaaaaaatttaaaaaactagccaggcatggtggtgcatgcctgtgatctcagctactctggaggctgagaattgacaaggagaataaatgataatatttacaggtagcttcagatccctgtatttacattgaggtttcagatttggagtaggatactggagtcattttgataacctggtactctagtgttatctatgtctcttcactgaatggagatatgattccaggacctcttagcatgcgttgaggcatataatactcaccggtgtacagtaatgggcttcaatgctgggattactttttagggttcagctaaatgtatacatttcccacccctgtcctttcataagaagtgtcctgacaactgcagctcc

SEQ ID NO: 154696 - DNA, 229 bp, Homo sapiens
tctgctgaaacatttcctttcctgactttcacaagttagagcaagaaaacgtgctttgattttggtttttgctactgtttcctctctggggagggtttgcaagctctctttctgtgttctggtctgaccagtggttactcttacatttttgacaagtattgaacctttatttttctatcagtaacaaaactgaagcgtgctcacaaccctcctttcatgcgtaagttaa

SEQ ID NO: 154697 - DNA, 368 bp, Homo sapiens
gtctagaggatcccggtgtgtcccttggtctgggcatttgaaagacctggtgaagtgaattaattcagagaaggtttcaaaatgttagggatcatgccaggaaaggagaattagaagagggcaacacagaaagagaagacagcaaagagtttgagagcacaagagaggaaaaagttacaacacaaaacacagctccttttaccaccttaaagaattcctggcttctacaccgaaggcataaaccaaggctgagctaaaatttacctcttcattttctaaatatttggtaaggtgtccagagccctctaattccctatggaaatactctttaccaaaaagaaaataaaagacagagagaaagtgaaact

SEQ ID NO: 154698 - DNA, 339 bp, Homo sapiens
caaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggag

SEQ ID NO: 154699 - DNA, 255 bp, Homo sapiens
gctggccaagtgcaccacgtgaacaaaacaatctcgacactcaacctcttccccttccccatccacagcagctccagaaaaacagcagcagcccctgccccttaccgagcacttccggtgctaagcccacttgctctaattcattcagaccttacctttgtgggtaggcactgtcactgtccctgcttttcaggggatagatgatggagagtttccgcaggtgacactgccagtgagcagcagagctgcccgggt

SEQ ID NO: 154700 - DNA, 296 bp, Homo sapiens
gagaagaaatagaggtggcagttggtaaacccaagtgctggcccttgtgtaagttctgctccactcatctagacagtttcaaaatgccattaaatattgaccccacttgggccagccccggggtttagggtatatgttgatgagccttgcaggttactggtgtgctgctctacccagcagaggacaaggtgcagtgggaagaaggagccttcagtggtaaccggaatcttctgaggcgccagggaggatgttctagaggacaccttgaacagaggcagagaggcaggaaaggccca

SEQ ID NO: 154701 - DNA, 201 bp, Homo sapiens
ccggaacatcgtgagatgtgatgggaacagactcagatagagcaaacaaaaaaaccaagaaggtaaggaggatagtccatgcttccaaaaaaatacagagaacagtatactgtcaaaaggctgtaagagtcagaacagcttttcccctggaattatctcagagattgaatggaatgctgattttctctccagtaaagaatc

SEQ ID NO: 154702 - DNA, 414 bp, Homo sapiens
caatcctgcctcgagcactagctggctgtgacctctctgtacttcagtttccttatcagtaaaagtacctgtctctcagagctgttgtgatggtgaagtgagttaacctatgtagagggcacaggacgcagcctgggctataataagtactgtatatctaactgtatagtctggcactgagtaggcttaataaatgtctgcgaaggaatagcagcattccatcattcacctgtaataatctctttgtggtatcatcactactagatcaaaaaggtagggataaatttctggaggaaaaaacgttgtagatagttggaatgattgaccaaggagggagtgaaatattttgggggaggttcttatgaacatattgactctcctcagtcaggattcccatgtatagtcctgcatatt

SEQ ID NO: 154703 - DNA, 438 bp, Homo sapiens
cttgcagtcgttctacaggatcccccagtcggactcggcaggagaaggagataagagacacatttgaagcagagaatgacaacactaacaaaggcatagaagtagaggagggtatcataaccaaggtgacaccagagtgagctagtgttgaagaatgggtcaacttcctttagagttggtctgttttgtcaacatttctgttaaaatatggggccccaattgaagatactaatcaaagtgtgatccatctaatcaacacagagcacaaaaggactattaactcctaggacctatggaaactactctcaatgtggcataaggttgctttaccttttctttttttgcatgccgagtccgctgcattctgggcagcccggcgacgctggccccacgcacacgggccaccctggtgctggtgatcgatacggcagggagggg

SEQ ID NO: 154704 - DNA, 579 bp, Homo sapiens
ttggaactgtatcctgaagaatgattaggagttagagtagggaaataaggaggctgggaagataacaggtagggcaggagaaggagataagagacacatttgaagcagagaatgacaacactaacaaaggcatagaagtagaggagggtatcataaccaaggtgacaccagagtgagctagtgttgaagaatgggtcaacttcctttagagttggtctgttttgtcaacatttctgttaaaatatggggccccaattgaagatactaatcaaagtgtgatccatctaatcaacacagagcacaaaaggactattaactcctaggacctatggaaactactctcaatgtggcataaggttgctttaccttttctttttttgcatgtcaaaacattgtcttctcattttaaggacagcatattctgattatttttatttaatttatgatattagcagacagtttatgaatcaaaactgaaattcatgagactgatatatgtttccttatatagttgaatttagctactcatttcaacaaacacaaatttatacctaaaactataggtctcaatgatacttg

SEQ ID NO: 154705 - DNA, 279 bp, Homo sapiens
gagcctgaaaggcggagccggctgcggtgagccaagatcgtaccattgaactgtagccttggggacagagtaagactccatcataaacaaacaaacaaacaaaagtcaataagaagggagtcaaagcatgtctacacaaaaaagcaaataaacacaaaagtagtaaatgagaaatgaagaacaaaaaaacctacaataaatacagataatatgtaacagaatcacaagggtaaggtcttctccatcagtaatacttcaactgtaagtatttaatctgca

SEQ ID NO: 154706 - DNA, 506 bp, Homo sapiens
actgctgaaatgtagattgagagagccagaaattagatctcaataggctgaactaatgatgaaaatttaacaatataaaattcaacaagaacaaagttctattctgaagttaacaaaaggattctgcaaagcaatcacctcaaacctctcttgttagaagactgggtgtgaattacaaataaattatagaaatacaggataggtgagatgtggcttaacagttatttatttgctcaacatgtatttattgaatgtctactatgtgccaagacttgtttgttctaggtgttggggattcagaacaagccaacaaccctgccctcctatagcttacattctagcaatatctagagacagacaataagcaaacgaacatacaatgggatgtctcatagtgaaaactgctgagaccaatggcagttaaccatggttcacaagagaaaaccgtggtttaagttggctctaaactcatgaatcaactgtgtgattcaattttgaaaaaagcc

SEQ ID NO: 154707 - DNA, 295 bp, Homo sapiens
tggaaaggcagcccagggctgtggaatcggacctggagggaaaggaggagcagggagacacacaggagagcctggggacacagatctgtggcaggaggtgaagaggaagagctggcgcagaagcacccgagaggcccacagcccatgaagtgttttcaggagagttaagacccaccatggagtgggcgccacagttaagcctggaggttttgcagccaggaggggttctgtctgggtttcttgcctcccaccccagcctccaaagtgggttgacaccagctctgagctgtcagct

SEQ ID NO: 154708 - DNA, 345 bp, Homo sapiens
gaccatgaagggtggatgagtgtcagcattcactgtgttcacaggtgacttatgggctgaaggtggatagtggggcctgtcagcttttggcagcttggaaagttagggcataattgggttgtagagttgcagaaaaaccagggtaccctgagaatcaacgtgtctagtttcttctgtcatagccactattggctaggatagttatgatgtcacataaacataatttcctccatctctgagacctagtaggttattagttgccgagtgtttagatgtgtgaagtgtttcttgctgtggtagtttgttacataagagcattctgtgtacagggaataaaaagaaaat

SEQ ID NO: 154709 - DNA, 475 bp, Homo sapiens
agttaaatttagttgttatcagcatatagacgctatttaaagccgtaagcccagatgagatcacctagggaacaagtgtaggtagaaaagagatgcaaagactgttgcttgggacactctaacattatgacattggagccatgagggggagccatatgaagcctgattgattttcactggcagagtgtgctgtcctgtagcccaatggaggcaagccgttcaaagaggagcacaagccattagctctatcaaatgtccttaaagggtcaagtaagataaaaactgaccactagattcagtaacatgcaggccacttctgacctagacaagataaggagtttgatgagttaaaagcctgattagaggagaaattggaggagagaaattgtagactgcacatatagactgctgctcttgaggaattttattctaacggggaagagatcaatggagcagtaggtagagggaggaaagg

SEQ ID NO: 154710 - DNA, 286 bp, Homo sapiens
agacataactgggaaggggatgagaatggggaaaaacacgctgaatcaggctcttcagaatcgcaaatatttaaacatacagcctcagagatatcaaactttgtcttggcttcagggttcagagactttttaaaatgggcccattaaatgtaagcacaagcatgcacattcttgaacattttacataattttccaatctctttagtttcatcgaatacacctgccaccatgaataaatgcatcatctggaggcatagcagcagggccctgctccctgggaaagcag

SEQ ID NO: 154711 - DNA, 507 bp, Homo sapiens
cggtataatccacgaaagaaaaaatagataaactggacttcaatgaaattaaaatttctgttctgcataagacaatgtctagataacaagaaaacaaggcacagactgggaaggcatatttggaaaagacacatatgatagaggacagttatctaaaatatatcatgcacccttaaagttcaacaataatcaaacaatctgactgacaaatgggctgaagaccttaagagacactttacttaaagaagattatacagatgggaaataagcaatgacaagatggtccacatcatatgtcatcagaaaaatgtaaattaaaaccatgagatactacagtgcatctgttaaaatggcccaaatctggaaaactgacaacatcaaatgctcatgaagctgtggaggaaaaagggctcttattcattgttgctgaaagcaaaatgttacagctactttgaaagacagttgggtagtttcttacaaaactaaacatactcattatatgacata

SEQ ID NO: 154712 - DNA, 124 bp, Homo sapiens
tttccttccattaattcatatgcctgccgttctgccaatcatgacactgtcatgattcctctatctatatagtgagccttaatatcagatagaatggtttcttttactttaatcttttttcaca

SEQ ID NO: 154713 - DNA, 836 bp, Homo sapiens
gcatcagaactttacaagaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggagggatgccgctccactcctcccccacactcctccacttccaggaatgcggatgccattcagtggtcctgtgcctccaccactcccctgggattcctgtggaggacaaaattctcctcctctaccaatcctgccattgggttgaaaccaacagaaagaattaaacctgaaatcagcatgagacgattgaatggttaaagatcagacctcatgaaatgactgaaaactgtttctggatcaaagtaaaatgacactaaggttgaaaacggggattgcttgtaacttgagatacatttgtgcaacaaaagagagaggagacagaggcagatatgagagaagaaatcgattacgaacacaactcaacgacttaagtttagattctaaattgcccagaactttcaatttactgaggttttgggtgctatgaggatcgatgtgattggcgttgtgaaaaggtggggagttagatccgcactataagcttctgtcagagcatatggtcagagaggatagtttggacgacgtgggtgtgggacactgaggggatcgggacggaggaatgaaaggggataaaaggcgttgatgatgggtgaaatggagaaatattt

SEQ ID NO: 154714 - DNA, 417 bp, Homo sapiens
tggttccgagagagggactgaggagaccctgaatgtcccctaaactaacccccttttgctgttcaacagggctgcaagtccaagtgacagcctgctgtgtccattctagggagctgcacttcttggaagaattagcttcaaggggctggatgtcagactgggtattattctgccctgagaagaatggaaggtgttttctaagaaattctctggggagtggggaggtgtctttaggttttgagcctccgactagtcaacacggtgatttctgttgcatacctgcagctgaaagaggacagcctcaacccccagcaccccctcttactctttcagaccccaggaagcctcccagagatccccaagtgacctccccagacctctcctgtttgtgtccacctccccactgtgtacccttgt

SEQ ID NO: 154715 - DNA, 203 bp, Homo sapiens
  misc_feature (1)..(1): n is a, c, g, or t
  misc_feature (20)..(20): n is a, c, g, or t
nccacggagagttgccgagnagtgtagcaatgaagtgatgtttgaggccatgcagagtcatcttgggaaccatcgggaagccaagaaaatgccagcctagggccttgctgtcactaagctgctgagccaactctggaatcttcttctcccagacttattattatgggaaataattaaatgggctttgttttgcttggctttgc

SEQ ID NO: 154716 - DNA, 383 bp, Homo sapiens
atgtgtctaagcagaatatagcaatccagttcctctttacagtggcagatagaggagtgaccatgagataccaccatggccaaggaataggatgaggatgtcaaacagcagaggcggagtttttaggaacgttcttcctctctgacaaatgatcaaaacaacaaaaattgttgttgctcacttgcctctttctcgctgacaggatgtgagtgaagtgatgtttgaggccatgcagagtcatcttgggaaccatcgggaagccaagaaaatgccagcctagggccttgctgtcactaagctgctgagccaactctggaatcttcttctcccagacttattattatgggaaataattaaatgggctttgttttgcttggctttgc

SEQ ID NO: 154717 - DNA, 281 bp, Homo sapiens
  misc_feature (1)..(1): n is a, c, g, or t
nctttgagtcacgctctgttgcccttgctggagtgcactggcgtgatcttggctcacggcaacctccacctcccgggttcaagcgattctcgtgcctcggcctcccaatgaagtgatgtttgaggccatgcagagtcatcttgggaaccatcgggaagccaagaaaatgccagcctagggccttgctgtcactaagctgctgagccaactctggaatcttcttctcccagacttattattatgggaaataattaaatgggctttgttttgcttggctttgc

SEQ ID NO: 154718 - DNA, 236 bp, Homo sapiens
cgtcgtcctcaccccccgctatccggcccccccccccccctccccccttccgcagaccaggaatgaagtgatgtttgaggccatgcagagtcatcttgggaaccatcgggaagccaagaaaatgccagcctagggccttgctgtcactaagctgctgagccaactctggaatcttcttctcccagacttattattatgggaaataattaaatgggctttgttttgcttggctttgc

SEQ ID NO: 154719 - DNA, 572 bp, Homo sapiens
gaggttgaggctgcagtgagccatgatcatgccagtacttcagcccgggcaatagagcaagaccttatctctaaaaaaataataaaaagacctcacatttagacaatgtggtagtgtgctggttcagaaggagcccagctatgcatggctaagggcaaatccctgaatggagaaggaaattgaaaaatgttgactaacctgagaaacagtctttggaaaagggtgatctcaggttctcatgcaggacaatttaggaaaaagagagcaagccaggagaaggctgagaacttattccccattagtcaaaaatctgctttaagtcaagatcctgcaatggcctttcacaacaagcccctgaaaatcagcagaacaaagactgggcctggtgagtgagtgcctacgcagagttcttgctgccgtgattcagtgcaagttagaaacctgtgctcttctttagcctggggaaaaaccaaagtcagcaaacccagctcaactcagcaaactttcgtcgcctgtatgctaactataaggcatgttgctaggtactgtggaaattgtaaagacacataaga

SEQ ID NO: 154720 - DNA, 272 bp, Homo sapiens
cgtggtggcagacacctgtagttctagctactcaggaagctaaactgggaggattgctttagcccaggagttctaagctgcagtgagctatgatcacaccactgcacgcctgcctgggctacagagcaagcaaatgtctcttaaaaaatttttttttctaaagaaaaaatattggcattttgttggtaactgctgaagttgaatgatgggtatatgggagttcaaatatattctactattctcggtaatcatcaatgtttagatatttctgt

SEQ ID NO: 154721 - DNA, 1039 bp, Homo sapiens
ctgtttccgtctctatagttctgccttttccataatattgtataagtggagtccttgtgtgtgtgtgtgtgtgtgtgtgtgttttgtacgtgtatgtatatctccttttgagtcggagtgctttcatttaatgtgatgtatctgagattcatccatatggttctatgaaaaacaaatggaaaataaggtgatgaaaagatgctcaacatctttaattatcaggaaaatgtaaatcaaaccacaatgagatactactatagaatggcttttagaatggctaaaaatgaaaacgtgccataaattggcaagaatacagaccaatggaaattttcatgcattgcttgtaggattgtaaaacggtctgtccactatgcacaaaagtttggcagcttcttatactattaaccatacatttatcatatgactcagcaactccacacttaggtatttaccctagatgaaagaaaaattctgtttacatgaaaacctatactcagatgttcacagcaattgtataattgcccaaattaggaagtaacacaaatgtacatcagtggatgagtgattaaacaaattgtgtacaccaatactatggagggctgctcagacataaagaaatgatttattgacacttactacaacatggatgaatctcaaaagtgctgttgtattttaggtaaaccatgtgataacttgaattacatttgataaaagatttataagtgtaaaaactagatttatatattttaattttatatgtgcctgtcattacatactatagaaaattgtgtctacagtatgttatatagcatattgtaatatttattactgtatattccttgtgacaataaaatagtttgtattttatataatagtacctgttttatagtatatgttttattttatatgattacctaattttaatattttacatatcaaactttcacataatattttggttatttctactttcacgtagttgcatttaatgtttgtagtgtaaagatataactacaataaaagaggccagagagtctgc

SEQ ID NO: 154722 - DNA, 276 bp, Homo sapiens
ccagaagagtactttatcatttcagttcacaacaagaataccaaagagggagggatcaacactgtcaaatgctcatgacaggctcattaaaacaaggacctagcattgattactggatttagtaaccatggatatatgatgaccttagcaagagcaattttgctgacgtggtgagacagaaattgtgattgaagcatgagaggagaggacgtagacacaaagtactgacagctcttttgaattttgctgtgaagaatggaatagcacataactaga

SEQ ID NO: 154723 - DNA, 101 bp, Homo sapiens
ttagtgccacccactctgtctccagtagcttctctccccgaagactgcttccagaacaggtcacaggctcctgggctccccttcttgctgaagccaagtgc

SEQ ID NO: 154724 - DNA, 251 bp, Homo sapiens
tagtaagagcaatagctatgattatcagctattgagtgattatactagaaatcacttagtatctcagtattacataatacttttttgtctcttcattcctcaacttttccaagtaaatataaaagctactaactcagaaaacgtctgatttatgtaagatcagaaatttgatacttctattgtatgcatatgatatcataacccagaataaaatttgtaaataaaaatggagttttcctctggattacaag

SEQ ID NO: 154725 - DNA, 391 bp, Homo sapiens
gaaaacttggctctcagattgaaacgaaccctaagcatcacttcatccaagcatcatttcattctctaacttgttagtgcaggagaaattcatttccagaggcttgagtgagcaaatgatacaggtgtcggagagaacataaggatgagaaattcatgtaaggaaatgtaaaatctatgcatagccagagtcatctagtaggtctgtgaacatacttccaaacactcagttccaagctctgtggtttgcttactagtttttggagaatgtgacctgccaaatcgattgctcatccctcaaactcctctgtaatgtgtgtgtccatgaacccactaagaagcaagcttccccagggaaggaatgattttttggagtaggttgtaccatatct

SEQ ID NO: 154726 - DNA, 556 bp, Homo sapiens
tgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctac

SEQ ID NO: 154727 - DNA, 460 bp, Homo sapiens
gaaaacaggtctcatgacagggtttgctgatgggttagatgtagggagttagggaagaatgattctagatgactctacgttttgggcttgagcaactggtgtgtaactgaatcttggactgagatggggagactggaggaggaacagaagatttgcgggaaggtgtagaaatcaggatttatattttgaccatcagagaggtcagcaaatcacttcaatttagaagtctttggcttaggggagaggtctgggctggaaattcaaagtcaagagtcattcctctataccgaagggtattcaatgttgtggtgccgatgaatagcgatgccaagggtgccgatgaatagcgacccgtattgaattcaccacaccacatactatgaacggccatgcaccaccacccacggaatcgagaaagagctatggtgccgatgaatagagaggtgccagataaatagcg

SEQ ID NO: 154728 - DNA, 477 bp, Homo sapiens
ggcatggtgacatcgcatgtagccctgctggcctggtatggaggagttgctgtggcctggtttccacagatgtggctgcagccgttctgttgaataggaggctattaagggaaaatgctttgcaaggagctgagcagctgggagagatcatcagaactctgaatggggaactttgtcctctcttgctctgggatcctcttgcatctcctggtctgtctctaggagattggctgttcacgacgtcaaagagagttatccctaggaaccattcctcgtccgactgctttcctgacttggagggacaaggagaagcttaggacatggtgaccatggccatggcagccctgctggcctggtaggaggagttgctgtggcctggtttccacagatgtgggctgcagccgttctgttgaataggaggctattaagggaaaatgctttgcaaggagctgagcagctgggagagatcatcagaac

SEQ ID NO: 154729 - DNA, 261 bp, Homo sapiens
aaaaaaaaaagatgcagtactgtccttgactgatctaacggaaatgctttagtaattttttgttcaactacttgattaccagtagtaattcgggagcaaatatttgatctctggttcaactaaattatcagtgagaactacttgaaaacgtattggtactatttggctgacagaattttacagtgagacataagcctttaaaacaatgtcctctaaaatatgaagtatatgggaagagaagtcttgttcctcatatgttat

SEQ ID NO: 154730 - DNA, 240 bp, Homo sapiens
tgtaggctcagtaagggcactagccatgtcattccagtattcccagggcccatcatagtggggtgctgggactagggcttagttgccctccccagtcctcatcaacacctcctagccaccacaaataaatacaccatctaagccaaaactgagtgcttgtatagctttgaaacaaatcctcagccccctgcctgttcccacttagaagggtgctgctcctaagcccctgttttatataaa

SEQ ID NO: 154731 - DNA, 485 bp, Homo sapiens
accaacttccggccaagtgcagtggctcgtgtctgtaatcccaacactttgggaggccaaggtgggtggattgcttgagcctaggagttcaagaccagcctgggcaacagggcgagaccttgtctctacaaaaaatacacaaattagctgggcgtggtagcacacgcctgtagtcctagctactctggaggctgaggtgggaagattgctttagcccagaaggtcaaggctgcagtgaggcggtgatcatgccactacactccagcctaagtgacagagtgagatcctgtctcaaaaaagaaaaaaagtcaacttccgtaagttgttataagtacggaatgagaagagatctttgataggaatcctgtcggttgtaaagcactgcacagatacctattataattagtttaacttggaaaataacatatactctgtttacagggcaggtaaccctctgccatcaggattaggagacaaaggggaaa

SEQ ID NO: 154732 - DNA, 258 bp, Homo sapiens
attaaaaaatggccgctgggaaatggtaacagaagtccctaaatccacagaagagacgtgcagggaggcctcccagactcttagcgcgttgatttctctggacagtggtgctgccttgaggtgctgtctgtacttggcactgcacagcagcactgctgctctgcttcccacaagcttatgtcatttccccaacgacaccagaaatggcccacagtcaggactgtgtcttcacacccagctcactgcccttggtagcca

SEQ ID NO: 154733 - DNA, 295 bp, Homo sapiens
tgagcctggcccgggtttactagaagataagagcagcagcttcgtagttacaaagattaaataaggtaaaacataaaaatgctttgcaacttctaaggcactatataaagcactagaaggatgggagaatcatgttttgtgtcagatatgaaacaactggcttagaaaaaaaaaagaatgaagcatttttactccttaaagaaaagcttctgtccttccccattgcccaatcctcaacccccaatcctgttggggatttttcctgttagagattttattcaaaaacatttagcat

SEQ ID NO: 154734 - DNA, 490 bp, Homo sapiens
tgtctcaagggaggggggggaaaaagcagagttaattaggtttgaagaagacagccaaagaaaacaaagcagcacctcacacaggaatgactctgaaattacctgctctcttggttcacctgttagtggcttcctccacaaggagacagtcaagaaatctatctaagaggctacatggaagcactgtggagtcacagagcagagcatcttcccaatgtgtatagctctggggatcttcaggggtcagaagtgtccaggattaaaacaagatccctagcatgtacaattcgaaggggtaaacctggaagagaagatgtcacgttctgggttttgcccaaatcccaacatttgcatcagctcctgggagagcatcagggcctttctcccatgattacaattcatgagaccacagttttgtattatagctcacctctagcaggtaagttctgtcttccttccctccatccacctgcctaaatctcttagtggg

SEQ ID NO: 154735 - DNA, 282 bp, Homo sapiens
ggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgt

SEQ ID NO: 154736 - DNA, 432 bp, Homo sapiens
gtcctggacggggagcaaggtggctgatgtgggagtggaagagaaatcctttacggtatcccatacgtaccttttgagttttgttccatgtaaatatatacttatgcaaaacaaaaatttaaatacaaatttttaacattaatatttaaggtctagggcaggagggagaagaggaggaggaaaaggagttgaaggagggggcaggggaagggttagaactgctgggctgcaaccaaaacgtaagcaccccggccacgtactgagcgtcctctgggcccagcgtgtgcgggcactgcacatggcaagtgctattcacctcctttgggaaataaggaaacggacaaagtaaatggcaaagccaggacgtgagcccttcatgtgggactgcaggagcctggggtgctctcctccagggcggtgcagctcccccaa

SEQ ID NO: 154737 - DNA, 358 bp, Homo sapiens
gggaactgtgagtccattaaacttctttttctttattaatttcccagtctcgtgcatgtctttatcagcagcacgaaaacagactaacgcaggcagccggtgtggggaggagtgggcaaggagggggcaggggaagggttagaactgctgggctgcaaccaaaacgtaagcaccccggccacgtactgagcgtcctctgggcccagcgtgtgcgggcactgcacatggcaagtgctattcacctcctttgggaaataaggaaacggacaaagtaaatggcaaagccaggacgtgagcccttcatgtgggactgcaggagcctggggtgctctcctccagggcggtgcagctcccccaa

SEQ ID NO: 154738 - DNA, 460 bp, Homo sapiens
tttccaatttacaaagcttcctcaaacattatttttatttgattcttataataaacgtacaaagtggcaattttatcatgaaattgaaaattgtattcaacattctttgtaattcaaaaagtctgccttcaaacccaaatacctcattatctagaaaagtatatacttagaaaagttatccttagcaaactaacacaggaacagaaaaccaaataccacgtgttctcacttataactgggagctaaataatgagaacacatacacatatagagagggacaacacacactgggacgttttggagggtggagggcaggagaagggagaggatcagaaaaaataactaatggattctaggcttaatacctgaggtatgcaataatctgtacaacaaactctcatgacacaagttttcttatgcagcaaacctgtgtcatgagagtctccgtcgaactgggtac

SEQ ID NO: 154739 - DNA, 303 bp, Homo sapiens
atcgagcacattgtccaggtattataactgagcagaatcccagcatgctggcaggaaaacaatgaattcaaattctgctggtaaagctctcagacaattaaagtacagcccctggcccccagcccagggcaggacagaggagagatagagagaaagacctattattggataaggccctgggacagggtgagcaggaagtaggatgaacaagaggttaggatgtcagagaagagccagactcaatcaacctggctaggcactccccaaccaccacccccgtccccaccactattactccctccc

SEQ ID NO: 154740 - DNA, 288 bp, Homo sapiens
tgctaaggtctctgcattttcagtgataggtaagaaaatggtccctgaccttgaggagctttcacatgcatggttctactccagagagggcatgttatgttttatttcatgggcaaactcagattgattgctggtggcttcctggagctcagtatttcatgaggattctgaagctgtctgtggacttagtggaaaatagagtcattaccaattagcaatgtctgtcctggcatgggaggaagaagtagcagtatttgggttttattctggggccaagaaaacatcata

SEQ ID NO: 154741 - DNA, 116 bp, Homo sapiens
gactgaaaagcaactcacaactctgttacataaacgttgaaccagattggtctggtgtggctccaaaaggtgttctcaatgtcattaaatataaaatttcaaggtggtacatatca

SEQ ID NO: 154742 - DNA, 439 bp, Homo sapiens
cccaaagtgttgggatttacaggcatgagccactgcgcccggtcactttcttcttctagtaagatgttcaaacagtaggatttatgtatagtgctgagaatattaattttaaagttcaaaatcctaattgtcagttgggctactctgcttactatttgtgtgaccttggtttagctacttattctttcaaagcctcagtttcctagtaaaaagatgggtaataaattcttagttaacactgaaataatctgtataaaacttaacacagatctctagaacattgtaagatttcagatgttggtacctgccattgcaattgtagatgtagacttaaactagtctccctaaagttggaaacctacaatgttagccagattttgagagggctcaaaatttatttttggtgttcatattacatactattatttaattagtgatc

SEQ ID NO: 154743 - DNA, 439 bp, Homo sapiens
ggctgtttttgttcagttcagggtcggtctgtctaaggtcagacatggctgtttgaattcattgcctcttgtctgttttctaataagcattagggatttgtcatttcttgttgattatcttaattatcctatagcactctgggtctgataatgtgaacgttttgggttgctcagtggtagaatctgtagtattttatagacactaaaacctacatttttggctgagcatggtcgcttacccctataattccagtgctttgtgaggcccaggtgggaggattgcttgagggcaggagtttgagaccagccttcgcaacatagcaaggccctacaaacattttatttttgtattttgtctctacaaaacaaaataaaaaattaggtggacatggtggcatgtgcctgtagtcctagctactctgggagctgaggttgggga

SEQ ID NO: 154744 - DNA, 577 bp, Homo sapiens
aacaggcccttttttaaatataattctccatgcagttggagggttaaacaggcatactgagagtcagtgtaaatgtttagtcttaccttcactgagttctaaggcctgaattaaagcaatgagctcagcttaacgacagtgtccagggttatcactgcatatcctgcacatctctctccttgtgggttgatgaagctgctcccgtccatgtatagctcccagtctactgatgcccaaggctggtctcggaggtcaggtctgctagagtaaacttgagtccaacacctctacacagttaatgctcgacagggctctagctgctgggaacaaggtggcgggttcagggtgtttccagtttagtagatcaatggttaaaaagggctgatagatgaaagtctgttgccccaccccctggatgtgggcttggtcattataatagacaggtcctcgtgtctccctgagaggcatttgcatagctccagcaagaccagatctgagagggcccacttgactatcttgacttccttccttggcctcttgaggctccgatcttccccttcaaggtgagacctggggc

SEQ ID NO: 154745 - DNA, 579 bp, Homo sapiens
ctggattgcaggaaatgttgtcagaaaagtcataggagtggagtgagccagtcgggaaggacattgaaggtcactgtcaagactttggcttccacttctataatttactagcagaggacactggacacactggttaaaagaggccagtgatttttcccatctagaagacatgcccttaatggtaaaactcaaatatggtagcacttaggaaaggatggtgatagtacagggcttagggcaagaaaacatccacagagataagtaaagcggattgtacccacccttcctgttccctcacccactgaacatattgaactctgagtctgcatgctgagctttgggataaggagacaaaacacaacatagttcccatcctcctaatgctgagtcgattggggagatcactggcagtggtactacaatggagtgagttttcagagacagatgaaaagcccaggttgtagggaagtctgactcattttggtcactgatgatttggggaacaaccaaggagaaggggatgggtaaggttaggaaagccttccttgagaaattgacattagagctgggatcttggaa

SEQ ID NO: 154746 - DNA, 156 bp, Homo sapiens
gaaagcaaggcgtctgtttcagtaacctgaaacctctctgtagggttaatagaggggcccgagcaaagagcacaagaagccacattgtctgggaaactggagaattgtgaatggggccaatgtcccagggcagctgcccaaagggaagggagaaaa

SEQ ID NO: 154747 - DNA, 564 bp, Homo sapiens
aatttgagcagaggagttgacatgacatggtatgttttaaaagaatcagtctgtcagctgtgttgagagtaaaatgagtgaagaaacaatagtggaaataggaagaccagttaagtgtttgttgcaatccaaatgaaagtgatagtggtgtggaccagggtagtagcagtggaggtggtaaacactggtcagattctgcatatattttgaaactacagtcagtaaggctttctgatgaattcaaaatagggtggagagaaggtgatagaaggaggagcaaagggagactctaggatttattggcctgagccagtggacagatggagttgtcatgtattgtagtgaaaaagacgacgggaagagcagttcttggcaaggtggggagaagcttagtttataccagttaaatttgtaatgcctattagatatcccactggaggtgttgaatgcatggctggatatttaagtccagagatcaaagaagaggtcaggttgaaaatataaatctgggagagctcagcaaatagatgatatttaaagccatgagtctgggtgagattaacc

SEQ ID NO: 154748 - DNA, 219 bp, Homo sapiens
ctggcatgatctggcccctgctgatctcccaacccatcatgggacagtcaccctcagcttctgctacatgagacatctcatgctctcccagcatgtctgcctccttcccccgtttagcactttgctcttgccctccctttttctctcggaccccttcctcagtacctcccctacatacacaggattctctcccgggacttcctcagcccctgcagcctc

SEQ ID NO: 154749 - DNA, 430 bp, Homo sapiens
cagtggctgctcaaaagaatgaaactgcgcgaccgggagaccacggaaagggtgtctatcttcattcccatttttaatttaaactttaatggaaaacacattttgcattttctggtctttccacctgcagcctcagatggtcgggcagaggttttgagtctgggcaattaagctggtgcaatcttatcacttccaggcctgggtttgactggtgaaggagaacagaatgccagctgaacaaaaggccaggtttccctggacccagtagtcagccaggattgttgtttaaagatcccagagccttgcaccctcccgctcctgcacactcagccagagctgttgatatagcagtgcagcccagagaaaagagagacctggattcaataggctggctgtgagggggcactggtgaattctatggtcacagcga

SEQ ID NO: 154750 - DNA, 325 bp, Homo sapiens
tagctgagattacaggcacccgccaccatgcccagctaatttttgtatttttagtagagatggggtttcagcatgttggccaggctgatctcgaactcctgacctcaggtgatccacccacctcagccttccaaagtgctgggattacaggcgtgagccaccactcctggccccagttttgtacttctttgcctagtttgggactatgaacaagaggaaatgtagctttgtttgacttctgccacttcctctttccattcttccatttgggtgggtgttccggtagcttgtgttgagaaattttaacttcttaatgttttgtatt

SEQ ID NO: 154751 - DNA, 120 bp, Homo sapiens
gccagcttatccagatctagacatgcaaatgcttgctggtaaggtgattgatgatattccctatcttaggtattataataagattgttgtgtacattttaacctaatttctatctgtcaa

SEQ ID NO: 154752 - DNA, 466 bp, Homo sapiens
tgaagatgctaacaatctagcagaaaagagaggccagaaatttcctctcctctatcttgctatttattacatagtcctttattattttttttcaaatctactttttagcaagaaaagattcatcatagttcaatagaatttatggaaaccaggctaggtaacaagtatttgacccacacaaatttgcttttaatacaaagtgatccatgcaaagttgcttttaagtaaaagtaaatgatagagtacttttattcacttaattcatgcaccagcaattcacaacattcaagcagcagcatgtaagcaagcagcacaattttcatgtgtccactgcattcatcataacatcatcgcagcaaacagtcaaggtacttgcaaccagcactcataccatcattattccaacattcacaatcaccaacatctttccacaatcattatgcattccaccatgcatatttcatca

SEQ ID NO: 154753 - DNA, 251 bp, Homo sapiens
ggtggctcatgtctataatcccagcactttgagaggctgaggtaggaggacagcttgagaccaggagtttaagaccagcctaaacaatatagtaagacccactctacagaaaacttaagaaaaaaaaattttttaatccagcaactttaatatttcttcatgcgtacatgttcacatacatacacgttcaaagcagaacatggaataattgaaaaattataaataatcaaatccttctcagcacatgaaaa

SEQ ID NO: 154754 - DNA, 395 bp, Homo sapiens
taaacaattcaggaaacactgaaagtttccttcataatcaatgcaagaaagcagcattttttttttctcctacctcagcctcccatatagctgggactacaggcgtgcgccaccatgcccaggctaattttttgtatttctggtggagacggggtttcaccatgttggccaggctagtctccaactcctgacctcaggtgatccacctgccttggcctcccaaagtgctgggattacgggtgtgagccacagcgcccgtcctaagatcagaatattttgcctaaaaatttggattcccagtttctttttttttttttttttttttttgagatggagtctcgctccgtcacccaggctggagtgcaggggcgtgatctcggctcactgcaagctcc

SEQ ID NO: 154755 - DNA, 426 bp, Homo sapiens
agctcggtccgtagcgctgctggaaactgctgaagtgtattccaaagtgactgtaccatcttgcattcccaccaacaatgaatgaagagtacctgttacacatccttgtcagcatttggtttcattaagtgttttagatttaccattctagtaggtgtatgatggtatctcattgtagcactaatctgcaattactggatgatttatgatgttgggagtcttttcatacaattacttgtcatttgtatatgaggtgtctgtttagatcttttgcccatttttaaattgggtttttatttttcttttgttgagttttcagagttctttgtattgaatagtcctttatcaggtatgttttttacaaatcttttctcctactctgtggcttgtcttctcaatctcttgacagtgtcttttgcagagcga

SEQ ID NO: 154756 - DNA, 657 bp, Homo sapiens
atccgtttgtcatagtcacttagtgacttcctatcccttaagcaagaagaatttacacttgccacatctcttctaaggtttactacaaattgctggaatcttacgtactacatattacattacaattaacatcctcaaagttcaaccctcagaacagataaatatttaacatgcaaataaataatccagagggattgaaggggagagatggcacgtaaatgattcaaagaatccacaccaaaaccaccaggtgaaaagacgccggggaagagggatattcactagtctcaggaagagggatattcattagtctcaaagatcaccatcaaattccattatcagttaccaaaaaagaaacaataccgttacaatgaagacaaagggaaacaccggtgtttccctttgtctagtgtttccaccccacctgtagtcttcctcatccatggatacttgcttggggctggtgctgccatctacccccactctcctagtcatcaagtgggcatttgaagtgtgtggaactgttttattttgctttgttttgtgacactagccagagggcattactgtgtttattgagagggaaagagggatcctaaacatttttgtaatgagcaggtatagctctacatgaacaagaactgactcacccaacat

SEQ ID NO: 154757 - DNA, 171 bp, Homo sapiens
tcgcccggacattaaccatgagtcctctgggctggcatgtgcaatgggcccagccggagtgctgctgggaaacctgctcagggggcgagctgagcctcctgggataattctgactaaatgattcttcacggagttgacttgaaatgtgatgaatgggtccccagtgctctt

SEQ ID NO: 154758 - DNA, 412 bp, Homo sapiens
atttcttcctctcgctattattaaacagagtatggaaactgggaatgggataagtgagggaggtgacgatactgaagggctcggagacagaatcgtttcttagtgaacccttaccctatccccaaagtgggctacttcatgcagtttccaacctgtgcgctgcatgactggtgttaggattattgcagtaactactgttgttgtcaccatactgcatactggacaccctatcatatgccaagtgctgagctagcaagaactgagccccagctgtctgacttcgaggtctgcccactagtggtcaaatgccactctagctctgtctacctcacaggttgtcaggaggtttgaatgaaggattattcccctgcacacagtgagaaagaaatctgccatactccttctcctcatc

SEQ ID NO: 154759 - DNA, 374 bp, Homo sapiens
ctcactagtgagtatacgattcaacagcctcctgccctctactaagcttgtatgttaaaccatacatctcttatcatgcatccaagaatggtttctacttatgctcctaacagccatatcaaacttgttgaaacttgctctgggtgtggtgattcacacctataatcccagcactttgggaggctgaggtgggcagatcacctgaggtcgggagtttgagaccagcctgaccaacatggagaaaacttgtctctactaaaaatacaaaattagccgggcgtggtggtccatgcctgtaatcctagctagtcgggaggctgaggcaggaggattgcttaaacccaggaggcagaggttgcagtgagccaagatcg

SEQ ID NO: 154760 - DNA, 578 bp, Homo sapiens
acgtggggttatcgatggaggtaggattggtgctgtgggtgaaagagtatagatggggtggtggttgtggtaaactttaatagtgtagggagctgagcctattattaatgtggggtggtgggtagtttaggctgccttgtgtagaaggacagggctccattattggacaggctgaggacactggtgtagataaagatggtttcagaatccagagtgtgtcaaagcggcatagaggtgctcactaactgagatgattgagatatgcaaaagagttaaattaatagaaaagatttgtttctaatttagtaactgctgcccttcaaaatgacattaagtacttgcgcccctcaatttgaagaaaagaaaaaaaaaagccatctgaggctgtcaagtccgctaagagtagctgactggccgaaatagaacccacggggagagggtgtctctcactttgaatctgctcagtactgggttctggcagcagcagcagcaatttatagctcacatcttccacttccaccctccttgtctgtgatacttcatatttcattttgcaattaaaggtgacctgaaaatgc

SEQ ID NO: 154761 - DNA, 194 bp, Homo sapiens
gatatcatacagaggagcttcactatatccaccactgtgatatcatacagaggagcttcactatatctaccactgtgatatcacacagggtagcttcactatatctaccgctgtgatatcatacagaggagcttcattgtatctaccactgtgatatcacacagaggagctgtgctatatctaccactgcgata

SEQ ID NO: 154762 - DNA, 379 bp, Homo sapiens
aaagacccagaaatggcatagatgatggaattagtgatcaggacattaaaacagctactatgaatattccccgtatgttcaagaagaatggagaatgaacgagagtgagggaccggaaacgactgtgttccatgctgagggtggcagaggctggcctggatgctggatgaggctcaactcgggggcctgggctgttgcactggggctggactggggatcacggaagagggccaggcccgcgtgggtctccagggctgtgctcaggggcgtggtcttctgcagtgggggcttggctggtgagtggagactctgcgtgactctgggggcgtggccgagaatgggtgtagctctgtactagggcgtggtcatgcgtaggggt

SEQ ID NO: 154763 - DNA, 339 bp, Homo sapiens
atgatttacggagtgattaacagaggtctacataaagttacttttcccctttacttaattatattgtagtgtgcagataaaaaaactactaccttctcatccaagtggtctgtagaattcatgttccttacagtggtcatttaaagtcaatatttatttatttatgtatgtaataaaaaaagttggatttttgtgtatgtctgtcatgttatttagagagaagtaatcttgtaaaaatgttttgtaaaaaacaaaaaaattgtaaatagtcttgatattctgtgactcattatttttatgttagagtttgtacaaactggttcaataataaagtatcca

SEQ ID NO: 154764 - DNA, 681 bp, Homo sapiens
tctcactctggtacccaggctggagtgcagtggcacaggtcatagctccctgcagccttgacctcttcccaggctcaaaggatcctcccacctcagcctccaaaggagttgggactacagacgtgcaccaccacacccagttagttaaaaaaaaaattgtggagatggggtcttgctctgttgcccaggctggtctcaaaatcctgggctcaagcaatccctccaactcggccttccaaggtgctgggattacaggtgtcagccactatgcctgttttttgtttgtttcttttttactggtagagctatatttagacaaatttctaaaggaagacaaaactgaggtgtttccacattcactaaaatcttaaaataagggcatataaaagtttttttcaacaagctcctctgtcttaattcgcattgtgcttgctggaaactacagccatgtttagatctcatctatactctatttcggaaaaagtctaattttaatcattaacttcacatactaattaacggctgtagttaagctgtgaaaccttacctaagctaataggaaattaccttcacatgaggacaacttaagtgattcagacactccaccgttctgactatacttttgctgtgttgccacctaatttttattactactcccttactcactactccagccaaaca

SEQ ID NO: 154765 - DNA, 389 bp, Homo sapiens
tctcttactctggaacttattctgtgtgtgctgtggccttcaccctgtagttaacctgtgccctctgtatattcctccttaaaaagaatgttagaaaatggactctaggccgggcatggtggctcatgcctgtaatcccagcacttttggaggctgaggtggatggatcacctgaggtcaggagttggagaccagcctggccaacatggcaaaaccctctctctactaaaaatacaaaaattagccaggcgtggtggtgcgtacctgtagtcccagctactcaggaggctgaggcaggagaatcacttgaacccaggaggcagaggttgcagtgagccgagatcacactgcagcactctatcctgggtgacagagcgaggctctgtccc

SEQ ID NO: 154766 - DNA, 535 bp, Homo sapiens
agtcccagctactctggaggctgaggcaggagaatcgcttgaacccaggaggtggagatggcagtgagctgagatcacaccactgcactccagcctgggcaacagagtgaaatcctgtctcaaaaacaaaaataaaaacaaaaaaagcatacaaaccacaggagctcctcttggtccccctttgtctttcattccacctccagaaatcccagcagaatcaccttcaaaaactcctagaatccaatttttcccctccattgctactgccctgatctgagcctccataacccttacccaaatgcttcctaaacgtatcctggctggtgctgctgaattccatgtctttccagctgccctttaaaatacggtaggaggcaagtcttttctcaaaaccctccagtggcttctctctcagagttaagatcctgcagtggccttcctggcctcaggtagtgtctgctgacctgtaccctcggccactatactccagccacatggctttgtggttcccttggacatatccagcatgtttctg

SEQ ID NO: 154767 - DNA, 205 bp, Homo sapiens
atggtgggagtagggagaagtcatgatgaatgggtgttagaagagataaacagtgagggaaagtacacaaactgaaaaagcacacaaaaatcccaaaaacgaagtgcacaacagcaacaaaactaacaggaaaacaaaacttgggggcatttttaaaatatttggtttttttccttttcaagaacaggaaaaacaaaagatggtg

SEQ ID NO: 154768 - DNA, 287 bp, Homo sapiens
cagtcttcagaatcctttccagctgtaaaattcagtgattctctcttttcaaaataaaatgaatttataactttgagaaataaaatgtaatgatgctctagtactgctgagggaaggaaacatctgtgtatgcctcacccagaaccagtcaggggaggaaaactgctgattttctagggtaatgatgtcctgtgaaccaaccagactggcctcaagccgtctcaggaaaaatgacagcttgaagttctcaaaggatccaccaacatgcaaaggtctgcaagttcgca

SEQ ID NO: 154769 - DNA, 379 bp, Homo sapiens
actggatagagaatgagctgccagccagccttgggtcccacatcagggtcttggttctcctccccatgtcagtaagcccatgtgcccaggagaaaggaagatgtcatgcacactcctgtctttgagaagttgggtcttcaggctagcaggattctgactggggtctgtgagactgggaggaagccatttcccttcagcctcaagtctcccttcagggaaatgaaggcattggtgagagccctggttgcattgtgcagcccccacctggcacaggttttacacacagaggtcacattccaccaccacctatgcattcagacactggggaagacctggcctgtggacccccaaaatcccccctgggtgtctgacgccaccc

SEQ ID NO: 154770 - DNA, 302 bp, Homo sapiens
tgatgatatggcccttatttagtctgaattatctggatacaatttggtcttctatttcacaggtgtaaggaagcagcacagtctggaacataaaaacgtgtggactctggtgaaaccccgtctctactaaaaatacaaaaaaattagccaagcatcgtggcagacacctgtagtcccagctactccagaggctgagggaggagaatggtgtgaacccgggaggcggagcttgcagtgagctgagatctcgccactgcactctagcctgggtgacagagtgagatcccgtctaaaaaaaaaaa

SEQ ID NO: 154771 - DNA, 353 bp, Homo sapiens
caggggaaacacggaattgttttagggcagtggaattattctgtatgatacggcagtggtggatacatggtactatgcgtttgacaaaatccacagaaccttacagcacaaataattaaaacttaattatgctattttttttttagacggagtctcattctgtcacccaggctggactgcagtggtgcgatcccggctcacagcaacctccacctccagggttcaagcgattttcctgcctcagcctcccgagtagctgggataacaggtgcccgccacagtgcctggccaatttccgtgtttttagtagagatggggtttcaccatgttggccaggctggtcttgaacgcct

SEQ ID NO: 154772 - DNA, 501 bp, Homo sapiens
tacttttccacaggtaattaagacctgaaatgcagaggttttcagatggttcttgtccaggatggaatacatggttatttcctgaaatcttcgttgcattattttccctcacactggtagataatcagaaagattaccacacctccatgcataggatgctgggttattaatctggggaagaaattttttctctcccttttatttgcttaaatccagaggtagatataaaccaccgccacctcactctttacaaaaatcctatttaaaaatatttttaaatggcataaataattatatttttaacatttaaaatctaagtaatgcagataagacaaaaattctcaccactcttgctacccctcatctactctgctgcccagagtaaactgttgctacctatttgtgtgaccttcctgagttttcttgtttacacacatacgtgtctacactaagataagccttcacacaagtaacaccatccctgtgaaatcatttatccat

SEQ ID NO: 154773 - DNA, 176 bp, Homo sapiens
cagcaataggaaatttaaagaagaaatactggcagcaagagaaacacacagaaaaagtgagagccaaattctgagtgtaaattcttaccaaattcatgcctgacaactaaattatgcatatggaagtgggggagggaccccagagaggccagtgaagaagcaggcagagacctaag

SEQ ID NO: 154774 - DNA, 283 bp, Homo sapiens
ggaacaagacagagagacgaaagaggttccacagccttttaaactactagatctcatgagaactcactcactatcaggaggatggcattaagggcttggtgctttgccatttgtgaaggatccactcccacccctttatgattaaagctttttccacctaggccccgactctaacattagggagtgtactttcacatgagctttggaaggggcatagagaaaaaccgtattattctgtccctgaccccacaaatctcatgtccttctcacattgcaaaataca

SEQ ID NO: 154775 - DNA, 620 bp, Homo sapiens
tttaattgtgtagggtttttcgtgttgagttctgaagagttcttgatatattctggatataagccttttatcaggtatgtgatttacaaatcttttttccagcttgtggctttgtattttgatcctcttaacaatgtcttctaaaaaattctcatgatcagtagtgcaaaatgctgtgtttttgaagagaagttgtaaattttgattaatttactaatttgttactttgtggattgcatttttggtgtcatgtccaagaaatctttgcctgacccaaagtcccaacagttttcccctgtattttcttgtagacattttatagttttgggctttacattgagatctaggattcgtttggggttaatttttgttacgtggtgcaaggtatgaatcaatgtccagttttttgcatgtagagatctaattgatctagtagcaccatttattaaaaagatgtatctctccactgaattgcctttgaatctttgtcaaaaatcaattgctggctggccacggtggctcactcctctaatcccagtgcttttggaggctgaggcgggcggatcatgaagtcaggagttcaaggccaagctgttgaacgtagtggaacccctgtctct

SEQ ID NO: 154776 - DNA, 472 bp, Homo sapiens
gtttctgtattaacaactgggaaaagtacagcaccttatcaacatttatttgaagatttggtggactttgtggaagaaaatggatttcaatagagtccccaaaccatgacagatttggaattaggtgtgatcaaggcttctaacagtcaatttgaagatgtcaccaataaagtttgtcttttctgttcagcccaacacactgggcggaaaattcagatgagacaggaacttccgtttaaagatgcgtcatttgcctgcgtgggtgttcctcccagctgatgacaccccggagcgttcagggaattaacagctgcatttgccctaagaagccggggaagttactgactggctcgaaaatactcgtgcgtatggcaggatgagaggatgctttgtgatggtgttgttgctccgtcaccagcactatttccgccaaatctgcggtctgtgtatgaggcccatgcgcactggacct

SEQ ID NO: 154777 - DNA, 266 bp, Homo sapiens
gcgttagactctagaggctcccccatgtgggcattacttgctttattaggctttttggtggctgtgcatcttgtaagggtgtgtatgcatgtgcgtgtgtgtgtgcgtgcgacatgcgcttgtcctctcagacccaagttcttaaagggaaagagactggggcctacacagaggcaggcatgtatattccacagaccagagtttgacaagaatgactggacacaagagtggagcccagtcccagctctatgctgaattcagagtag

SEQ ID NO: 154778 - DNA, 504 bp, Homo sapiens
atatttaaagagtaattgcattttgccatcttagttaagaactctgctgcatcctaaattaaaaacattattgacttaaaatctataatacaaaaaagctttgtttttaaatacctagtttctgtccctcaagaccacataaagaaattctaataaagaggaacagtccggaagcaatgactggcccttgtcctgtgtaccatattctgcagcaggaacagtgcagacatctgaaacaggatagagctttaatcagctgagaggtttgctctgacttctgttttttttatattgtagcaaagctttcctgtagccatttctagtaggagaaaagtcagtctttatgatcaacagtgcctttttagttttttttttgaatgcataaatatccattaaaaaccatctttctgacattttcttgtatgggtttctgatgaaaattaaagatctggccctcgtgagacctgtaacctgtaatggaaacagtggtcagatccaataaga

SEQ ID NO: 154779 - DNA, 617 bp, Homo sapiens
ttcaagagagaagtctccaggaaagaaagtcaatagaagtaaaggtgcaatctagagatgtgtgtatatgtaaggggaaggagatattataaaagcaaataatgcaaataaagagacatggcaattagaaactccaggaaaataatgttgaaatgcacaagtgaactgtggtccaaatataaaataatgtgacatgaatttaatatatagtatatgagaaaagcattctaattgaccttgattctagaaacagtcctcagaatggcccaggtgattttatattgcatcagttacagaaggacacaaaatctaacacactacttaggccagcatcaaacaatatttacatggtcctctaagataagtgctatgtattggttttcaaagtttacagttatcctgtagtcaactacagttgtggctgcaagacagaatataaatattagtaatcctgaaaatgtgaaagtataagctgtagctgatacaagttacaataagaaagggagggataaagagtgtagaaagggttaagagtatacatattcttatattaaagtagagcttgaatagaatctgtgaaatgaggatgcagagaactttaacaattatttgaggtt

SEQ ID NO: 154780 - DNA, 271 bp, Homo sapiens
tgtctgtctgtctgtctatcaatcaatagcttttggggtttttggctgcatggatgaattattattttattctgtctcaaaaaaacaaaaaacaaacatagaaaaaaaaatcttaataagtttacagaactcttaaagtattttcatgaatcccagcgtttcatagaaaacagactgaaaagcacaaatttaatgcttctctgaataaggactgcaatgcttgttcttttattatgctttatattcatcctctttaagacatgaccttggg

SEQ ID NO: 154781 - DNA, 223 bp, Homo sapiens
cacacccttgcccaccagtgctctgcattattgccactcattccagacaaaaatcctcatgacctctttgtctgaagacacggcactccctcacacagcacatactgctacttcatctctaccctacaactctgatttatccttcaagttccaactcaaatgtcacctcctctgggaagctctctccagcccctccagttgtgagttatactatcctacctgt

SEQ ID NO: 154782 - DNA, 225 bp, Homo sapiens
tgtctaatatttttgttctggcctaaagaatatgttgacatttagattctctgccgccactttcctccagtagggacagaatagttgaacccttgagaaatacaatctgtacttttgatccatagtttgcttcttccgttatttatctggttgtggaaacatggtttagtaccttcctcctctttttttttttttttttttttgaggcagagtctcactgtcgcc

SEQ ID NO: 154783 - DNA, 220 bp, Homo sapiens
tgaggtctagaggggcggcagcacttgtccagggtcgtggccgacaagtcgccaagctggggagtttccatgggatccaagcctatccccaagcagcccaggggacacagacagcatgcaggcacacaatcgcacaccctgccccgccacccctgagcctgccgcatcgtcattcctgtgcaactaggcaccctgagtctccacatcggggtggctctgg

SEQ ID NO: 154784 - DNA, 137 bp, Homo sapiens
tgatttgagattgagaagacagtaatattgagtgagataaataatactaataggtcccaccggtactagatgtgcagtgcaggatgggtggcatcaaagagaatggtacagaaagggaagactggaaacgagaaagg

SEQ ID NO: 154785 - DNA, 784 bp, Homo sapiens
tagcacctcctcaatgttcaacttccacgttgctttccaactgcagcctcaatgcttacctggttatagccataattgtgattttctttgtgtaaaataaagtcagtcctaaagtgagagaaaaaaaattttacaggaaaagaatctttaactgacatgttttattggctgtctaaactacagtagttaggaattgtgttttacctgacataacaatagtggtctaaacaagacattaagtaaaccagcggtaggccagtctagtgctagtggaaggagtccttagtcattggtgacctagactcattctgtcttggatcccagtattcttctgcatgatgccttcctggatgtcacctcatagtccaagatagctgcagagttattctgacaccagccgtcatatttgtaatcccagcaccagaccctccagctaagcaaatacccttttcccacacagctttcccctatccccttctactagttctgtttacatcttcttagccagactgaccacctggccacatcttgctgcaagggagaagctaggaaatgtagtcttttagcttgggcctattgctagcccaagtgaaatcagaattgttattaaggaagaaaataaaccaatattgggtggcacttaacaatgtctgccacagttgctaatcaataaaatctcccttgaagacatgaggaaatccactctctataaactccagtacatcaccaatgccagttaccctgccttgcggataccatcggccctcagcgtctgtgggttctg

SEQ ID NO: 154786 - DNA, 389 bp, Homo sapiens
ccaccaactctggtttcttgctggttgggggtgtcctttctgagggcatcaatttcctaccaccccaaagctccaaatagagaaatgtggggagctgtccaaggtgtgtccaggaattatcttccagtgacctgtagggtggacaggtaggcagaggggatatgatggtatcaacagggtccaaccctgagagaatcatcaccctctttaggcctcggtcttcccatctatacaataaagaggttggactccatgttttcttaggggccttcataccctgacattctaggagtcttaacttttttttgatgtcgcgcatctcagggtggtgactgggtggaagtttgagaaaaatctctctctctctcttttttttttttttttgatgg

SEQ ID NO: 154787 - DNA, 265 bp, Homo sapiens
cccccaggattattcgggtcatgcaggtctgtgtgtggatcctgagagctgggctgtttacagggcagtggaggcagccaggctgtacctggactgaaacacctcatggtgaagcacttcccttggattaagctctatttagtcagctgctcgtgccataatggcaataggattatcagctaagtgagggaaaggctcatgggctgggataaggccatccagggggagcctgaataacagtctatcagaggggcatgggtctgaa

SEQ ID NO: 154788 - DNA, 593 bp, Homo sapiens
ctgatgttctacatggagggtcttgcagctgcagaactgtaggagaactgatgttctagtttgagggtcttgcagctgcagacctggagaggagctgatgttctagtttgagggtcttgcagctgcaaacctggagaggagctgatgttctagattgagggtcatgcagctgaagactcggggaggagctgatgttctagattaagggtcatgcagctgaagactcagggaggagctgaggttctagtttgagggtcatgcagctgaagactcgggaggagctgagattctagtttgagggtcatgcagcagaaggctcagggaggagctgatgttctagattgagggccctacagctgcacacctgaagaggagttgatgttcgagattgagggtcgtgcagctgaatactcagagaggagctgatgttatagtttgagggccctacagctgaagacccggagagtatctgatcttcgagattgagggtcgtgcagctgaagactccaggaggagctaaggtggtaatttgagggtcttgcagctgctgacttggggaggagctgatgttctagtttgagggccctacagtt

SEQ ID NO: 154789 - DNA, 300 bp, Homo sapiens
cgggcgaatcacctgaggtcaggagtctgagaccagcctcaacatggagaaaccccatctctactaaaaatacaaaattagccaggcgtggtggtacatgcttgtaatcccagctactcgggaggctgaggcaggagaattgcttgaacctgggaggcggaggttgcggtgagctgagatcgcgccattgcactccagcctgggcaacaagagcaaaactcagtctcaaaaaaaaagagatagacttactctgaaggagcaggaggagagaagtatgctagcggtggggcagctgggaag

SEQ ID NO: 154790 - DNA, 508 bp, Homo sapiens
ggagaagctgtcttcttgacttttccagcttcttgacattgactgccttcctttagctcacagcccacagcactcagaccttgcttccaccatcacctcacctctgactccaaagctcctgcctccctcttaaaagaacctgtgataacactggacacacctgaataatccagaataagaataaccttccctcctcaagattcttaatcagttctgcaaaaatccctttttccctgcaaagcaacccattcacaggtttcagggattaggatgtgaatatctttggaagaccattattctgcctaccacagacattgagatcatagataaattaatttaccccttctttttttaaagtttcttttttctttcttgctttctttctttttttttttttgtttttttgttttttgagatggagtctcactctgtcacccaacctggagtgcagttgcacgatctcagttcattgcatcttccgcctcccgggttcaagcaattctcgtgc

SEQ ID NO: 154791 - DNA, 323 bp, Homo sapiens
ctcaagcgctctaaaagccaataataaaatttaaaaatcaatgaggaagctgacggcaagccgatgacggggccagaggccaggaatgatgtgtctccaagtgaggagcaggcagacagcccaggcggcagggcttccaaccagaaccccagacccagagccccgagcatcctggcgcagacgcctgggatttggcagagatcctgcatccctggacggcgcctccccacggatgcgggaagcacaagtgggaaatgaggctgtccaaggattaagacccagacccccagtgccgtactgttctattcttcctgtctttggag

SEQ ID NO: 154792 - DNA, 209 bp, Homo sapiens
ctgtttgtgtaagtaaggcccttggcatcagcacgatgtaatagaaagaacactgactggactgggcctggtggctgatgcctgtaatcccagcattttgggaggctgaggtgggaggatcacttgagcccaggaggttgaggctgcagtgagccgtgagtacaacactgcactccagactgggtgacagagcaagaccatcctgtctc

SEQ ID NO: 154793 - DNA, 269 bp, Homo sapiens
catcggctgagcagtaaatcagaattttgtcccgaatgttactcacctgttagtcgcagccctccaacacaggttcgctgtggaaatcactgccattttacccatcttcttgagcatgaaaaaaacccccatcttcccagaataacgatcccactcccaatttagcaagcagccaatttctagacaatttgactaatgacaaaaaaatcagtgtttatgacatcatctcccagcttttcactatttccttttcaccttgaaaagctaat

SEQ ID NO: 154794 - DNA, 485 bp, Homo sapiens
gtggggtgtcaaaatatctttctagggtccataaatttaagttctaaaaatctgacatgtgaaactagaaacttctgctccagacccacaaagctttactattttcctccagacatcattactagatcaaacattacggtttcgcgaacagttttaagtttaggtgtatggggcccctctgtaccattttataggtcaataccatttatttctccatggaatatctttggaaaacacaaaatgaaagtggacctagaaagacaattcaaacaatggaattgaaaaagaaatcttgtggccgggcgcggtagttcatgcctgtaatcccagcactttgggaggctgaggcgggcggatcacctgaggtcaggagtttgagaccagcctggccaacatggtgaaaccctgtctctactaaaaatacaaaaattagccaggcatggtggtgggcgcctgtaatcccagctactcgggagactgaagca

SEQ ID NO: 154795 - DNA, 669 bp, Homo sapiens
atctttaggttaaggtcgccaacttaacccaatttagcctgtgactttcttggtttttgctctgcaagcttctgtcccaggaaaccccacagtactggtcacactggggaggctggcttgcctgcctaccacctaaatatcagccaccatcatattgagctcttactatacctcagctgggaacttgagctcaaggctttggacttgagtataactttgctcctggaagcaaactgtctggctatttctattccttgaccctaaatcaaaaaatggcaaataactctcaggccatggagcttcccttgggtgttacagttacagattttcaagtcaaggatatgttcaggacctaattagctcatccagacacttagaatctagattcatgctggaagggaagaaaatgtctccctcctcacctttgctggacacaaggatgtgtcatctttcatctgtttcttgccattgtcattaccatcaacattgacagagataacacatagaaccttgaattatggaatccttattaagttagatactcatctcttctagaaaataaaatgtttattagtaaaagcagaatcctcaggaaaacagtatttataagccctagacacatggccctggaaaagtcacttaacttctctgaacctctttttcctatga

SEQ ID NO: 154796 - DNA, 487 bp, Homo sapiens
tggtagtggtggtggggggaacgtgggtgtgtatcttggaaagtttccttttcccagaactatctgctggaccccctgggtaagaggggtgttccaaagttctggcaacagcatcccctggcttcaaatcttccccaggcaggaagcgtcttcactgatgccccaccatggagaggggccatgggcaggaaggatggaagcgcagaggggaggacaggatgaggagggcatttgtagagaggtttgaagttgaatcagaacacacaaaaaccctcaacccattcaaagctaccggtgagtttcactagatcatttaaagtggggggaaaaagcaatggtacaggaaggaactcaaaacagataaaggtggctcccagtggtccccacctcctgacactcaaactcttgtttagtcccttgccacatcacggttagtctgtgaccaatggaatatggcagaagggatggtatgttgctttgagaccag

SEQ ID NO: 154797 - DNA, 352 bp, Homo sapiens
tcagtgtatcctgctttaggtggactttgtctttatgttcataattttaccatcatttatattatggcagaaatatcctaaaaagcatgtgttagctttgtcttctgttctttttcttttttttgagacggagtttcacttgtcacccaggctggagtgcagtggtgcgatctcatctcactgcaacctccgcctcccaggttcaagtgattctcctgcctcagcctcccaagtagctgcaattacagcactcaccaccatgctcagctaatttttgtatttttagtagaaatgggatttcacaattttggccaggctggtctcaaactcctgacctcaggtgatccacctg

SEQ ID NO: 154798 - DNA, 332 bp, Homo sapiens
cgcctccgggcccgcgaggttttgacgaccagcgggcgccccctcgggaaccacatttgtttcccgctggtctcgagcgtccagagcgcgaagcggcggagcacggcgaacctacgattcgtgatgcttggcctaatcctctgcccttcatgggtgcgggcaggaacggagtagcggctgatgtcccctccctaatcccaaagccccacaaaagccaaaatacacacgcaaactctcaccagcgcatctcacaaacacaaaaactaaagacaacacatgaaaatataacccgatcccccaccaaaacgtacagttcaaaaaaataaaattca

SEQ ID NO: 154799 - DNA, 184 bp, Homo sapiens
attggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaa

SEQ ID NO: 154800 - DNA, 156 bp, Homo sapiens
acagttgtgaaggaaaataacctcagacctacttttttcctgaagctttttgccagacgtatgcatatatggagtttgtataaacataaccaggggacccattctgtatgtttatccaccaatcttatacctgtatctatatgtattaaaaaagcc

SEQ ID NO: 154801 - DNA, 687 bp, Homo sapiens
ggctgtgttccatccctgcccccgctgttaaccatcacctgttgattccgctggattttcatttactactggagaagggaacagaaaacagaaacacatgtaggttttgaatttaaaaactttttttcctttttttttgagacggaggttcgctcttgtcttccaggctggagcgcaatggcgtgatctcggctcacagcaacctccagccgaggcgggtggatcacttgaggtcaggagtttgtgaccaccctggccaacatggtgaaacctcttctctactaaaaataaaaaattaggcgggtgtggtggcgggtgcctgtaatcccagctactcgggaagctgaggcaggaaaaacatttttaaaaaacttgtgatggcagagtcaaaacagaacaagcctcggaagatgtgcacatttaactgtccttcagtattctgtgtaaaaataccactcacagttcacgttttcacttttgaaaggctcgaagtgagggaaatcaaccatcataatgaaagaacaaaagaatgattaaaagaaaaggtgaataggattcatgaaaacgctttgaggccgggcacagtagctcatacctgtaatcccagcactttgggaggcagaggcaggcagatcacttgagatcaggagttcgagaccagcctggccaacatggtgaaaccccatc

SEQ ID NO: 154802 - DNA, 218 bp, Homo sapiens
catacagcctattgaaccttattgcatcattccatgcctccaagtcttcaccaggaaatactaatttcttgcaatttgcaacatggagctcgctaattcctatctaattttccagatatgatggctctggtaagttctattttatgcagaaaatcaatattaccttttggtcaagtctttaatataattattttccaaatagtcacttttctagctag

SEQ ID NO: 154803 - DNA, 327 bp, Homo sapiens
ccctgaactcgctgatcgctcagctaccgaaatgtctggcagaggctccgtcttggcttcactgtctcccctcagaaaagccagtctgagatcctcctcaagtcttggaccaaaggaaagacagacaggtgctgcggccgacatccctcagcctgcagtcaggcaccagggccccgagcctctcctcgtggtgaagccgacacacagcagccgtgagggtggctgccgagaagttccccaggctgcctccaaaacccacggcctgctccaggccgtcagaccccaggcacaagacaaacgtcctgcggtgacctgacagcccggccc

SEQ ID NO: 154804 - DNA, 712 bp, Homo sapiens
agcgtcagctgactcacttctcaaaaacggagctccccgagtgagcaattcctgtcccttttaagagcttacaactctaagggggtccgcgtgagagggtcgtgattgattgagcaagcagggggtacgtgactgattaccggtgcaccggtaatcagaacggaacagaacaggacagggattttcacaatgcttttccatacaatgtctggaatctatagataatataaccggttaggtcaggaggggtcgatctttaattaccaggcctggaatgcatcgccgggctgtctgactactgatttcacttctgtctttcttttaactcctacattttctttgaggcagaaattgggcataagacaatatgaggggtggtctgctcccttatttagggatattgagtttcccaaaccagttacttgttgattgtataagacacaactcacatttatttgtccaaaacttccactcttttttttttaaaacctcttgcattttccgatgctgtcactcttgaggtttcctgaaatcccgtcagttctaggaattcatgacacttctctcctcccaattgtgggatgtggttacacaatcatggtcccttcagtctccatctcaaaccggaagctttacccctgtcagcctgtagaatgtcttgggtaagaatgaataccctggttgggcgcggtggctcacgcctgtaatccca

SEQ ID NO: 154805 - DNA, 440 bp, Homo sapiens
ttgaacactcagcagggtatgaatggttgaagtatggcatctgggattggcccagacttagctattgttacaggcacatactcctaagttttcgatcttgtctacctattaagctaggttgcagttcatccacaaaaacttaaatatagaagtatagagccctcaggccatatttagttcactttaacacactcttctgtgcattctgaattataatcctcatttcttctcattcccaagtaaactcaacatatttagagataattttctctacttttttttttaggttgacagtttcaaagcagtttgcagggatttctctttgtctttaaaaactcccttttgtcctgattttcctcaggtgggctatgactttcgtagatgctgagtggattaaaacaaagagtttttcacattatactctcagaacacactttttt

SEQ ID NO: 154806 - DNA, 184 bp, Homo sapiens
taataattagctctagactgaacattgctccagacctaacaaatcataaaagaaagaccagaatggatcaaactgtttgcaagtaacttaattgcatttcagaacaaagctcaagaaaatatgcagtaataaaaagaaattcatcccttagtaaggtaaaatgcacaatgtatgaaatctaatc

SEQ ID NO: 154807 - DNA, 805 bp, Homo sapiens
acaaagaagaagatttctaaaccatgccactggtaagatttttaaaaattactataattgacttaaaaactactttgatccatcgttggctgaaaaaaaaaaaaagaaaaaccaccaacttagtataaggtcaaatttataataatgcagaattgtatgttttctgtactctctattagggtctgcaaatagtaagcacggataatttatacaattctttggggttttatttaggagacaaaccatgtgggagacaatgcgcaacactcacagaagactggggcttccctctgcaactcaactctgccactagctggtgatgtgatttccagaatgatctttgtgtcttggttgcctctactgtaaaatgaatgagctacctctcagatctcattcagatgcaataccttacgactcggagcatacacttagttttaaaatctgagatttaaagttatcatggcataatttgcagagtttgtgtaaagggccttttaacagattgagaggttgggggtggggataagatatagttcaatcactgaacaccaagcaaggaactaggctaagaatactgagggaaaagtcaagacttatttcctcaaagagggaatctcttccctaaactaccaaacaggtatcttgtttattattttcgtctacttggcggggaggttgttttgccactcgtttcacagtatctctggagcccacagtggctgttcctattttgactaatcaaacccttctttgaccaacatacacaagattataaagaaagaaatttaaaagaccacaggtgctt

SEQ ID NO: 154808 - DNA, 108 bp, Homo sapiens
tgggagaggaaagccagggcccagcacgcacctcttagtgtgagaccacgtggggggctttaggtgtgcgggctccttaatctgcccaacaagcccaagtggggttca

SEQ ID NO: 154809 - DNA, 176 bp, Homo sapiens
tggcagtgacaagagtaatttggggagagaacatactgaagatggaggagccactgccagcctgtatttctgagtggctgcgtggaacagaggggtccctcctcccaccctggatggttaaagaaacaaagacagcaacttcttgcttataggccagcggttttcaaaatgtggtc

SEQ ID NO: 154810 - DNA, 298 bp, Homo sapiens
gtgttattgcttccagcatctctaggtctgcaacagcaagagttaagttttgctcagagaatgaaggaaaaataacacagactgggcagccagatttgcgagtctgggcttttcctgacaaccagtgcagactatagctccatctgacatggaaccggcgtattcacaagcattgctagatctgtgatctagttatgaaaacaccagaaatcggctttgttttcagggtgaaaaaaatgcaaagtcatacagattcttatttcctaatcatgataaactccactgtatggtatattaa

SEQ ID NO: 154811 - DNA, 374 bp, Homo sapiens
cacttgaacctggtaggtggaggttgcagtgagccaagatcacaccagtgcactccagcctgggtgacagagtgagactccatctcagaaaaaaaagaaaaaagaaaaagaattaagcaaattgggtctagtattttagagtagaagaaaagaaaccaaatggggaaacgactgagaagcaccatttttcagagtttggggatgagtcctagtacttgtcctcagggtgttcaacagtattgtgtgggaaacagacaactagatcattgataatacgttgtaaaaatttgaccatagagccaccgcgtgcagcctgttctccatcttttgagatagttatatttcaaggcctttctcaaatgttacttttctcc

SEQ ID NO: 154812 - DNA, 246 bp, Homo sapiens
cctaagggctgtgaaagaaaagtacaaggtacaaagagaaacgtcaatagtcctgaaaggttgactgcatcaagaacatgtccatggagaccaggctgatggagtttttgtttggattgttttgggtggcagggggtaggggtaagggcacatggagcgttttgtttgaggtacttgaaagggagatgtcaagtaggcaactgaatatccaaatcaagagagtctgtagtggagtggtgactcaag

SEQ ID NO: 154813 - DNA, 349 bp, Homo sapiens
gcgcacccttttgtcatataagcgacaacacagggagaaagctttgggcaaagggaacgatgtgtgctagtctttgggatgagtgaacaagctgaattccataaaggaaacatttttggtatggctgaagtgtgaccttcccaacacatttagtcctgcgctgcctcacgttggtcaagtggttgatttcaattacgcttttcgcgagtatcttccagatcactgcctccctcacagatcctccaggatttgtagaatcccagctgagaatagtcaagggctttggtccaaacaaatcaagctaatttcccaactccacagttgagtgtctacaccgccttgggcagtg

SEQ ID NO: 154814 - DNA, 396 bp, Homo sapiens
aggccccatcttactggacttagcagcagcatttcacatagtcttttcctccttcttccttgaaacactttttcacttggcttctagaccacgccccatcttgttcttgcactgtttctggctattccttctcagtctcctttgctcgttcctcatctcttgatctctgaagatggatgtgcctcagggcccggtccttaaacctcttctctctgcatgcccactccctggtgatctcatgcagtcttagggctttaaagcatcaatatgcttatgactctctaatctcatctgtagctctgaccccttccagaactccagattcatccccactgggatgtctaacagaaactcagatttgccatgtccaaaatcgagttattgattctcccctcc

SEQ ID NO: 154815 - DNA, 381 bp, Homo sapiens
cagggtgctttccattaggaactgcctaataagactaggaaaaatctttattgctaagaggacctagcagtgtatatattcagggtagagaagtataatgaagaacaacggtccccttgtattctgatagcatatggcatttatgcaggtttctgacagttagatgtgattgttaaattacagtcttgaaaaatgttatattctccccctgtgtttacaggcagaaattgatactaccttgagaagagtcacatggtattttcccaaaagagccaagataaagaaccttcaattctacataatgaggcacatttctaatatgccttttgttctaagtggacaacatatgaaagcagcagtgggatttttttttcagcttct

SEQ ID NO: 154816 - DNA, 484 bp, Homo sapiens
tccccttcccgagagtaaaaacatccatatgcccatcacctgagaaaatcatatgcacaggatgcacccacctcacctttctctgcctcatcatgtcagaaaaagtaccccaccttttgtcacaaggcaaacctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagccactcagggtggggagcactgaggtgggaggatcacctgagctggaaggttgtggctgcagtgagccgtgatcacgtcactgcactccagccacggtaacagatatttttaaaaggatcttctctgttaaaaataatcaaataaacaggtggccatgaggctagtgtggctg

SEQ ID NO: 154817 - DNA, 545 bp, Homo sapiens
actatcaataaccaaactcattaactaatgagatgatctggccaggccctgcattctcagaggtggttttgggggtcagaagggtttgcgtgttggggaaagaggcttggggtgggaagagagatgacctccaaggctttgcaaagctagccctgatggagggtgaagcttgggtgtaggactgtggcccttccccttcctgtgtcccaggaagactctgaaacctccctcctcaccctctgctaccttaccccttttggggatctggcattgaagcatctgttgatccactgtctcttcgccactccttgtcgtaacacgagaagtgattcctagctctgaggtgtccatgcagagaccacagacacatgcagtgactcaaattggttctgagatgggccagtgtaaggtttcccattaggtagatttcccacagcttggcttaacgtcctggtggcttataagtgagcatgcctagaactgcttgtccctatttttgactcggctgcatacgattagggtttgagtattcatgtggcctgctc

SEQ ID NO: 154818 - DNA, 332 bp, Homo sapiens
taaaatattatgacaaccagcaaaatgtggttggttctagacactgaaaatagctaaaaaatacaagctaaaattgagtgagaaaaatatttaacttccagtcttagtttaaatgattaattctttatgtacaacatatctggtttgaatacaattcataagaaaacataaaagtgtacttctgtattaactaaatgaagtccatagaatagtggatgatggataaagcaaggggagattcagatttcatttataaaaaaaataatggctagactatgatgactagcaatccatgtaagatctgtaacatagcttccaactcatatgccatc

SEQ ID NO: 154819 - DNA, 435 bp, Homo sapiens
gcagaagagccttctgggtagagaggctgcagtgcaaaggctctgaggccagaacatggcttaggtattcaaggaacagataggggagctcctagagttttgagcaaaggagtgacacaaacttttatcaggattcttttaccagtgctgtcccaagacttgggcctggacaagattggtaaagatgacaggtgttaaatgtaggtgggtgagagaatcctatcagcaggtgagggaatccaggaggaaattgtttcaggtggggaggagagaaagtaatgaatctagttttaaaaatgtagaactggagatgaaggtggaacatcctagtggagaggctcagatgagggttgacagaattttagatttgaaagatcatctggtctatcccttcattcaagaaatatgagcctgcactgcacctctaatcttacc

SEQ ID NO: 154820 - DNA, 450 bp, Homo sapiens
aggacgtacatgaattggactgggcgtggttggacgtgtgtcgagtctgtgatagcctctactgatatcactgtgcagaaggctctcagctttgttttgctggctgtttttctaattcagcagggaatactcatcagtggcagttcaatgcgcgttaatgactctgggattgcaggcatcactctggacaaagaaatgattattgtgcggtcaaaagaagttcaaagacaagaagggaatttcagttttttccttagagatccacttcaagagcatataaataagccaaatgttaaaaaccacagtctgaaagctgacttcaaagtcacaactctctaattaatgaactgcgagcttcagtttggacaagttgtggtttgatgcgcccataaatcaacatgacaggcctgttcacagtctcagacagtgcttgtcattgagtcacatcag

SEQ ID NO: 154821 - DNA, 512 bp, Homo sapiens
cacacgaggatcccggtgttcctttgtctttcctttagactatcattgaatcacattttctcagtcttgttgtcaaaggatcatcttcctgtctgttctaacaactgaactgtacaaacttgagttgcacaacattaaggtttatacacctttatcacttgggttggaattcatttagtcaacataaatacctcaatagaataggtttttattgagcactcactaagtgtcgggcactgacagttctagatgttgcagatacagcagtgaacagaacagtgccgtcctgcagacagaggaagaaaataaatgaataaatggatattatggtaagtaagtcgtgctaagaagaaacacagagcaggaaaaggagtgaggaagtgccgaaggctggtgaaatggggagctcctgctaagacaattttccagcagacacgtgagggctgtgggggagaaagctctgtgtgtaactgggaaagagcacgatacagacaaagggaaacaaatgccaa

SEQ ID NO: 154822 - DNA, 693 bp, Homo sapiens
gggtaggcgcggggcggtcggctgcggtggcggcgtttggatgattgtctctcggcggcggagtcggtaacactgtggtgacactatctctgtcatgcatcaaacttataaaattggctgggcatggtggtgcatgcctgtaatcccagctacttggaaggctgaggctggagaatcacttgaatccaggagacggaggttgcagtgagcagagattgcaccactgcactccagactgggcaacacggcaagactccgtctccatagaaacaaaaaaacaaaacttacatatgtgtataagcctgtgtcaggattctgtacttttccttttatctacagtttgcatatttatatttcttcagtaatatatgctgtttcaagtactacagctttatattaagccttattgtctggtagaacaaaactttccacatctaaaaagttttcttaactattatttttctcattcatttgaattttagagtatgcttatcaagctctatgaaaaattacattgtagttggctgggattttgttgactttgcatgttaatttagaaaaaactgacatcttgaaggagtgttttcccatacaaaatgtatttatatctgttatgtctttaggcagagtttctatttatccacactaaggtcttgtacattttttattggctttatttctgagtactttata

SEQ ID NO: 154823 - DNA, 405 bp, Homo sapiens
aaaaaaacaaaagcaaaagcaaaaaaaaaccccagctcctgacagaccccagcaacttatagatgaacctgagtgaacttttctcattaccatgctaaagtctccacccggggagtagctatagcttcattaccataacacatgacttatgtgctggcataatgactcactgcgtctgtaccactgggacccctcctatacatgggatgatgtagcctctcgcctctccattgctccataaaattctcctattactttcccttggagagatgctgctttggaaaatactcccagtgtcctccttacttacaccaagtaataaaactcctattgatctaaacttgcattctcacaaacagtcgtttgttactcgccaggtgaatgaacctcattttttttttttag

SEQ ID NO: 154824 - DNA, 303 bp, Homo sapiens
gatgctgctaaagtgattgcatcagcaggctctgaggggctgagactgaagcctacctccaccacatccaacttcaggatatgtagatgatcccttggccttcattgtctatgaaaaggggtggtaccactcacactccaacatcaatgaagacatcacttacagcaaagcaagtaaactacagagcacacacacgtgtacaaacgtgctcgtgtgtggtgatatggactcagagttgcacatacacagcacaaggtgatatccacactacctgagcacctgacgccagcacactactttcta

SEQ ID NO: 154825 - DNA, 437 bp, Homo sapiens
tttccctctactggggtgaggtagaatatgccctgtctctctagaatgtagaaacaatgtttttccagcctctcagccccaagcccttagtgctaggctatcctttgccttgattctgaccccttcccattatctctttaccccagacctttttcaatagactggctcagagtcataattaaggagtaaaagccgggaataagagaaagaaaataaaatccacccctccccaaaaatgcatattcaggctgagtttaaaaagggaccgtaaatcactaggtgtttcctgctacatataataaatatgctgtcctgctccttcaacagctgttgttcccatgctctaattctgaggtctgaaaagattggggctagggaatggttagacagacaatgagcctttcctccccaaacaaaaattccccaatctggtatgc

SEQ ID NO: 154826 - DNA, 496 bp, Homo sapiens
gcctcagcctcccgagtagttgggactacaggtgcacaccaccacgcctggctaatttttgtatttttagtagagatggggtttcatcatgttggccaggctggtcttgaattcctggccccaagtgatctgcctgccttagcctcccaaagtgctgggatttcaggtgtgagccaccgccctggccagactgtaggaatctaataatcaaataattgtaatgggaaggagagtggagtagaagcccatttctacttactctttctctgaagttttaactgtttgacaatttctggaagtcacctattacaaactcagtatttctataaacaaatagtctgatgcatcagtttataaacaccaacacatttatttactatgtgttatcagaaaagcctcacttatcttccttgtgttctttgactaggtgagtacttaaccatttattgggctcctactctgtgctaagcacttaaaatatttcacctctcacagg

SEQ ID NO: 154827 - DNA, 301 bp, Homo sapiens
caaactacccctgccactaacatccctaagaaatagagtagttgtaaaattggaacagaacatgtcaactgtagtagctacctcaaaattcccccttccctagaaggagacgagcgttttccagaaaaggagacctgcatccctcccgtgggctagaagagacaagatgacactctgagggacagcagcaggtggccagggcctgagacatgggctagaagagacaagatgacactctgagggacagcagcaggtggccagggcctgagagctcaggggtgtaggtatgaacaacagtgca

SEQ ID NO: 154828 - DNA, 447 bp, Homo sapiens
agtatttgttagaataagctattttttccccactaatggtaacaatttaatattgggcaatcacatttcagtctaaaaaaattagcagcagtgctggattttggtctaatatcatgggacttttcccagtctacatgtaaatcatcccacctttgttgcagcagtggagaagggcttgtcactaggtcttctaatggactgctagagtttaattatatgttgttttatggtgtctggcaatgtgattcccctgcctgacatagtttatgagctttttaaaaataaagatcatgtgactttgtgttctcatttgctaaaaagcattcattctttgggttcttgtagatcctattgctgtagtgaacttggacctggtgttgttattttgtaaaaatgtcctcaaaatcaaatgtcactgaatataaagacagttctaattaattaatg

SEQ ID NO: 154829 - DNA, 352 bp, Homo sapiens
acacaggacaggaggcagggagaaaaacacacaaggaaactgagactcaggcaatgccacagacatacaaaaaagcagcagagccaagaccgtagtgaaagaaagaaccacactaagagacaaaaaagaaaacaccatgagaagcaaacaaaagaatggaaaaagggcaaagactacagagtaagcaaaaggggtcagcaaaacaaaagaatacaaagaaagagagagaaaagaacaggaggaaaccaaactgaggcagatgagaggcagagatggaaaataaataaggggttgaggagcagaatgtagtggacgagcaggcaagaaagagtaatactcaccaaagagacag

SEQ ID NO: 154830 - DNA, 349 bp, Homo sapiens
ggtgtgctatatcctgctgatggcaaaatacaacctaaatgaggcacaggcccaatggctgagagacagtacttcaacatgagaactgaataaggctgcaattagcaagaaaccaaactacctgacccccagaggcttctaactagctagtggtttttctgcttccagtccgtaggagtccagaagcaacatgcttcacaggccaagcacagagccaggggcttcgactctaagttctaattgagatctgctgctcatgtgccctggtggctaccttagaaccatagtcataggaattagagagcagaacttccagaagaggcctgcagataaatgtggcaggtggaca

SEQ ID NO: 154831 - DNA, 330 bp, Homo sapiens
gttcagccgcgtccacacgacccctccagcagcggccaccaggacccccgagagccctgccgcgtctacacggatcaccccctccggggcccagctgcgtcgacaagggctacccctctcaaaagtccagccacctggactcgggtcaccccccaggaaccccctgggagccgcatccacgcggaccccgaccccagcccgcgtccacacgggtcccccgacccccagcctcgcctcctacctccaacgcaaagcagagacatgtctccgagctcgcaggtgggccggaggcggccgggccggctctgtcgggtcgggctcagcggccgc

SEQ ID NO: 154832 - DNA, 340 bp, Homo sapiens
gtcccccatcccccggtggagccagtgaccctccctcctggcatggggaacaggtctgtccacacgtgggtcacacacgccgttccctcgggcaggacctggtcggcctgatgagggcagccagtgcctgaggaggtaaatggccgagtggaaaagttcggcaggagggagtgagcagaagaagccggagccctcgggcacaggagtgtcctccccggcctccctccctcggctgggcgcccccgcatcctgcgccccgcccaggggaggatggaagaaggcagccccaccgcggactccgctccgcccccgcctccttcctcctccgacccggggctgc

SEQ ID NO: 154833 - DNA, 436 bp, Homo sapiens
agacccctgccagggagcagagaaaagatgcacccaccacggacgccacgaccacacacactctccctggccgctgcacacaaatacaaaccctaactggcaagagcagagggaccaggaaactgtccctagagtcaggaaccccatgtgctcagacagcagtgtaagcaagatttctccacccactggatgccaggagagtcctcctagggggcccctacaccgagactctgcccccctcttaggactgtccctgagttggaagccagcccacttggaagccccctgccctcccaagtggaacactggcacaggaagcaggccctgtccccaccaccttctgcaagctgggccccatcatgctacagaaacggggagacctggtctcagggatggcgctttcctgacatctcttgttaccccctcgctcaccagg

SEQ ID NO: 154834 - DNA, 224 bp, Homo sapiens
ctgaggtgggaggatcgcttgaggccaggagttcgaggctgcagtgagccaagactgtgccactgcactctagcctgggggacagaacgagatcccgtctcaaaaagaaacaacagtgtaacagacaaacatgtacccttcaccttgattcatcacttgttgacagtgggctgcatttgtctgctctctcattatacccgcacacacacacagttttatcttct

SEQ ID NO: 154835 - DNA, 335 bp, Homo sapiens
ctgtaaagcctgcagaactgtgagccaattaaacctcttttctttataaattacccagtcccaagtatttcttcatagcaatgcaagaacagcacaatataggagataagaatacctccctcaaagggatttttgtaagtaaatgttaagtatgtaaaatgcttcacagtatctgaaaggagtaagcagaatgtatttgctgttagttacatcatttcttcccagcagtaactgtgattaaaacttcctatttgcctctttttgtcagtgctttgatgactggccttggggagggtctgagaactaaatgaacagggacaaatctctatcctaga

SEQ ID NO: 154836 - DNA, 157 bp, Homo sapiens
tgattttagccattgtaatagatgtgaagtggtatctaattttttttgatttttaaaaatttctctagtgattgttgatgtgtttttacttttctttctttctttcttttttttttttttgagacagggtctcaccctgtcgcccaggctggagtgt

SEQ ID NO: 154837 - DNA, 391 bp, Homo sapiens
agaggccatgctttgatgactagttggataatagaaggtaaaactaaagtgatagacttactgaagactgatttgaaatatagagcaagtatccagaaatgatcaaagttctttttcacgattgtactttgctaagctcctgtgtctctggagctcagagtgttgccacagcttggtatatatgggctaagcagggccagtctctgctctaaggagcattcactatgtcaccaccacttgacattggaaaagcactttcctcttgtccaatcacttggccagtgtgaactctgtgtgtcttaactctttaagaggcaagtcagtcaggaagtagcccccttgccaaagcaggaattttacttacagcatggattctaagcaggccagtgat

SEQ ID NO: 154838 - DNA, 666 bp, Homo sapiens
taaatcagagctgttgaaggcttgagttcagcttttttttctgttttttaaatccagtttcttataacataacctaaggcctattttcatcacaccactcacgtctttatttgtgcttatggaatgctgataatctgaagcttttttttaaaggttaaaaaaggtttaagagcatttttaaaaggttaaaaaaggatacgtatcatgaacaaagtttgtatttgttttttaaataaaaccttagtgtgaaaaacaaaacaaaaaagcaacacgaaaacaacagcaggagcaaactgaagattccctacctgagacagagaagaactaaaatatatagcagcacatttcaagatactatatggtagaagatctcccttagattaatgtggcgtttagttctttgttgtatggacaggaatgcagcacatttttattacaaaaataaggagctgttcgggttgtactttttagtctcaaaattggaaaggtaaaaccaataaagatgatagagcataaaataaaactctgtgctaaatagagcttacattctaatttacaagtttactgtggaaacatttattcttgataaaggagacacctggctctacttttccaactgcatgggcaagaactactaaaagaagagagaaaagaaaggagaaaaga

SEQ ID NO: 154839 - DNA, 947 bp, Homo sapiens
ccactcctgctcaggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggtgcccctgcctaggtccatttgtcagccacttttggcttgcatcaggcctactgcctgggctgtgggcagccccaggatgagggagacatggagaacactgtgtcctgcagtacccccggctgccaaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacctccctctcttcctgatccttcccacccaccccccaaataaaccaaaagtggacacaagt

SEQ ID NO: 154840 - DNA, 266 bp, Homo sapiens
accgcgcccggccccctattgggtctttagtaggatggatttggttcctcttggtgccccagagagcgaggttatgaattgtcagggctggctggtttagcttagaggaaactaccagtgcctgcacttaagtcttggagctctccttagcctgaatctcaggcctggtaagaggaacaggaactgagtctgctgatttgtgaattgagaatctgcatttgtgcagccctcaagacagccgcgtccagggttcttgagaactggca

SEQ ID NO: 154841 - DNA, 266 bp, Homo sapiens
agatcttagtgttgtggattcttagagtgtttaaatttgattttcaagacttgctcttaaggaaaacaacatgctttaagcttatggtttgtgagtgctgcctgggcatatgtgactgcaacatgtgttaactgttagtaatagcctctgtaggtgttggagtggaccccatcagctttatttatatagctcacgtttagaacaagaacctatagcttcgaattctctgtgtcatttgttgtttttgaaaggaagcataggtgtaa

SEQ ID NO: 154842 - DNA, 495 bp, Homo sapiens
agtgatagaggtggagttctctgctgatccattcagcctgagcagttctcacaccactggctctggggtgctgcttggaccctgtgtctctcttcccagaggggaccctcgggagagcctggccttccccagacaggcctgtggttgttgtctccagttcctgcctgagcctcagtcttagagactcagcccgtcaggatggccctatactctccatcgttctctctgcttggatgatttctcagcttcaccaggctcctcccgcttgctctgaggtggcccgtgccctcgcagctttctgcagaggtgtcactgtactctggcacctgcctgctgatgtagatagcaggggagctgttttctcccttgcgggggtaggagcggtcttagcctcctggtgcgctgtccagggaatgcctgagcacccggctaatgcctggaccaacttctgcatgttcccatgaggaagaccacagggtcggctgcaggtgagca

SEQ ID NO: 154843 - DNA, 356 bp, Homo sapiens
ccacattgaaccccacgtcggggtcactactcaaggcagtggatggaggcccttcacatttctgggcctcagccacagctgcagtaggtgcccagaggtcagaagtgagatgtaaccagagatcccagacctcccggaccagatcgtgccgcaaacgaaatgccagctcgagctcccacagctctacggaaggcctcccggaactaaagcggaggagggtgtcagcctcatcccgctgccagctggccctcagttcctcaaagacagtgagtgaggacggacctcaggctgtctcttcgggtcacacccggtgtgaaaaggcggcagatacagcaccagggcagacactcaccccc

SEQ ID NO: 154844 - DNA, 433 bp, Homo sapiens
tgtcccatctaataaggaatatcaataaagaaataaaaattattttaaaaaacaaaaaattgtggagttgaaaagaacaataactgaaatgaaaagttcactcaggggcccagcagtaaattggaacagtcagaagaaagaaccagcagacttgaagttatgtcaatagagattatacaacctgaaaaacagagagggaaaaataattaagaaaaatgaatagaagcttgggacatccttaatgagagtaccagaggagatgtgagagagaaagaagcagaaaaaaagttccaagcagaaaaaatgtccaagaaataatagctgaaaagctcccaaatttgctgaaaaatgttaacctacacattcaagaagcccaaaaagctctacacaaagagacacacctagacacacacacctggacacacacacctgg

SEQ ID NO: 154845 - DNA, 564 bp, Homo sapiens
taagtcagttctttcccctctccaagtttagctgttatcatcctaggattggcacatgctaaactgacctggaaagcaaacccatgactgggggagtacacacaataggcaccatgcccaggtttgcttctaacaattataagaaacccaagccagctaaaggagcagtgtgctgatctagggctgtagggcaaaaaccactctggcagccaccctgcccctccatctccctctctgccagacagtgggttgaacacacatgtacacctgaggaggagggtctgacgagggctgcctcagatcagaggcagcaggactagctctgtatgttcgacctcatgtctggcccatcttgagtcccaggctcatacaaaatcacctttgttcagatacagattcaatcagtatttaatgagccaagcactacttgaagcatttgaaaattccttctttcacataagccccacaataacactgcaaggtagttatcaagtccctacgttctagatagaaacaagattccgagaggttaagcgactttccgtatggagctaccgagaacta

SEQ ID NO: 154846 - DNA, 619 bp, Homo sapiens
ctatgtctcgatcgttactcattcaagtgtcctgcccttcaggggaccctattaactatatcctccggctcttaatgaggcacgggggaatttacaacatttaacccaaatactttcatccaaacatatttattcaattattttggcttccatcaaagcaaaaatggcacgggacaaagttaagcagtcaagcaaagactttatcaaggctatggtaataggatagagagaccagaactcagtctgagctccactctgtggaaacaaagggtgagagggtttttaagttctgtggtgagctagaggaaaagtatgggaagatgtggagggaagtcatagaccaatggtgtttgctaatggactttatctgaaagaaaaatacagttctcatatctttatgacgaggaagtagttttgcaactgggagcaaggcattcactgaagttaggctcctaccttctgacacagaaggggaaatgtgctaatatcttccttgatgattacatttcaaagtttgagatataactcttttaaaaagcctcctgccatttttaaaacctaagctccactaaaaaccctatgctccactaaaaggcaaatcagctcctcccctatgcca

SEQ ID NO: 154847 - DNA, 561 bp, Homo sapiens
attacttatttagtgtttgtttctcttcaagagagccagagagtttgagcaaacaacataaggcctgtctgtcttgttaaattcacatgcctagcatgtagaaaaggatttgacacatttgaggtgttcagtaaatttatgaaacaaaagaaaacactgtcaagctgggtccaatgtgggtttttcaataaagaaactgcattgtaatccagccacccattttcctttgcttccctgaaagaatcttagccatctgaaaaggaatcattattttagctagcataatcgcgatgcaaaaataattatttcacttattctgtaccccaagtttggaagtcaactacagactctaattgctgcctaaatcccagtagtaaacaaaccagctttgcattttatatgttaccatgaggttctccgggtttgctcctcagagccaaagaaatgttgacacagttgcacaccaagtttcaacatgctgatcatgttaaaatagtgcacaagaaatatttttccactttataaaaagccagactgtttacatgcttaagtggccagaga

SEQ ID NO: 154848 - DNA, 257 bp, Homo sapiens
cagcgtgattccatttgtgatttttcaaaggaagcaatacatcctttcccttgcataggaaatttctggacagatgagcaacaagcaatgaatcatggtaacttgaggaagaggggccagaaggggagatttatactcttcaccttatgcccttctggataatttgaatgtagtcacgaatacatattacatttttaatattgcaaactagttattttcaaaaattaattgtttaataagggatccataaggagttc

SEQ ID NO: 154849 - DNA, 276 bp, Homo sapiens
atcactttcacctttgtttactcctaggcagggacagggttgccctggagccctggcccagccagtgtgttgtggactggcgggttaggctggagagaagtgaagagtgggtggcagtgagaagcctagttgtggttgggacgtgttcttgaggaagatctggatttgaatcccagctctagctttctagttgcatgacgttggataagtgactcagctgaacctcagtcttctcatctgcaaaatgggtagagcaccttgcaaggctgttttgcc

SEQ ID NO: 154850 - DNA, 625 bp, Homo sapiens
agaattttagttgctgatgcagtttctttcattaagtagaaaagtaatgagacccagagacattactgtcacatagttctgtggcacaaccagaatattgatagttccttgacaaaatcacttgagatgcagggtcttgataattagagataactgaggtggcccttttagggaaaagaatataaacaaagccttagggcatatttaggaaatagcaagtagctcactttgattactacagccaaaggtgcatgatgtgggacaatgtaagatcaaactgattttgacaaaatgaaagtttttgaactttaagatccaataatttgcaatttattaattgggtaggtagtgagcgatgactaaaagttcttaagagagtgatatgattggatcagggttttaggacagtgcttctcaaactgtctgtgagggaggaccagtttataaataacttttttccaatctgtttcaaatggacacgtttataaaataaaaatgaatttcaagaaaaatgaagacacaaaatgtaagcctaccttttttattactacattcaacaaacaaaattgctctgtcaaattactgtaaaagtttctaaatacttaaaatttctgtatgtgtcatg

SEQ ID NO: 154851 - DNA, 403 bp, Homo sapiens
aacttcagaaaaggaattccctcacctaaggcaggctaaaaagtcacctaaaaaacaatgacttctatagccttgtctgtagaaaagcctacatttaagtaattgtaactgtaagaaggtttgaatacttgtcacttcaaaaggaataaaagagcctagtaaacagctgtaataaattgagtatttgagaaagatgaacatcatgttatggcagaacaaaacccaacccgtgatcagtttttgaacacatagcaagcaaatcttttacaatcagcaagcaaaggataatctctaaaagaaaacaaaagagcaaatttctccaattatacattttaggattagttgtaagattacagcaagaaagcatatttttataaattttaaaatgattaatgattgattt

SEQ ID NO: 154852 - DNA, 516 bp, Homo sapiens
agctgtcccttgtccatgcccactgcccacgaggccccttagcacaacttccttgccatcattctgaaaaatccaggcacggggcttgtcttgaggtgctctgaaagcttgcagtccccagagtgggtgggttatatagtgaaatgtgagttggcctctccaccaattctatgccatacttggtggcctggggcttgagaaagtgccactcataaacttcatgtatttcttgtcacttctgcctctactccatctcatcaaggtttgagtttattctagggtccaggtggtaaacataccactcaacccgccatcatcctctgcctttttctaggtctgtttcccagccatttcaacttcctccctcctccggggatgaaatagaagcccccaagcagataggcgtatgcaaatactggtgatggaggtagagataggaacagagcaagtgataaaggagggaggtgttcttaatgtaggagcgtctccaccctagctcagcaatctaaggcaagg

SEQ ID NO: 154853 - DNA, 487 bp, Homo sapiens
taacaatgaactacaatatgggaccctggattggatttgggaacagaaaataaggcacattactgggaaatctggtaaaatctaaataagggccagcagtggtggctcacacctataatcccagcaccttggaaggctgaggctggctgatcacctgaggtcaagagtttgagtccagtctggccaacatggtgaaaccccatctctactaaaaaatcaaaattagccgggcgtggtgccgggtgcccgtaatcccagctcatccagaggctgaggcagcagagtcgcttgaacccaggaagtgaagtttgcagtgagctgagatcatgccaccacattccagcctaggaaacaaagacttcgtcaaaaaaaaaaaaaaaaaaaaaaatctaaataaggtctgtagtttacttgacagtattgtactaatgctaatttatgagctttgaccatcataccacagttacgtaagatgttaccattaggg

SEQ ID NO: 154854 - DNA, 283 bp, Homo sapiens
cagggcgagtctatagaggatcccccgaacaggacaagcaagtaaagaagacgtgccaagacaaatgtcacaaaatgaatgacagagttgagagcagtgccctggagttttcaaatggtacagtcggggaggcttgagagtacctagcaaaaagggcatcttgatggtgagggggttctgaagtgggagaggggttggaaagcaaatgatgaagccttgatttcagactcttctctgttactagggccttgggaagccctgttttgctctgagcctcagtttc

SEQ ID NO: 154855 - DNA, 399 bp, Homo sapiens
acagcgttaaatttcccttttcctccaccagatcagagaaggaaaattttacaaattgacttaaatttctcgtcaattcaggtgacgttccctcagattaaaagctgaagatggaatgagagtagctgtgttcaatgctgtgcggcagatgcacacggcgcggctggctgcatgctcctgggcaaacacaactcgttccaggcgccgaatacgccgctcccaccgtgcaggcaaaacagaactaactctcatgtccacatttccttcgcctcacactcatggcctatttttctttcttggagacatgaattcaccttttgtagcatctgctatagcgccttctggaggcaaacaatagcctctaaaataaaaccaggagtaggcttcagtcttgccttg

SEQ ID NO: 154856 - DNA, 570 bp, Homo sapiens
acaagagggaggaaaaggggagaggaggaaccaagaggcctgagtggcagagctgcagtgactcatcaggtctcaggcctgcccttggtaaacctggatggggtgacttcaaagttaattacactacgtgctttcaagatgctgggatgaaagtccttgggaggcataattacttgagaagacattcttcaagggccgtggaggagcccaggttactatctgtaggcatcctttgccccaggtgggcctttcttttgtttgtttttgagatggagtcttgctctgtcacccaggctggagttcagtggcgtaatctcagctgactgcaacctctgcctcctgggttcgaacaattctcctgtctcagccttccaagtagctggaactacaggcgtgtgccaccacgccccgcctaatttttgtatttttagtagagacggggtttcaccatgttgaccaggctggcctctaactcctgacctcaggtgatctgcccgccacggcctcccaaagtgctgggattacagctgtgaggtttgccttcttaaaggggcagtgctcctcccacag

SEQ ID NO: 154857 - DNA, 547 bp, Homo sapiens
aggaggagaagagaccagggacacggtgtggttggctacagaatttatgaataggtaagaaacccgccccctcccactggaacctctctgaaataactatggagacacagcaggaggctagtgcagtaacagatgggagcagaagttactgaaacacactctgtgctaaccagggagttgtgggactggtgcactcacacactgctgggagaaatcagcaccattcactcggaaagctatctggcagtttgtaccaagggtcataaatctgtatttattcctgtttccggagacacatgctgaggaaagaatccaaaaggtggaaaaagcttctaggcatgaagaggtagcatcataacttaagaaactagagccaccgtaaatatccaatgggaaatgtttcattaaatcacccatgttcactttaatgagacagcatgacattttaagagaagagatttcaagactttccagcaacatggaacaatgcacagccccaacatttgagcttaaaaagcaggaatccacattgtttcctcaccaggac

SEQ ID NO: 154858 - DNA, 193 bp, Homo sapiens
tgtgggattacaggtgtgagccaccatgccccactgtttatacattttaaattacatgtttgagtggtccacagatactgcaaaagaaagatggcccacatgcagcagccaattcaggatttcagaggtaaaggtgaggctctaaacatgggttcaggaatcaagtaactctgaaggtgagatcgtaaaggaa

SEQ ID NO: 154859 - DNA, 491 bp, Homo sapiens
tgatccagctatcaccgggcgtcgtttacactgagcagaacagttacaagccaggaaactgtgaatcactgctcgaaatattacaacgaggaacgagcgtgttgggaaggtcactgtgaacagtctcttttcaaagcactctgccttgtgcatttcccacaccccacaaccttctagaaatgccaaagctccaggcaggccacccttcctgtgtgtcctggccacttacctgcacacctgtcctcttgagactgactcagatcctccagaaccttcaaaatggcctgctgctccagcccctatcagctctccttcccctgtgacccttttgtggaaaggagtgcttccctcctgatttcatatttgtgaatctttactcttccctgctgaggtgacagaaagaatcagaatgtctcgagtgcctgtgctgtgtcatcacccacagtggggagagacaggcaggaaaacaagctccgacatccccggtagcc

SEQ ID NO: 154860 - DNA, 180 bp, Homo sapiens
aaagaattaaaatgccacttatcttgcactgctacttactgctactgagctggtcatcctactgaattaattaggttatacattgaactatcttttgagattattacatttcaggccatttattgtctgaaacactttaattttctttttgtacaagagagggcactctagtcctttatt

SEQ ID NO: 154861 - DNA, 198 bp, Homo sapiens
aatttatgcctcttcattttatccaatccctaccactcctctttcaaggccaaactccattcttttctcctccgtatggccttttctgaccacttttctgattgtctgcagagatctttccctaacagaatagatccactggtaagctaacaataacaagttgccttaaaccatctcttgcactattccatcctctga

SEQ ID NO: 154862 - DNA, 607 bp, Homo sapiens
aacagtgccttggacatcatctggcatgtctgtcaatgtcaagatgttaggtagacaaaaatgaaacaattacaagtagagaggtttcataagcataaatccgatgtgagatccagttatgacgtctaaaatgttactgattgatgtctataatgacagtcttgccaaaaaagtaaaagaataagagtgaaccaggagagaaatgtcaagggtgaaggagaagctcaggtatctgaataccaacagtctgagctcatggaagtaagtaaaaattgcttagggcagaaataactgcctcaaccctcagggcattcatagtccctatgcaggtcacctctgacctcaaacagcttccttcattttctgtagtgtatatgacaaatactatcatttttttgtgtcatgacatgaaaaaggttggcaagccctcgctagggtctttaaatgtgaagaaaacaggagattaagggtaaacctttagaagccaaatctatagttttagtaggaaatatagactgatagatccttcaaaggaaacaaaaaggtaggaggaaaaccagaaaaagaatatatcctatacacaaagattgggagagcaggtctggtg

SEQ ID NO: 154863 - DNA, 146 bp, Homo sapiens
tgatccagagtaagataactaacttctccgaatctctgtgctttcatctggagaaatagagaaatcaatatcaatatatcaggattatagagcaagattgcatgtgtaagcccctaaagcaggattgtgcccagtcagccctcagt

SEQ ID NO: 154864 - DNA, 367 bp, Homo sapiens
ctcactggaagtggcgggacagcgtagtctggctcaaaagcacagtcgctttctgtggagatgccacctgttagaaggggatggaacaaaagagctggtgagaaaagatcctgccttccctattaaaatacatcttataggataatccagaacaacaaatattttcactgtgaaaaatcaaagtattttcactacatgcattcatttctacacttactatgtactcaattccaggtctagcactacgaaactgaagatgagtaaactaaggttccttcttataaggtgttcactatctcatgagagatgcaatcatataaggaaatacaagaaaataatttccacataagttgtataaagaaatgat

SEQ ID NO: 154865 - DNA, 279 bp, Homo sapiens
cagtgttgtatttatatccttgaattaacaagtgcaacccaaattaatatttcagtgattttttttcctgtcctcataagaacaaagatcaatagcttgttgagctgttacttatcctgacacaggctttaaatgcatgaagtctcagaaccaactctactccatatccaaccatggttaagaaagccaggggagggaggacacagttccagtgttgtattttttatccttgaattaacaagtgccaacccaaattaatatttcagtgattttttttcc

SEQ ID NO: 154866 - DNA, 607 bp, Homo sapiens
atatatgcaaaaaccctccttcaacagattctccagagagggaaaccttgcactctctcaagaatcccatcagcttcactggacgagttacttgattactcttgctgaatattaacagcatattggttaatagcatttaaaataaaaatattggtcaaaaagagcatctacttctgtgaaatacatgtaatttcccacaaaatgcctaggcatgccccatggaaataatatgttaccatatgtctcagagagagtatgtcaacagttgaaagaaaaacaaaaaacaaaatttttgaaaggggtaaccaaatgaaagttttggtctttcagaaaaacaaaacaaaataggaaaaatgatcaaaaataaattaaaacaggtgtattaccaccctgatcacaatgaatgagagaaaaagtattgaaaacaaagacatcagcagaatgtgttttcttcgccttacaggatgagcaataacaagttttacatatctgaactgctattactgttatatgtagatatgacagactgtggttctagaattgaacaagttatttgttattgagattaattaaaataggatgccatgatccctttcaaacaaaaatt

SEQ ID NO: 154867 - DNA, 561 bp, Homo sapiens
cctcccagcctggtcaaaagtactaaaactattaaaaagattgaattacctacaaactttgatcttttaaaagcaagagaatgtaaattaatggagaagagtgttctgtagttaacgtaaaaagaaagaaactgacactgtggcatgggcaagatagcagaggattgaagacccggtttttgccttttttccccccttttcctgaggacttaaactttattttggaaaaagtggcaggtttgtttttgttaaatggttgaaaagtgtttgtatgttacttctcagatattactcagtataaattatttcttaaaaccatatgaagttgtttaggtaagaatgctcttagtaattactatacctaagtcagcctgtattttgtcagatattttttaagaaatgatccagatcaaatcaactattttgaggaatgtgaatatatatccagttacaactaggaaagaatgttaagaatataagctgtgttaagaaacaggaaaattctcttgttatatcatgctgctgccaatctgtagtttctgtgactcaggaacagaagta

SEQ ID NO: 154868 - DNA, 371 bp, Homo sapiens
agtaatacgcacacaccccatcacaaaaacaaacaaaaaacactgaagttctgcttttgtcaagtccttactcaatatttatgccctccattcctcacctctaattccctacacacacacacacacacgcacacattcccacacacacacgcttctacaaagaacacttagaaaaacagtattccaactacaagcccacttctctcatccactgacctcttctgaaaacacaaaagattttttaagctatcagtaacacgtccaaacacaagctgataagtttgagctagaatttacatatatacagttgctacacaccctcctattttctgcaagtctgtggaaggaggctgggaaagaactaagtgcaa

SEQ ID NO: 154869 - DNA, 871 bp, Homo sapiens
caagctagattaaaagcatttatagcatatgttacaggtaaaagcttactattaatataatatctattattgtaatgcatagaaaaagatccgtggatacaggtcatgttgttaacagcactgggtattttcagagactgatggggaaggatggtcaaaagaattggctttatttgtatgttttaagtttttacaatgagagtattaatgtattatgtgtctattaaaaaataaattttgatctatccatcctgttgaatattatgtagaattgaatgtggtatttctgatgggtattatcttagaagaaggtttagacaatgtaaaatacatatgggtatatatacgtttatataatatgtaaaaataggctgtgagaatgtacttcagtggctgatatggttatcttggagatcgtactgtgagtgaggtaataaagaatgactgtcatgttttgctcttcataattgtacattatttgaagcctttgcttttaaattatttgtacagtaaaaataaaaacataggggaaaaaaggctgaaatgggggaaatctgagctctcacatataaagatcctatagaaccacactatcccatacagtagcctttaatatgtggttaatcagcacttgaaatgtggctagttctatattgagaagtactctaagtgtataataagtgtaaaagctggagtttgaagacagtacaaaaatgtaaaatgtcataagaatttttatactgatcatatgttgaggtgataatatttagatatgaactaattaaaatatattaatacagattttacccgtttatttttactttttatttatttttttgaaatgtagtctcactctattatccaggctgga

SEQ ID NO: 154870 - DNA, 483 bp, Homo sapiens
ttttaatctccgcgtcagaggtgactagtgataaattttcttcattttgtataatctcaaaagaatgaggtcagcatttcagtattccatatgtgaactgagactatcaagaaactatattatccccagaagcaccatatagtaagtaaatcaccaccaccaccccactgtagaaataatttaaacaaaagaaagtttgtgtttctttaaatcttaagtatagacaatttaaagataaataaaaaacaagtgtatatgtatttatataatgaatatacaaacaactatcttaatgtgttttgggttttgaatttatggatgtagtttctttgcttgcattccaaaatgttataaactaactaagatgtatagcttatcggtgcctgtcccccatccttgagtgaattagatgtctaaggaatttcgtaaactttaatctccaaagatctccaaaacctcagtaggcaaggtggcaaaaaaaaa

SEQ ID NO: 154871 - DNA, 225 bp, Homo sapiens
tatcaccggccactctaaatgaattatgtgtttaaatgttcagattttatagtctatttaatcctgtaaatcttaataataaatttgatggcaagcagactgtgagtggaattttagataacaacatatgttcatagtgattcatgaaaatgtaatcctttatggtaaatctgtattatttataccaaatctttctctctggactagagccgcttttttaaattc

SEQ ID NO: 154872 - DNA, 680 bp, Homo sapiens
  misc_feature (161)..(161): n is a, c, g, or t
actctagagtatcccctgggaggtgcaagtgcacatagctttgccttattcttcttaactgtgtaatattatacagtgtacatgtactgtaatttacacaggactttgaaattcacttaaaatttgtgtcagtgtgaggtgaagatgaaaatggatttcgnctctcccaaatagcaaccctctcctgtgtgctggggggatattttctttttttttcccttttctttttcattttttgaaacaaggttttgctctgttgccccagctggagtgcagtggtgcaatcttggttcactgcagcctcgaactccagggctcaatcgatcctcccatctcagcctcctgagtagctgggactacaggcacattcctcaagcctggctcattttttgtagagacagggtttcaccatgttgcctgggctggtcttgaactcctgggctcaagcaatttgctccctttggcctcctaaagtgctgggattactggcatgagccactgcacccggcccggatgtttttatagtttgctttttaagataatgcagtggacaacacaatttagaaataaggagagcaaaatctgtataccacatgggaagtatcatttttttcctgttttacacctgggcaggtaaggtgtaaagtgggaagtgggaggtcaaggggtcgcccaggcta

SEQ ID NO: 154873 - DNA, 542 bp, Homo sapiens
agtcagccttgggatgatgtctgccccctgccatgtccccaccagggtggtgcctggggcatgggagtgcccaatctttactagctgggtgaataaattccaggctacactgactcacctcacaacatgtttgctgtaggtacacggcagcactgtggcagcagctatcgtggggcaaataggagtcctgggcccagagtctgctccaaggaagaaataagtttccaaggcgttcctatttgcccccaactcaggagatcaaagggaagagatattgcccctaaacacagttctccttctcttaaccatgtaagtagtccagttaagagtaacagatatttgaggttggatgattactattttatttttatttttatttttttgagacagggtctcactttgtcacccaggctggagtgctgtggcgcaaacatagctcactgaggcctcaacctccagggctcaattaatcctccctcctcagcttccctagtagccagggctacaggtgtgcaccaccatacctggctgtgtttctctac

SEQ ID NO: 154874 - DNA, 301 bp, Homo sapiens
ttctttgtctcttccagtattcttatgctaagaaaatatttcttctatttaagatacagtagctgttcccttgtattttctcataggggttctttgttttattttgtttgatatttaactcttaaattcacctgcgttttattttcttatgtattatgagataaggctttaatttgatctttttttccagaatgaaacaaattgctcaacagcagttattaaacaatcttttctgtttctaatgatgatgctatattttattatatactgtttcatcatttttattgtgtaggaatttttt

SEQ ID NO: 154875 - DNA, 236 bp, Homo sapiens
gacggagcattctaagcagggttctaggaggtccagagctagaaaaggggttggcctactggaaaacagaaaggagggcagtgtggtgaatgtgaatgagggttagcaggatgtggcgggggaggcagcaccagtgggctacagacttgacactcagcaggacagacgcccttgacgggtgctatgtggcattcagtgaggtcacaggaatgaaagatcactgggcactggatgag

SEQ ID NO: 154876 - DNA, 698 bp, Homo sapiens
ctgcctcccgggttcatgccattctcctgcctcagcctcccgagttgctgggacttcaggtgcccgccaccacgcctggctaattttttgtatttttagtagagatgaggtttcaccatgttagccaggatggtctcgatctcctgaccttgtgatctgcccgcctcagcctcccaaagtgctgggattacaggcatgagccaccacgcctggcctggcctggtagtttttataacagatgttagatagcaatactcttcataactctgtacaaggcaatcaggcaaaaccaaaggccaagtaaaatgtaattggttaagctaattgtagctgatgaaacctttacgttttgtgaaagaggagatgtgcatcagcagctgtaagtgagcactctaagatgcagtgagtaaaaggtgttgggagatgagcaactaaaatataacctcttagttataaattgcagaacgaagaattttactcagagtacaaactagtggaaaaagtctttcgtatactgggtttttcagagttcttaggcaagattatatagtttgatttaaagacccaaaaatgtacttcctggggtgcaggaatgtcaggtttctgttaggtggaacatgctcctcatggcacagaattggctacatgaagttaacctacaggccaggtggtaatcggcaggatgggtcggccggagg

SEQ ID NO: 154877 - DNA, 656 bp, Homo sapiens
gtcccagctactcggccgggcggggggctgaggcaggagaatggcatgaacccaggaggcggagcttgcagtgagccgagatctcaccactgcagtccagcctgcgcgacagagcaagactccgtaaggaagaaaggagatagcactgccatccagagaaatgggaccttggctgacagaaaacgcacagccaacactcaacattccaataagacacagcagtgacaaaaggggagtcttacgctggaagaaatttcaacaacggcagcagtttccatcagtaagcacactctgatctctatatgacgatttgcacgctacatcactcaaattcggtcaacaattgctttacatttggagaaaaaaatgtatcagtaggaaccaggacaaaacatgggaaatccgactgggagcggtggcttacgcttgtaatctcagcactttgggaggcagatcacgaggtcaggagatcgacaccacagtgaaaccctgtctctactaaaaatacaaaaaattagccgggcatggtggcgggcgcctgtagtcccagctactcggagaggctgaggcaggagaatggcgtgaacccgggaggcggagcttgcagtgagccgagatcacaccactgcactccagcctgggcaacagagcgagac

SEQ ID NO: 154878 - DNA, 402 bp, Homo sapiens
gaaagactgtgtgcgcatggagagcaacaggcctagttcaggagacaatttggatatgaagtgataaaggtcagaataggggtacggatagtggtaatgcaagaagattaaacaagataggatagctaacaaaatatgagcaacctgtgaagaatctacgaattctggcctagctacacctgacaacttggtactatctttaatccaaaaaagcaaataaggagcagtgtaagtgtggaggtggtttagtacaaacatgctgagttattaactagaaatgttctccaaggtagctaaagtggagtgaggagaggccaaggctatttggagagataaaggattcatctacaaagaatgaaatctgaagtcacatcaactgagaaaagaacacttctctgaatt

SEQ ID NO: 154879 - DNA, 474 bp, Homo sapiens
tgccttccaggccatgccacctccagctctttcatggcctctcatctccccaatctctcaatgttggggtgccccaagaccctgtctttgtctatattctgggtgatctcaaccagtttccaagggcagacaccaaccccaggctgaagactctgacttgacctccataccagacctcaatcctcaattctagactcttgcacacaccctcctgctctgcactgctgcctgatgtggaatgagcacctcggccaacctacggtggccagcgtccaaggcagcacaacgcttcctgctctgcactgctacctgatgtggaatgagcacctcagccaatctacggtggccagcatccaaggcagcacaatgtcctctgcagtgaatgctgggaggtgttgcaccctccgcaacccccaccagggttggtagatatgaccagcagaatatgacagaaggttaacagtgtattactac

SEQ ID NO: 154880 - DNA, 362 bp, Homo sapiens
  misc_feature (351)..(351): n is a, c, g, or t
ctttagacataaggggggctcacactcactgcaaatctctttcccacaggctggtagtaaccacagaaaaagattacgggcaaggcatgagattggagaaagctccccttggtcctggaggcatgcagaaggtgactggtggctgtcagaggagcacacacagccctgctcatagagttacttcactctaggaatgaaggtgtggcgacatatgcagctgctgttttgttccgaatgtctgaggacaagccacaagattacaagaaacggctttcagttgagctgaccagctctcttttcagaacagagccaatggcttggaatgggactgctgatcttggacttgatatngatgccccagg

SEQ ID NO: 154881 - DNA, 255 bp, Homo sapiens
acagaccagggaggaggctataaaaatgtaaggctatgagatactacaccagggtagtgacagatgaaattgaaaagaaggggctgctatgacagataaagaaataaggctcagacttgtctagatgtggcaagagtggaggcagacaaagataacacatgaaaccaaatgttacactgaaggaccaaaacccacttaggatcaatgcttcccttaacaaatgttaggtctctttctttgctccccttttctcaa

SEQ ID NO: 154882 - DNA, 498 bp, Homo sapiens
acccagcatgaggtgaaccatgatgaaggggaagtcagaaaggaaagagattgcaccagtctgaagattgtagtttctcttgtaaagtttacaacaatatgtgatgatgtaatcacattcttagggctcctcccagagtcttagctggatcctgtgctactgaaaacagcatggtactgacataaaaatagacacattgaccaatggaacaggacagagagcacagaaataaacccatgcatttatagtcaactgattttcaacaaaggtgccaagaacacccaatggaaaaaggatagtctcttcaataaatgacgttgagaaaactggacactcatatgcagaaaaatgaaattggacccttgtcttacaccacatacaaaaatcaactcagaatggattaaagacttaaacataagacctgaaactataaagctactggaaggaaacataagggaaaagctccatcacattgatctgggcaatgatttattggat

SEQ ID NO: 154883 - DNA, 275 bp, Homo sapiens
tttccccagaagcctgtgtgaagagcagctggtactgtggtcatggtggagatatagaagtatgagaggggtacttcctgctcccaagaggagcagtctggtggtcaaggcaaggcacacatggtagtaggctagaggtatcagagaaaatttcccatgggagatggaacctgacctaggctaggaacgttgtgggggatttaaattaagtagagaggaaggaatgggactttgatgtagagcaggggtcatcaaattttttctgtaaagaacta

SEQ ID NO: 154884 - DNA, 237 bp, Homo sapiens
agtgagtaagaagaggggagaaggatggcacagttagcaaatagcaatgtctgttatacaccctcttcaaggttccttgtgagcggtcaaccttaccagacagaacaatcttccaaggtagacgagggctgtcttttaggcaaggagttcaagtgtctataattctcactctttttgcttaggatcttctgactaatgaaacacattcatttagtttatatttttatttgcataggg

SEQ ID NO: 154885 - DNA, 481 bp, Homo sapiens
  misc_feature (28)..(28): n is a, c, g, or t
tagatcgagctctgtaccccaagggtcnttaagccccaaaggtcctctaagatactctgcaaaatgggaattaaaggatgagagaagggctcaatgataggaagcagtataacggagcgagttggaacataagctatggtgttatgtggagctgggttcaaatcctggctctaccactgaacttctatgtgtctaatatttagctcttagcagattatcaggcacatggaagaaggaaaagagaaaaataggttatcatgtttatcatcattaacagcaataagaaataagttcttggcattctgccttgactggaatttgttataagcccacactggacctgacgttggaattctgtaacccaaggatagactgattgtaataaaatttttaccttccgactttttatccactacaatgtactgccctagatttttcttgcttttaatcagtgagttcttaggcttaagggacccttggc

SEQ ID NO: 154886 - DNA, 386 bp, Homo sapiens
gggtcgggggctccctgtttctagccctgccctgctccctgctttctttgctggctccagggcctggctgtctctgcagctgtaggactgaccgtccccacctccatggcagcctcctaccagaccttaggacggagcttcatgatctggtggtcacctgcccctccctgtcctcctcctcttccccaaactttgttgatgcctcaccttggctttgactccattctcacagcatattgtttttggcaaccgttattgacatacaattcacataccatgccacctgcctctttaaagcacacaggtcagtcatttttaacatgttcacagagttgtacagtcaccaccagtcaattttaggacattttcatcacctcagaaagaaa

SEQ ID NO: 154887 - DNA, 178 bp, Homo sapiens
tctctctgcctctacctgaacatcctgctccagatccttttccccacccccctcacatctccagctggcctgctcggtgctgtcacgcgggcactgtgagcctgcagagtccagggggttcctggaggtcagggctcctgtttacctatgcatctggtaagacgggacatgtgactag

SEQ ID NO: 154888 - DNA, 260 bp, Homo sapiens
ccatctctagctctctgctggtcaattagtctatcaactaacacatatttatctcaacatctgagacacataaggagtatcttcattccagatcactgatagtaacctgagaaggaaagaacgacctacaattaacggttcaaactctagcatacaaagttaaaatactgattaaggccagacgtggcagctcccgtgtgtaatcccagaattttgggaggccgaggtagacggatcatttgaggtcaggagtttgagac

SEQ ID NO: 154889 - DNA, 371 bp, Homo sapiens
taaatattaaatgcaattgtgatgttataactactaagaagtaatttaattttctgaatacatatctgaggaatcctacccccaacccccaacctctgcgccaggctaaataagcgaggtaaacactcatgacacaaggctatgcagcattcacacttgaggtcaaaaattccaaaaataaatccataacaacaggtgttatcctaaaagcactgagatgttccccgtgaaagaccaacaattttggatttttaagaaaataaagtagaaatgctctatccaaacacattttttaaaactcaccttgggtcatttcacaaatatttatttcttagcaatccattttcctttgcttataaattcctgtttca

SEQ ID NO: 154890 - DNA, 384 bp, Homo sapiens
gctcttgggttgaagggtaaataattcctttaacttttgatgatgataatgataatgatgatgatgatgacaatatgtgccccgcttcatcagccagaccaaaggtccagaggacagctgttacatagtgcacttcaggaccccctccacacctaacagaatagatcccaaggttgaatagatcctgtgtctttgataggagactgggagctccttgaaggcaggagataggcatttatgagtatgcacctgtctccagaactaagcactctccttggctagaatagacaggtgtctaccaattggtgaataaaaaacacaaagggtttggaatgaacatctactgtgatttaattttgacatggtcagtgaggctgcctagag

SEQ ID NO: 154891 - DNA, 593 bp, Homo sapiens
gcacgatgggggtgcttggcagcaccctcgcctctccccgctagatgacaggagcactgccccaccagtcaggacaatcaaaaaggtctccggaagttgccaaatgtcccctgggggcaaaatcacccccagttgagaaccactatcctagaaataagtcaacaaataaccaaccacaggcggcttgggctggggactcacgtgcaaccatgaagaggattcatgctgcttgtgaggatgggggaggccagacccagatagttatgaaacactggtaggaatgctgccatggaggtactgctggggctccaaggagaacacataagaagggcaacaaagccaagaggggcacagggaaagagaagagttaagtgtcagaaaaggtctgtttctggctgggtgggtgtaatcccagcactttggaaggctaaggcaggcagatcacttgaggccaggagtttgaaagcagcctggccaacatggcgaagctctgtctctactaaaaatacaaaaattagcccggtgtggtggcacacacctgtagtcccagctattgggcaagctgaggcaggagaatggctttagaccctggg

SEQ ID NO: 154892 - DNA, 837 bp, Homo sapiens
atatcatgtttatgaatacaaagattcaatgtcatccagattctgaatctcttaatagtgatctataaatgctatgcaattccaacccgtcctaacagttttttaaaggaatttagtaagttgattttaaaatctgtatgaaatataaatgggccaagagtatttaaaatctctcaaaaaaatattgtatgaaacttatcttaaaatatactaagatttagaacaaatttataataagtagcttagcgtggcactggcataggcccacataaatagatcaatggacttaacagagaccccagaataataccatgcatattcaatataaaaaattcaatatacaaaagagatggcattctagtcagtaaagagggacttttcagtaaataatgctgggaaaattgatttatatattttttcgtgaaaatggatgcctactcactacacatatacacaataaacaggtggattaaataggaaaactctaaaatgtttagaagacaacacagaatatttttgtaacctcaggttagagaataagatctttaaaagactcaaagagcttagacctaaagggggagaactcagaaattcaactgcattaagaaatagtatttacaaaaagaaatcattaaggaaattaaaatgcaaggcacaaagtaagaggatatatatgctacatacatgactaataatgaacttttatctggaacacataaagaactcctaaaaatgaatacaaaagacctgaatgtcttctccctgccaagatgtagtaacagggtctagatttactctctcacctaaaacaattgaaaaccaaacaaaatataggac

SEQ ID NO: 154893 - DNA, 305 bp, Homo sapiens
tctactggcctggtcgctgcttgtgagacctggagcagtaggacctgatgcattgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgagg

SEQ ID NO: 154894 - DNA, 663 bp, Homo sapiens
tgcagtttcggtgatctagaggatccctatgaattctgaagtccagctgcatagagaacggtcacatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcaggagagtctccgtcgaactagttcgacggagactctctcgtgactttcaactttcttctcagaaccaggcaaatgtcctaaataaaagtcggccctgtgtcccctgtcctctcactggcttcattttgtagaacacattacatcattccagttacagttcacatcctcatttcaaaagcactttaccttgccctacaatgctccagtttccttaagtgacctgtactcttttcaattagccagttatctaagtctagctgataacagtgtagaaatcccactcatctgttcccctaccctgcagtgtgattcttcatggatgtggtgtcaaaacagaa

SEQ ID NO: 154895 - DNA, 183 bp, Homo sapiens
cgctccggagccatgcctgtacccacccccttcctcagactccactcccgcaggtgccctaggggaaactctacaaccagcaccatggccggaccccatttctcctggaacccctgagccatagctataaccagccccgcttttagagcttatttccctagaatatcctaagccaccctcgta

SEQ ID NO: 154896 - DNA, 170 bp, Homo sapiens
actgaggcccaaagagatgaggcgaattgccaaaattcaaatagcaaaacaggtctctcaaactcagccctcttaactgcaaatccaacgctctttggcagataatgcatgtgaagagacgaggatacggtgagctggagggaattttaaagtgaatccatagaaaggat

SEQ ID NO: 154897 - DNA, 522 bp, Homo sapiens
ttaaatgtgatgtcaatggtagtgttaagaattaactataactaatacatggatggatctatgccatttatgacagaatgtaagaaactgatgaagctaagtattgcctcagatgcaagagaacagttcagagaaaggagctaggaaatacagtactgtaccttcttctgaatgtttgggaagggctcatggagcaatggagtttccagaagtcatttaatggagagacagggagatttggaagtcttgggagagtattggaagcataaggggtggactgtgaagtcagaatcctagagtaagggcaagtcggtggccgctgggtgaggcatgggtgaaagacctccagggtggaagcctgggggactgggaggaatttttcagtaaaccattcgaaatacaagcaggacctaggctctagtgtacctcttgggtagagggaacaaatatgaacagcaccacagagaagagatacccagactttggtaagttactgcatttgaaggccggaagaacagagtg

SEQ ID NO: 154898 - DNA, 405 bp, Homo sapiens
gcaaataatgcatatacaacactcaatattttagtatgtcctgcactcacgattttaaccctaataggaaggacaactggaattctttctccttagcatccacgaaccccatatgttataggacaaacagatggccagaccctggcctgtgcctccaaacacagaccttttcaaggtctaatgcttccagagaagtcttcacactggctctgagacccacacttgtaatccatacaaccaagcagcccgatcctctaaacactcaaccatctcgtcctcagtggcatatggttacctaaaataaacctgagaagcaaacacaacttctccgggtgactttcctatgataaggtgaacagaactgtatgacattcaaagagaactgatgaagcggcagcagtgcag

SEQ ID NO: 154899 - DNA, 567 bp, Homo sapiens
  misc_feature (251)..(251): n is a, c, g, or t
ggagtgcagtggagaatggtatagcttatatggaaaacagtggaagatggggtttcactatgttggccaggctggtcttgaacgcctgacctcgggtgacccgtttgcctttgcctcccaaagtgctgggatgacagacatgagccaccgcacccgggcgcaccctttgatcttgagatggctgatacggcagagcagcccagcagtggatgagtgcttacatttaaaaagttcatgggatttcatagatnagctcatgaatgtacaagtccccggtgtaaaggttcctcgactatgaatttttttatcctttctttgttcgtggggtgtatgatgcataggacatttatagatggaatatacctttcaggctatttcttcctctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacag

SEQ ID NO: 154900 - DNA, 309 bp, Homo sapiens
tacttctttttaactccttttgctagatttttaaaatgtccttctcttaaattttataatcaaatctaagatttttacagtgatctgtctccaaaccctaccgccttcttccttctgtgtgataccataaaaacatcatttgttatctctaaagtcccatccttaatccttcttcctgatcatttttatattgtaaaaacaaaataggccattctgtcttaatgtgtgttttatatatctctatgttcccttgtttttgtctgtgcacaattttgttcttcttccagagattcacttatgactacggcc

SEQ ID NO: 154901 - DNA, 658 bp, Homo sapiens
ttcatagacattatgtatactttcttaagttttctgtacttgtgttatattaaataatataaatgtttttaaaattccataaatggaattaatagcagattagacatagctgaagagagaattgctaaattgaggcagaaagtgttcaagctgcaacgtggagaaaataggatttaagatgcagaaaaacagcagaagacatacttggagcagtaataaaaatgccaatatatgtgtatggttggagcctcagaagggaataagagagagaagcaatattgaaagaattcatggcgtaagatttttcaaaattgacaaaagacatcaagcttcaagttcaagaagtactacagcacccaagaagggtaaatgcaaagtaaaccacacaaaaggcacatgattgtaaaataaagacaattaagaaaatcttaaagcgaaggaataatagacacattatcttaaaatgagtaaaaataagacagttgattttccaactgaaatgatgggagagagtggattaacacttttaaaataatgaaataaataacagcaaacctgtaattctatatccagtgaaaatattatttaaaggtaaaagttaagacatacttacataaatgttttcagagaaagatgctgtttgtttacccctgccaaa

SEQ ID NO: 154902 - DNA, 345 bp, Homo sapiens
ggagggtggagtgatggaaagaacacaggagttgggctgcccaggttcaagacctgatcctgtttcttcttagctgggtaactcttggcaagtcacattttgtcttagaacctcttagtaccttcatctgtaaaaagaatagtcgtgtgtatctcagagggtcattgtgaagaccagctgagatagcgtcatggctaaggagagtgctttgtagtcatgaaggtatcattagtaatatggtatcaactattcttcattgctacttattagattctaggcactattctaagatttcacatcaggacttttcaacagcagcactatgacattttttctagataattc

SEQ ID NO: 154903 - DNA, 459 bp, Homo sapiens
ttcatattacgtttttgagatagctgtttatttttttgagggggaaatagtgacataaataggtttagaacctcaggtggcttaaaaccccagatgtagtcagtggtaaattttttttttcttggttagtctagttttggtgttggtaagtattatatatgctggtgggtttttaaaaagggcacgtggtagagtctggcatactatttggagtcttgtggtagctgcccacttcctgctaatgcagtagagcatgttcataatggccttatatgctttccttcctagggcaggccgtacttagtcataccaggtaagaaatatgttttaaaattttagttaaacagttatgatgatagcttatagtttactttgcatttctttatttatagaaagattacattttctacacagtgatttactgttgttatttcctactttgttaactcattaactcca

SEQ ID NO: 154904 - DNA, 736 bp, Homo sapiens
tgcagcaggctccttccacccccacacttggtggcatagtttcaatggcacactgaaaatggccctggggcccccttccagcgggtggcttttggagctgtaggaagaggggacagagttcctcagatggctttcagtcaggccatccctgtggtgtctcactggacattttactaagtgcttctaaatctgcagactaatgtttacaaaggagagacatttttatgagaactggaaaatgatcccaagcaatgtttaaagatattttataatttatatagaataatcagctcttcatccagctcccatttttctttcctgttagaatctgtacagaaaaattcaaaaggaatttcttcactttattgagagaaatggaagagcagctggagttaggtaggaagggccagggtgccgttgccatctgtcttcagagaggggacagcgaggcttctgagtgcctgcacttattaattagcgactgcttttggagagttgctggcttgctgctgttactctcaggcacctacaactgtctgagtctcctgcatgttggtcctgtgtctttaagagaactaagttgctttacccatgaaggcagctgtaaaatggtggaaaagtcgttaacttgactcaaagccctggttttgagtcctactgaaactactttttctctgtgtgacattgagaaaatcacttcgcctcagcttccccatttgtaaaatttcaatgataa

SEQ ID NO: 154905 - DNA, 170 bp, Homo sapiens
ttcccagctgaggtggggcctgatgtcttgtttcagctcaaattgcaaagcagtgtcgtttttgcaatctgtttagtgccacatttttcacatctttgtgagtctttttttttttttttttgagacggagtctagctctgtcaccaaggctgaagtgcaagtggtgcgat

SEQ ID NO: 154906 - DNA, 275 bp, Homo sapiens
gccttccttaagagccacgtgacacagcacacaccacctactgtgtgtgctacaagaatcaacaccttctgtgagagcagcaacagcctggacaaaagttaagccacttttcattaaaaggttattcctcaggctgggtgtggtggctcacgcctgtaatcctagcactttgggaggccaaggcgggtgcatcacaaggtcaagagattgagaccatcctggccaacatggtgaaaccccgtctctactaaaattacaaaaattagctgggcatg

SEQ ID NO: 154907 - DNA, 678 bp, Homo sapiens
ccattttgttaatgggttttactttttaattttgcttcctaatttatttatttctgcttttaattttatgcctttgttcacctttatttggtttgtctgctcattttaacacttccaacttaaatattttatttagtttgtttcttgttttctattagatgcatttacaacataaatttttctttgactgtcagtttggccatatcctgtaggctataattttattgtcattcatttctaaatagtctgtaatttttatttctttttactacagttatttggaagagcattttaatttgcagatagtgggatttttagatggttggctggtttgtttttggctttctatctgcctctaacttctcatttttatgcatcatgatgagagtatatttctattttccaggtttgagtttttcctcaatgccttgaaaaagttatttttcaaaagttacaggcacaaatgtttgcctgaatctcaactttgaagtcaagcagcccacagtaaattattacgtgaatacctgagatacaggggttgcttttgttgttgttgtttaaacacctaaaccctggagtttaatgccatctcattatttaaggcctgtggataggagaaataaaacttctgcttgtcagggctttttgtcctttttgtgtaaggatagggatggtgta

SEQ ID NO: 154908 - DNA, 641 bp, Homo sapiens
atcccacatctcttttctcttattctagtaacagcatcccactttcctttggggaactgtccctacccaactggtggactgcccatcaaaggtcaacatctccctttgagggaggacatgtgacccaagctcacccatcaaaatactgctaccctcctagacaaagtgattggcccacatgtggggatacgaccccagtcaacgatcaggagtctttttcaggtgttaatttcaatactggataagaaaggtactaagcagcatatgaactttgctgcttactagaaagcaccttctgagggaaaaggagaaacagctgacattagcactacctctggcttttcagctggacaggcccacaatcatttttttgaaactcttggatttaaatatgtttcagaactcagaattattcaggtgagaatagcacaatgaggcacatacttgagtatattacatacacctctgtctggatcaaggacaacatcactgcaatcaaattcaattcatatttctgcaatgaaacaaactaagggcctaattaatgtcagtttaggtcagggtaggttttgccatgaagaaagtgcagatcaggtaaggtctgattacaaaaagtgttcagctgttttcagaaaggcata

SEQ ID NO: 154909 - DNA, 296 bp, Homo sapiens
gagaataatttctttttattgtcatgacctggaagtgaattttttactctttgtttctcatctttatttcaattgtagcttccataaccttcaacctgaatatttaattaaaccaaaagatagttgaggtatgaggaatttatttacaaataggaatctattgtgaatcatatcttaatagcttggcatcacacatctaatcatacaaactttttttcaggaaagggagatatgaaaaagtacagactagatgaaggactctttcattctttttttttttttttttttttttgaga

SEQ ID NO: 154910 - DNA, 419 bp, Homo sapiens
gagaggggcaggatggtggaactgggaggaaagtccagcccagccaaggggggctctgagagtcagaggggctcccaccattcctggccatgggaagaccctactctcggtcttgtggctcttcaatagcccccaggctcctggagtgtacccaggatagcttttctagtttttagtcctgtgtgagaagctgtgagttacaccagtaaccatctctctctgccccctacctcctctggcctttcttccctttctctctttctctcccctccctcctcctctccctgtctcctttggtctctctctgtctctcttctgttggtcactctcccgccctctgtctctttctgtgactctgtttccccatctctactccttgctgctccctctgcctccttctgcctctttgtctccccctg

SEQ ID NO: 154911 - DNA, 554 bp, Homo sapiens
cctgtgagagaggctggcatccagggcgggaaacctcttttgagggcgtgaaccaggatgtgaagcagcatttgaattcttgctgctctcttctggagcagtgggatattgggcagttcacttaacctctctgagctcctttctcaagcctttttttcctgactacagcgagcaacagctgtttgagatggtggagcacattcttgctggtgaaaggaagcaaggtcaacagagactcatagaggaaacattcaacaacttgaacagtaagcaagttgcagtttccgtctcagtggactgaggtgatacagcagattttgctgtggaccaagatccagttttcctcataacactcacaggtattaaatgactaatccagatccccagcaccacatcaaggtaggtgacagaagattaacaagttcctaacttttctttaagtgtcatttgttgcaacgttctgaaactgattaatatcccctccccctcttgccctgaaatgaatctggtggtattaaattaaataaaatagttccagtttgtccataaaaaaa

SEQ ID NO: 154912 - DNA, 513 bp, Homo sapiens
agtatagtgattataacaatgatgatgattctgtggtgcccagtgttttgatgtgttgagatgactagatgtatggcattgtgggtaagtagtgagacatcaggttaacttgaatcttgacaggccatcaggactatcatctatgttggaagaaccaacttgtgattatagatgtggactcatttgaggaggctatgtaatactaatgttaggatctgtttggcttgagggctgaagatctgtaaccattgaatgttccatcttctttgcagatgcttagttataggaagctagttcttcttttcctttgcttcattaaaaaaaaaatcttgtggtgcttataggcatgttatttctcaggtggattgaaagctttgttccactgtaggatctttgaggatcgtacctctttttcacctttgcctactgaaaaaaccattgaatgttccgtcttatttgcagatgcttagctataggaagctagttcttcttttcctttgcttcattaaaaaa

SEQ ID NO: 154913 - DNA, 1274 bp, Homo sapiens
agacataggaaggaggagacgttcatttttactcctggtgttcgaatacaaccaatagatgaaacagtcactttattctctgtagctgcagattcctaatttatggcatgattacatgattccttgtctgtagaatgatcagcgatcatgctgaagttgatagactttgaggtcccctttgacccgaaagactgggacagcagatttcagttcaatatgaaaaaggattttctagctggcagatctgtccaacagaagaaatgtctgcccaggaagtagtgagcttacggctgttggcggtattcaagtagggctgaatgctgttgattagggatgcggtagaagagaaggacaggaattaggccgacctccaaagtctcttccaatttagagggtcagttatttaatatatgacttgtcaaagccgaaagacacatagaataggggctttaccttcagtggcaagtatttgagtcaatatcatcaagtgtgttctttaaaaatgtttataaataggtcccagcatttttgagagacccttctgggatcattttagaaaggatgaacaaaacaaaacaaaaaacaggtgaggtgcattgactcacgcctgtaatctcagcactttgagagactgaggtgggtggattgcttgagcccaggaattcaagactggcttgggcaacagagagagaacttgtctatgcaaaaaatagaaaaattaaccaagcatgatggtacacctgcccatggtcccagctcttaggaggctgatgtcggaggctcacttgggcctagagtttgaggctgcagtgagccaggagcagtgagccgtgattgtggcacactgcactccagcctgggtgacagagtgagacctcgactcaaaaaaaggaaaccaaggatgagaactattttaagttgggtcagaactcagtttgtgaacccagggctgctgaaaattaaatttggtccttaggaaaagcaagaaggttggtggtggtggggggccgggaaatggccagtaataatgaacaacacagattgacatgtagacaagtagtaggatcatgctgggtgtggtgtcacacatctgtaatcccagcactttgggaggccgaggcgggtggattgctggaggccaggagtttgagaccagcctggccaacatggtgaaaccccgtctctactaaaaatacaaaaattagctgggcgtagtgttgcttgcctgtaacaccagctactcgggaggctgaggcaggagaatcacttgaacc

SEQ ID NO: 154914 - DNA, 230 bp, Homo sapiens
tgaagtaactacaccatgaagacacaacgccttgatcactctcagcccaagcatcggttacacgtggctcatggattcccaagcggtctccaggaaaaacagaagagaacaattctcaacactaaatagcaaatagaaagagaaagaatagttaatgagccaaaaaagacatttagagttaaaatcctggatcagctgaaacattaaactgaaaggatgattacagtttg

SEQ ID NO: 154915 - DNA, 418 bp, Homo sapiens
caggctggtcttgaacttcctggtctcaagcagtcctcccacctcagcctccaaaaatgttggaattacagccatgagccaccacacctggccataattttattttttataaaaaaaaattttacaataaaattcagatttgttcttattgggagaacagtagaagtcattgaatgaggaatcagtgagcagattttaaataagaaaacataattttgttattgtgaagaatggatagaatatggcaaacctattagggaactattgcagttatccaggaagacatgatggtagcttgaaatgtagtcgtgtgaatggattcaagagagatttagagggaaacagtataatcaacctgttgttgataggaggagtaactcctcagagtagttgtgggtaatggaatacatgtttctac

SEQ ID NO: 154916 - DNA, 283 bp, Homo sapiens
gttgtgaacgctgtaggggtgggagtctgctggagtgggctggagccgctcacagtcatctcagtgagcctgctggtgcccagcagccctggggaggccaggtgagaatccctgagctggtgtagccatggtcaactgtgtagcagagaatccccttgtttcataaacaaatatgctttgggagctttgccaggcactcagcagcctttcttccactgctgtgtaatctgtttcatttacacgtcttccaacccatcttcctaccactctcctccttttctca

SEQ ID NO: 154917 - DNA, 106 bp, Homo sapiens
actctccatcgacccccttcttaacacacagccaccacagaatgtttctagctagaggtctctctctctctctcctgtttctgccctggtgtgggactgcatgccc

SEQ ID NO: 154918 - DNA, 562 bp, Homo sapiens
tgtatatcctagtttggtcctgccccatccaagagaagagagcgccatttcgccattttgtagttcaactacttagaggacacatctcagcatgatttgtcttcttgaagagggtaccttttagtactttgtataaatatctgatatgtatcggtggaaatcctagaataatggatactattttcctatcctggaattcgggccacctcacagcctttagtctagccgagactaataaccggttataaaatgcccctcataattccctccaaaggtctggtgattgtaactggctctgtggtataatttttaaatcagaattctttagttgcagaccacagcaattgattttgcataacttaaacaaaaaggaatatttagaaggatattggaattactgaaatctaaattgacatgctgaaaaacaaggcctcagggaggtcaggaaccatcaagctcgagacatttaggtagcagaacctcagtctctatagtccccagtcaggtttaaaaattcaaggatggggaatctgattatttcactaagagggatgggaacttt

SEQ ID NO: 154919 - DNA, 221 bp, Homo sapiens
gtgcccatttcccttttgattttcctccatgttgtgatgccaccatgcttcttgaacttcccagcctgcagagcagtgaactaaaaaccctttgggccgggcgcagtagctcacacctgtaatcccagcactttgggaggccgaggcaggcggatcacgaggtcaggagatcgagaccaccctggctaacacagcgaaaccccatctttactaaaaataca

SEQ ID NO: 154920 - DNA, 325 bp, Homo sapiens
tttatgatttttattagtgatttgttttttgcaaacttaaaaccaaaaatggctaacagctggaagattgaaaatacaaacataaacctcagtgaattaattgcagggatttcaagaatcatttccagtattttaaaattttggttttgtcttttctttttgtaaaaagattaacttggctactttaagctccactattcagatcatagataaatctgtcttttattctaaccttagtatttaccttatgattttaatgatgaatttcaagatgttgggttttttcaatgtcagtaaacattttttacttttacatatgttctta

SEQ ID NO: 154921 - DNA, 303 bp, Homo sapiens
tggtgaaaccctgtctctactaaaaatacaaaaattagctgggggtggtggcggttgcatgtaatcccagctgcttgggaggctgaggcaggagaatcgtttgaacctgggaggtagaggttgcagtgagccaagaacccatcactgcactccagcctgggggacaagagtgaaactctgtctcaaaaaaaaaagaagctaagtcaagagttacatgcaggtgtgttccattatacaaagcatgggtactccaaatgggcatttgctgcctggagccagcatcttctatgtagaccacaaaca

SEQ ID NO: 154922 - DNA, 1647 bp, Homo sapiens
tagcttaaaatacatacatgtacatttattcatgctccccattcttaccatcaaatgtactgactaaagccctaactgaactgaaactcgcagatttcaagctattctttacaagacccaaacatttttgctcccactagttaaagtgtgtgcgcactaagaataagagtgtgtttgcaaatctatttatgtgagttatgttgtgattttaagtaaagagttgaatctaatattgtaacaaccactgacacattggtggggggaaagttgctgtttctatggaaaccacagaaagcttcagtaaaggcaaactgattaaacatatgctattaggtataggcaagtcaatttttataaattgggaacttataataaaaacctggaaaagtcacatagagacagtgtcttctatgtaactcccatactgtcttaatctccttggaagtcctctccccacctccctctctccacacagtgcccagcttctgcagctaaggcccttcccttcataaggactttaaaagtgtcttcatgttgctgcccaactttgcagaaagtgaaagcagaaatagtagacaatacattaatgcaagaaaggcagtgaggaactatcaaatcaaacaaaagctcttgtcattaggttaaaacgttagtaaataaatgtacatgtatgtattttaagctaaaataaaaatcttaaactatgtatgcatcattagttttttggattcaccaactgggttctagttgcgttgaataagaaaattctcctctattggcaatgccctagctatatcatcttggatgcttatgtaaatgctgttccctttgtctggtctgcccttctcacctggcaagtttggcaaactcttactccttcaaaaagtcagtataaggcctctgcctaaagaagacttctctaattctctctctggttctttgagctggtcctctctctgagattctactgccctcagtaaggtgctccattgtgtttatccctatagtattgtctgtctctcctcactggactcagaaatttctgggggacagggatactgtctgtaagtctcaaggtctcctgtgtttagcacagaggaggcaggtttgatgagggagagaataaagaaatgaattaatgaataaggtataaaatcagacagcagggtgcaatctagaggacagagcattgaaaggtgtagataactgactatgaggaatttctgagggtacccagaaaggggaggacctttgctgaaggacccaggcattgagtagagatgggtgaggggaaggggatcccaaggagattaagacagtaggggggctacatggaagacactgtctcagaacagactaatgtcttaggctgtctagtaaggatggggccctggctagagaatcagatctggcaggccttgatggatatggtggatgaaaatggcccccagcagggggctttcactaggtcacaaggtctgggtctcacctgagaggatgaaggtgccactatctttgtccactacctcccattgggggctgcggagcacctgcctcttggagcgctctgaggctgggggctcgtagggtacatgcaggatgaagttgagcaggcgcagctggcgcgcttcccagtaccgctgcaac

SEQ ID NO: 154923 - DNA, 527 bp, Homo sapiens
taaaactcaacaagtattccccaaccaaatcctagaaaacaaggattagaggaatattttcttaacattaaaaagctatgagtaattatacagccaaagccaatgctgaatgcattactcctaaaattaggattaaaaaaaacccagatactttctgtttatgaaactctagtataattacactacaagaagaaataaaaaaatagagtgccttttagcaaggtaatatgctatgtacttgaagcacatgtaacaatccactggaaaaaaaatatttgaccttgaaaatatgtattaacgcacttagaaaacataataaaaaatagatatttcaagccaggcaaaaaaagataaacatcacatgttctcacttatttgtgggatctaaaaaccaaaacaattgaaatcatgagcatagagtagaaggatggttaccagaggctgggaagggtagtgagaagctggtaatgagatggggatggttaatgggtaaaaaaagaaaaggagaaggagtaatacacactatt

SEQ ID NO: 154924 - DNA, 498 bp, Homo sapiens
attgatacaggaaatgcaaatcatcatgagtaccatttaccgtatttgagattataaggccacaatgagaaatctttagtctgtctttgaaagtcaggggaatggagtttggtgaatgcccttgactgttacaaccaacaaagatgggtgcaactgagacactcatctctttactcgacattggctagagtttctcagcccttgactcgtatctcagcccatatgaatcctcacagacctagaatggataaacgattgcctttcccaaatcggaaatgttttcacttaagttggctagatggaaaaggacatcttaaatgaggcactatttttcatggattagttcaaataacatttaatgagcccatgtttagtgccaggtactgttcagttaccagggccggttcttggctttaaatatattttctcctatatttctaatagtaaccttatgggtcagcaagcattttccccttcccatttttaatatgggaaact

SEQ ID NO: 154925 - DNA, 463 bp, Homo sapiens
caaggaaacaaattctctccctgagcccttaagaagaaatgtagcctagccaacaacctgaatgtatacttctgaccttcagaactgtaaaataataaatttgcgttgctaaggcacgaagtttgtggtaatgttttagcagcaataggaaactgatgcaagcacccgctgcgaatctctggggtttgctctctgtgcacctttcttttgtacattgcggtgtcctgtaaaccctagctgccttggtctcctcaaaatctcagctctgccaggctctccctctatgctccatggtttggaaactgtctgtgaatataagctgaggcaatcacagggctcacaccatttatttcccgtctctcatgggtccgtgcccttcattgtctcacattcagtgttttgcagaccattattttatagtctacattttttagctgtttcaggtgagggggtaaatctggtc

SEQ ID NO: 154926 - DNA, 398 bp, Homo sapiens
taaaagccgctaccagctctgggctggagggacaaaaataaacagtggtactggatcccagagacttaactcagttactgggccattgggtggaagatacaatcatagagagcttgtctggcaagtgctaaaaccatggaaggaacacagcatctgccagagacactcataatacagatagagagggaaaacatcctggattttctcttcttccttagctccaatctcccattagtgatttcctagagtcttctgacagggagcctggtaaatacaaactgcagggatcagcccccactaggacaccgagaaagcagcagaagggcaaggaatgaacgtgaaggccagcagatcctgcactggtagagatgcccactgaaaatccaaaacagggagaa

SEQ ID NO: 154927 - DNA, 411 bp, Homo sapiens
cattcttcaagttgcttctgagctatcaccttggaaaaggaggcttcttcattaatcccatctaaggggagcttggccaacaatagctcagagacatcaagttaatagtcggctccctctttaaattgtagacaaaggaaaccagagaatagactgatttcatccaacagagataaaaacaggaatttatgtaacatgaataaaaggaggaggaagggaaatctagagtctgaagagagtacaccttgatttcctttccttggtgagctgctgatgagctggtcaggaggactctgggtgtgtctgtgcctggacaccgggtcatcacagaggtgagaggttggctgtctgggggtgagactggctgtacctgggtcatctcaggaaggcagtggcttcagcgaccaactg

SEQ ID NO: 154928 - DNA, 356 bp, Homo sapiens
ctgtgtcatcccgggctgaagttcctcacgtgatatttagttgcttgtggccaaaacccgccttcactgcaaatgcatcggttcctcatcatttctcctctggaccagcaaggggctttcctctcgcccatccatctcccaccttttcgttttgtaggtagaacctggagggagcggcagtaattcatcatccatggaacgtgcctgtctgtggcctggacctgtgggatttggccggcgttccctttgcattacatttggtacttggaagcaagcatcacacagactcagaacagaggtccatgctgctctctatctgggatgacttatgaggtcttgattgcttactctgtagt

SEQ ID NO: 154929 - DNA, 379 bp, Homo sapiens
tataaaaataccatcctttggataatgtctgggaatgttgctcatctatgagtggcacattctcctatccaactccctaattgaacttctgctttagaagacattgtgctgtctcttggtagtaatgaccttgtcctagaagagatgtttcctaaatagaaaaaaagaaaagcactcaaataatatctgtagatagtataaaaatgtaatatattttgaaaacaagattttttttgttatctttgtttctgtcatgcattattctgttcagaataagtatagtgaatatttatatttttattttagaattttatattaaaattgcagaaatgtctaactaaatgcattaaaagtaaaattcttgttagctaatgaccag

SEQ ID NO: 154930 - DNA, 261 bp, Homo sapiens
tgtgaaagcactctccgcagtctccttaacagtcaactctaaacagtttcattaagaaagcagttagatcacatggcagcctgtcccagcttaaggaagttttgaggctgatctgattctttgctttcgcagcctgattctgctaaaagtgcaagccatccttcctagtcatgctatcatccctgctgaagaccccccctctctcctctctcaaagtgtcttcccatgcaggaatgtccgttgatgtagattacaaacctt

SEQ ID NO: 154931 - DNA, 148 bp, Homo sapiens
caggaaagtcacagaaatttcaatgattggtccaatgttccgtttctttttttaattagtcagataccataccctgaacttgtttcaacatcttgctttatttccagaatgtgccttaattgcttcctaatttctgtgcccatttcaa

SEQ ID NO: 154932 - DNA, 419 bp, Homo sapiens
tattcttttctttatttcccaaacatttatgaagtgtttactttatgtcagacatgtgtgagaaaagacactgataaaagatccaatccctaccctcaaggagctgcctatatgattggaaaggcaaaaacagaaagaaagccatcatgtactctatataaagtgcttttcttatctgctgtaagtgtgttatttaagtcagactctcctctggatcccatgcccagctgggtcctggccaaagcaaggaaggcctcagttcccttggtatatgctgggctgaaaaaccacaggagttcctcacacattcttcagccttgaaatagtatccaaaatgccaaagcattttagaataaagccggattctcaaaattaagaaagatggctttaatagctatatttaggattttgatatgtgc

SEQ ID NO: 154933 - DNA, 647 bp, Homo sapiens
cagagtcactttagcctaggtttgagttataggtcaagccacttactacctgttaaccttggacacattatttaaactttctgagcacttgttttctcatttgtaaagcgaagatgttaaaaataatataaattaacttttgaacatggcttgagaatgtaataagttaacacctttacagttatgtagagcagtgcctgaggcacagtaggcacacaataaatattagcccttattataataatcatcttatatagtgagattggtctcctagaagggcagtgaaaatattatcaaaagaatcaccaattgctgctcaggagcattgaaggagcaccttgagttggagaagtgtcaacaattttgattgaagctagatgagcgtgtctatgcctagtgggcaggccttaatttgctgcttcttcacatttcactggcgattaaatgctgagggacccatgtctctgatacctggcttggagcccagtctcctgggatgctatttcaacttgacccagctataaaagcataggaaccccagtcatcagataaagcagtagagcaacgaaggtctgtgctgtctggtcaagggttagatttggatggttagggagctggaagatattggtatgggattgtggggttgg

SEQ ID NO: 154934 - DNA, 336 bp, Homo sapiens
ggataggtccaataataacatggaattcctacaattattttgttttaaaaacatcagagtttaatatagactctggcttttttagtcatgagttgactcgctcttttgggccaaaaattactgtgacagagggcaacagaatagatgttcttttcttagttgagaaagatgagcttcaaatacacttccaaatttttttctgcatgtgtttaaaaacagagagaatgctaccataatagtatgtcaggagtcaggaatgttttaaatctgtgctgtgctaatgcatattttacttattatataacttaattttatttactcccaaaaagcagctgg

SEQ ID NO: 154935 - DNA, 226 bp, Homo sapiens
ggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtcccgagcccagccccgagcgagccccccccccgcccc

SEQ ID NO: 154936 - DNA, 428 bp, Homo sapiens
cctgcctcagcctcctgagtagctgggattacagtcatccgccaccatgcctggctaatttttgtatttttagtagagacgggatttcgccgtgttagccaggatggtctcgatctcctgacctcgtgatccgccagccttggcctcccaaagtgctgggattacaggcgtgagccaccatgcctggccttgtactatgtgttttatatacagttgaccactgaacaacacaggtttgagctgtgcggatccacttatgtggatttttttcaataaatacagttggctctccatatctgtgtgttccgcatccacaagcaagtgtggatggaaaatgccaatatttgcaggatatgaaactcaccaatatggagggctgactttttgtatacatgagttcccacagggacaactgctggacttgagta

SEQ ID NO: 154937 - DNA, 358 bp, Homo sapiens
ctcacctcagcctcccaaagtgctgcgattacaggcatgagccaccacacccagcctttttcttttcttttgtagtaatggggtcttgctgtgctgcctaggctggtcttgaacccctggcctcagtgatcctcccaacttagcctctcaaagtgcagggattgcaggcgtgagccatcatgcccgatctaagaaatattatcttggggaaacagggaatctatggccacactcattactatggtgtagcaaaagtctgaagctaagcagtactttttgagctttggatgggacatgtgctatctactgtgtctggccccaacagctcccttaaccccatgtgagttgccatttatca

SEQ ID NO: 154938 - DNA, 453 bp, Homo sapiens
ctgtaattgatgaacaactactagaatgaattattgtacttgagcacttagaatcatgtcaggagaggcatgaagtaagtagaacatatttgtgtagagataataattttactttctaaagcagtgattttgaaactcttgctgagagtgtgctggaggaagtcaagcatttcatcccggtttcaaccagtgctgttttattttgattaattttaagcgtggaagtttgcatagtatttcagttgagcaaggttctgttgtttaaaaatacgatagcctctattgttaccatatttgctcttatcacttgcctgcttaaatccttgctatttttttattgttattacgactgataagacttttctttccctagctccaactttattctttatctctgatcactttttcctttccatgtaaaccctgcattctaattctacttaaattgtttga

SEQ ID NO: 154939 - DNA, 2055 bp, Homo sapiens
gattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaaacccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtcttaacagtctccggtgtccatgcgttgactgccatgtatgactccaggtattgagttcatcttcaacttctcccaacaatgaactggagttttctgtgaaaagtctg

SEQ ID NO: 154940 - DNA, 2165 bp, Homo sapiens
gattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaaacccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtcttaacagtctccggtgtccatgcgttgactgccatgtatgactccaggtattgagttcatcttcaacttctcccaacaatgaactggagttttctgtgaaaagtctg

SEQ ID NO: 154941 - DNA, 433 bp, Homo sapiens
tcacttttttaaaatgtacttttttgggaatagataatgtgtacacattgtttaaaaccaaatatggcatatagtatctaagcggtttaaaaatttttttcaatgggttaacatgcagttagattttaaatcatttaaaattttaaccttaaacatcaggaacacttaagcctgcattaaaaccaactcaatacaacataataacaatatcgatccaaattaaacacgaaagaaaacttaaaactgcttctctggaaatgcaaaaatgacaagtaatttttaaaatttctaaaagcatttcagagatcacacataagtcaaacgaagttgggaggccaggcgtggtggctcacgacgtcaagagatcaagaccatcctggctaacatggtgaaaccccgtctctactaaaaaatacaaaaaattagccggacg

SEQ ID NO: 154942 - DNA, 950 bp, Homo sapiens
aactcctgaccttgtgatccacctgcctcggcctcccaaagtgctgggattataggcatgagccactgcgcccggctggtctctgacacatctaagctatgaaccattagggtaagtttctgaccatctctgagccccatctatgaaagactcatagggaggttgaaattgcaccacatgtacgatatctggcccagtgtaggaaatgtataaatgttagcttcatccctcagggaagcccactgagatccacacgaaacttttgtctgtgtctccccataatgtgacctttagaagttgccaatggcccacccaatacccaaccatgatttttctgagataatctgcccgaggtgtgtgagaggaaacgcgaagaaggcagtcaggaggattcactcttgggggagctgggtaggatcctatctcctcctacatccagagcatgcaggctccatttagatacaaaggggtgggattgggttcctggggagaaattgagcccctttgattctgcggttctgtgggtctaaatctggcatctccttggctatccacccccaggctttgtgattggttggctgtggttggtgggggggcaggaagctgctggtggagctgcagcatccttcagtctcaggcccctgggagggggaggggaaagaaccagggctgagctgtggagtgaaggggagccatttctctccaccgactgcaacctccgtgctcacagctcacggttcaccagaatccaggggcttggtcggcctaggaatccacaatgctggatattttcatcctgatgttctttgccatcataggcctggtcattctgtcctacattatctatctgctctagtggcctggagctgcggccggagcctgctggagaacagctcagaaggaaggatggagatgaatggccgagtgccctgcttgctgacgcaccggtg

SEQ ID NO: 154943 - DNA, 311 bp, Homo sapiens
agaaactgagacctaaagaagtgaggcctgatttttccaacatcacacaatttttactggctgagactggtcccctgatgcctaagtcaaatggtctccctttccataataacacttctgacatcctcctagtttaaaaatctcgattctacattgaatcagttgccagattctgtcagttctctctcccagacttcccatttccccttcttattgcctaaccaaagaaaacccactgtcagcttgttgtgtgcagggtcattgtctcttgtgttccaagcctttttgcaccctccacaagtacagttcct

SEQ ID NO: 154944 - DNA, 115 bp, Homo sapiens
tgaaggtgttgggtgctggcaaacaaatcagatggttccaggcagtcaggatggacgtgctgccttctgcctcggaaggtggtggggtggcccaggtgcccgccgtgcccttcgg

SEQ ID NO: 154945 - DNA, 347 bp, Homo sapiens
cagagctgccccacggggtgcagatggcatctgggcctgtctgcagcagacaacaacatgcagaccccaccatcccctctgctggagctggagaacaagcagaccacccacagtctccctgactcgggctccaacatctgcctgaggaaaggccggggaggtggcacccagaagctgctgggagggaagggggtgggcctgcctgccgtgcctgggcctgcgcccccacatcccacatgacggcctccccagcccccactctgcaaggaagtgacagaaactccacagaatccagagggcctaggaatgttggtcctgcaggactgtgcagcccaaggggcggccgc

SEQ ID NO: 154946 - DNA, 369 bp, Homo sapiens
agaggttgcagtgagccgagattgtgccatcgcactccagcctgggtgacagagcaagattctgtctcaaaaaacaaaaaaacaaacaaaacaaccatgaaaatacaaactaagggaaaggaaacacagatttctagtagtcttctcctttggcacttggaagcaacattttgctcatttccagagaatattttctgaagccatcaattatctgttacatctgttacattatctcatgaagccatcaattatctgtgcatctgttacattatctcatgtcagggcacctggttcttcttgctggggccagagcagcccatctcctcttcaggaatagcctgaagccaggtctctcccggggttctcttc

SEQ ID NO: 154947 - DNA, 555 bp, Homo sapiens
cctttgttcttaactgctctcaggcatctgaaccctgctggttttgttagtattccacgtgagtttagacagaaatccagcccctagggcagcacagtgaaaagccggatgttggttgcacactctactctctccctccaagggagaagtcctaggccaaggtgatctccttggtgctgagctgtgccggctttggggaggggctgacctgggtaaaatgttcttcttgcctgtttcagtgcaactcttcttggttttgttcttgtctggagtacgacaatatcttaattggtttctggacttttcataaaggtatttttgtctatatgtccttgctaaatcagtgtttctgagaagctgtgagaactggaccttcttctagttcagttttgaccttaactattcatttggtctcaagctactgctttctattcttttcattttaaccacagccatgcattcctactattaaatacagtaattcctcaaatgtgccagcttctttcatacctctgctttctacccagaacatcttttcttactctttggatcagt

SEQ ID NO: 154948 - DNA, 333 bp, Homo sapiens
cccctccctgctttgagttgtcctgcctttcaggactgaaccaatgtacatcttacacatattgattgatgtctcatgtctctctaaaatgtataaaccaagccatgccccgaccaccttgggcacatgtcaccagggcctcctgaggctatgttacaggcacatgtccttaactttgggaaaataaactttctaaattgactgggatctttctcagatatttggaactcactctacacagacacacagacacacacacaaacacactcacaaacatgcacacacaaatacacatatatgtatatttgtgttataaacgtattagtccttttt

SEQ ID NO: 154949 - DNA, 251 bp, Homo sapiens
aaatgaagctctgaatccaagctacttttgcacatgcaattatctgtcctgaagagtccttgtatactctgcctgccttggatgtcatcctaggcaaagcagatagagagctatcagcaaaccggaagggagtgcttaagaaaaagataccagccaaagccaaacaagaactgttcacaccgacattttattatttgcatttctagagtgtttaaagtacttttggattaattctctctttcagacactta

SEQ ID NO: 154950 - DNA, 201 bp, Homo sapiens
accttctccgagaaccagtcctagcagcatcaggggatctaaggatccactgccattgtggacaggtccacaaagaccaacaaagaccatgaccagggccttgatttgaccacatctgactcagcagatcattctgaattaatacttcaatttccttttttttttttttttttttttcagtttgtggaagatgaggtttta

SEQ ID NO: 154951 - DNA, 356 bp, Homo sapiens
tttaccatggcctgaaagaatataatgtaatagattctttttaacggcattaaacattttttcatcagtgcataatctaatcacaaatgggattttaggttagacttttccagctacttaaacagccctcttgagtactcaatagctgttctaggcactattttgtagaacactcctaagtttaatggtgaagattctcagatactgaaaccaatagcgacatttacgatatcccaaaatatcctcactattgacgcaatatcaacacacccccactcaaacactgggatactatgacttttttttccccagagaacctaagagctttaattgcacaattcccattaatcatcttg

SEQ ID NO: 154952 - DNA, 489 bp, Homo sapiens
cacggtgctggtgggagtgtagcagagaggacgaccagaggtcactcttatggccattttggttttggtgggttttggccggcttctctactgcaacctgttttatcagcaaggtctttatgacctgtattttgtgctgaactcctatctcaccctgtgacttagaatgccttacccgtctgggaatgcagcccagtaggtgtcagcctcattttactcagctcctatttaagatggtgttggtctggctcacacgcctctgacacctttgcctctcggggcctctgtgttcccgtcaggacatcggaatctccaagggcataaccctggtgctctgggagcctctctgtcagcactcagcctggatggagggctcagtgcggactccgttttgttgggtcatggttggccagtgctaggctgagctgggctggacacagggctggaggggtagcgcccttactgtagggacaggtgggggtgcaattt

SEQ ID NO: 154953 - DNA, 219 bp, Homo sapiens
cttttatttctaaggatgtttggcgtttgtccagtttccttctctttcaagtggaccaaatatgtacacaacaagttttatgacaatagagaacaaatatggtgctattattaatacatagcttaaggatttcacctaatcttccttttcagttattctttttttgagatggagtctcgctctgtcaccccaggctggagtgcagtggcgccatcttgg

SEQ ID NO: 154954 - DNA, 558 bp, Homo sapiens
cacgtttagacatgggtggtatgggcatcgagttctctgaactctaatcctgatagatgccatgtgatgtgtgagatggcttccaaagggcatttaacacactgtgagtaagatagaactcaatgcccttaccacccatgtctgtgatggtcatgcatgcctcagtgacagtgacttcctgactatccctccagtgactacatcaacgtgtggtacctccgagtaatgctataccatttggccacatgctcagctttctgagaggctgaccaaagatgtgggtagtgttaaaataaaatggagaccaagcttgagaatcccctgatcagacaaaatcagttaggccacctgagtgaaaggtagcttaggtgatttcttgtaaatgcctctgacagtcataaatgaaacacgttggcttctaaaaatggtataatatgatcaccttccactaactccctgccatcttgaaacctcagtagcaatagccaattattgtagagattaagtgacttcttcatttttgttttataccccaggctataataccatatgtctgaa

SEQ ID NO: 154955 - DNA, 769 bp, Homo sapiens
atttactgaaattagaaagcctggcgtggagtggcgagtggggaccaaattcgaggaggagtggggaatcaagaattctatttttgacatgttacaattgtgaggcctgttagacctgcagatagaagtgttgaatcagcaaatgaattcatcaagaaaagagtccgggctagagatactaatttgggagttgttgacgtcttgatgatctttacaggtgtgggatttaatgagcttaatgggaattaagtaaaactattttgcttattacttattatgggtaggtcacagcactttgtgcttggagtataccagcaagcaaggcagacacagtgattattctaagtggtttgctccgagccctgcatgccaccaggaatggtcttgacttttgttattgttaaacttattaaatgttggagtggacgcaaacttagagatgaccaagtacaaattccaaaacctctctcaaatttacaactgaggaaactgaggcatggagaagttaagtaatttgttaaaacctagtgtttaaaaaccatgtatactttagagttttcaataatattcagtccaaagcgttcatattcttcctttttatttgtatttttcttatagtctaagaaaggaagttaagttgaggggatagtaaaaaagataattagagactttgcctaaaagacctatgagagattcaattgaattcaataactaattattgaatgcctattgtgcctgccggattcggtccggctcgattctatctgcc

SEQ ID NO: 154956 - DNA, 600 bp, Homo sapiens
tcctgacctaccctcaactaggggacccttttcttcccccttgccttgcggacctcttctatcaaatctttcaggtactggatctccttggccagggaatcccgccctgctcgtttagagcctcgttcttcttttccagctctttgcactcaccagtaagagcctcctgctccgccctcttcttctggcggtacctagtggctgctgtcttgttttgctccatttttttcagcttcttatccagtttctcaccctttacttttgctgctaccatcttctctccaggaggatcgtaaggtttgggacgggcagacccacagagaacacctggagatgggaggctcctatttggagagcccctggtagaggggctgtgctgaggagaccccagataggactctgggctcatacagatgccactatcattatctgaaggggtgtcttcctcctttatgcactgagggatcatggcaacgtaagcagtggagtccggcttcctatcttcttcagtgatatccacttcactgcccagctctaaactaaaggaatgatctggagtggaggactggacccctggggaaaggggaagaagttgcaaga

SEQ ID NO: 154957 - DNA, 401 bp, Homo sapiens
tgttgggattacaggtgtgagccaccatgcccggcttgtgttaacatttctgatagagcagttcatttcattgtttgaaaactaccctcatgggagcaatgacaagcacatgtctaggattttttcaagcatgtttggtgatctcctaaacatacaggctgttggttaaaaagtgaacataaatgtttagaatgaaacctttttgtttaaatggggaagtgaaaggcttgcccgggcgtttccatctgcctactgtaattgatttccgcataaacggtcattactggcacctattgcagcaccagtattaaactgcatatagtaaaatcactgtgtaaaattgtgttataatctaaacagttctaatgcgatcttaaaaaaaattgtagagacagatctca

SEQ ID NO: 154958 - DNA, 658 bp, Homo sapiens
atttgtctttatattgacaatatgtttagcacagtctctggcaaaaagccagttagtggcacatcattcaggtctccccagatggagaccagtgcttctttttcattacagtgtggaggccctagtcatattctcattatacattaaaaactttaatgatgattgactcttcggttaccattttaataagtcttgattatgagtctaagcttttcaaaaacatctttcattgaataactatatgcaaagaatatatatttatatacttatgttgctgctttgtataaaataggcatggatcagaattaatgtcctctgattctatatttgccattagtcttttttctttttttttcttttgagatggagtctgactatctcccaggctggagtagtgcagtggcaccatctcggctcactgcaacctccacctcccaggttcaagcgattctcctgcctcagtgtcccgagtaactacaggcacaggccaccacacccagctaatttttgtatttttagtagagacagggtttcaccatgttggccaggctggtctcgaactcctgacctcaggtgatccacctgccttggcctcccgaagtgctgggattacaggcatgagccaccacgccgggctgccattagtcttatattaaag

SEQ ID NO: 154959 - DNA, 189 bp, Homo sapiens
cgtgacatctagaggatcccgttactgagcttggttgtctaggcatttgcattttaccaagaagctttccatagccctcatttgttttcaggacagccttgttggtttgtttcccttttcattgtttagaggagaaagagagtcagagctaaaggggtgagtggttttgcctgaggccacctgccagga

SEQ ID NO: 154960 - DNA, 585 bp, Homo sapiens
cagagattttaggaatttcagatttttagtcataaaccaaaatcttcgaccattaaacggtgtttatgaatgtttatgagcacaagggaagaaaatgtccaggaagaggggctcctgagagagtgtcctctgaaattcctggtcttataggagaggcagctgcagaagggagctgcagagggcacacacatgcctgtgtcagcgtctcatgccgacatccacactggctgaatccaacatgttcaagggtgctgcatgctcatccagagcccactcctccggggccccacagtgctaagccatggggctagaagggccacatgtcaagatcacaacttccaaacagacagttgcagaaaggggatggggagaagagcccagaaacacagaggcagcaacctcccaggtatgccaagctttgcactgacactgctatggtacctacagaaatccatgcactaccggccgggcatggtggctcacggctataatccccgcactttgggaggccgaggcgggcctcctgaggtcaggagttcgagatcagcctgacaaacatggagaaaccccgtctctactaaaaat

SEQ ID NO: 154961 - DNA, 321 bp, Homo sapiens
gagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccacgtacatgat

SEQ ID NO: 154962 - DNA, 366 bp, Homo sapiens
atgaatttattcagggtcatctagcaaggtcagaacacaacaaatacaaacatcccttcctggtccacatccttaacaccacgctgtagtcattcaacaaacatttatcaggcagagatctgctgggcatttcacttggtagatgggctcaactcagctggttcctgttttcaagcagcttataatttaaggaggaggagggagggagggaggaagacagaaaggagagagagagatctttaaacaaacggcagagccaggcttcagtgcctgaccaggcttcagtgcctgaccaggcttcagtgcctgaccaggcttcagtgcctgaccaggcttcagtgcctgaccaggcttcagtgcctgacc

SEQ ID NO: 154963 - DNA, 139 bp, Homo sapiens
catgctctgtggcagggtctgggttaaacaagagagttgaggaatgctctcggggagtgtgcagggtcattgttgttattgtagaacaggaattaaaagaaattttaaaacgtgtaagcaaaaactcagttctatgtta

SEQ ID NO: 154964 - DNA, 531 bp, Homo sapiens
tcagtggtcgtatcatgcttatagcgtttctatttgtaccaaacatcctgtcagagcttaactgtggctggcttaagtgccttttggctagtgctacacttatactgaaaacattaggaatccttaactttgggggtggcaggtgtgatgaaggcactaattgtgttccttttccagagagtgagttaggatgctttggcattaaagctggggtcaaaatagggcttggggtgttggcttcactcgatgaagatgaataatcgagtctctgggattgaaattttttattcagttcatccgaggaactatcttgttcctttttacttaattcagaatttccctttccaagaggactatttagagctttccactgtgcctcctgctgccaagaatatagcttcttgtgttctggtctctttatgccaaaagtctcttcctcaaatatagagctgctgtcatcagatgctgtcagatacatttcacttcccatcctgctacactggaccccttcctcagatgtgtgactggaga

SEQ ID NO: 154965 - DNA, 595 bp, Homo sapiens
ctgcaccagaggaatggaaaaatgagataggaaaaaaagccagcagtcagcgtgggtggagggggcttctggaagccagagtgtggccccggggcgtggaactgctgtgtgtcagcaggaatcccctgcctcctggcctggtgcgcacgtgcctgcggggcccatcgggcagcagttctgaagtggataggaagggacaggcccactgcctcaggactccaccttggggcgttcgagccacctctgcattggagaagagtccttccatccctctgccagtgcttaggccacttccctaccaccagaccagctctgaggcctgaatggcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatacccaggaagggtcctggcttcccttctctgtgcctggcc

SEQ ID NO: 154966 - DNA, 565 bp, Homo sapiens
tacaccccgcttattcagcagccaagatccctgacaactcaacatttggaactcaggtatgatttcccaaactatactcaggagcttaagggagtgtgtctaaaattaaagttaatgagttgaacaagcttaattattttgtttcctctggcaaacttccagtcttcctgggtttaatccaatggaagaaatggttattgagtgcctacttgtacagggcaccctgttaggctgtgagaggggtacagggagagctgagaacagatcataattccatgggaagggaggaagcagacatgctgaccgcagcaagatggaaggaaacagaatgatcgccagctagaaaagaataaaagcctctgagctctcgaattagcactaataacaccagaaaatcaaatagcccccaaggctggagtacagccacgacagtgcctggggtttcataacaatgactgagtcggaaaattaaaagaacagaaaaagttaagatgttactaactcaatttcctatggcacagaatgatgtcagacattttagaaaaaagtctaatcaaaacaagcg

SEQ ID NO: 154967 - DNA, 196 bp, Homo sapiens
attatttccttgggataaatttctagaagtagaattgctaaaacaaagactatttaatatttaagctacttaaaacattggcaaattgtcatctgagatgttgtattgatttatagtccctctgtagcagattgtgtttttaaagacggctgcacctatatgtcccattccacatgctcttcttattgtgtgactt

SEQ ID NO: 154968 - DNA, 483 bp, Homo sapiens
taacaaatgcatgacattaattttaaatttaacaagatagccttttaaaggaatatattcccctacccagccccaaaaagcatttatgtcctgatgaccacaatgaataactgagctgaagaaacaacttgtctttgtcagggagataaaattcttctgccacgtttttaccttccattccttagcattgtgtctgtggctcttcctaatatcactttccccaggagtgggaagaccctcttataattattggaacatttccactgtagaacctgtgacaagttaatctttttggaatggcagtcagatagctggaggtaaagccttacgtgccagatcttctactttgacacctttgctacactatatttctaaaatatccatgtacttggctgacttcttaaatgctgagcaaaatttatccttgatggctcagaattattgttatgagggtatctattactattatgtattaaaatgtac

SEQ ID NO: 154969 - DNA, 532 bp, Homo sapiens
aatggagtcatgctgagaagaaggaatgctatcggtgaaggggaaaattgacattaaatttgtgagcagtaaactgtgaccagagcatagggttcatcatgcttgtgagttctggccctggcccttgtatcttccattgtgcttccctgaggcatcctgtctgttcatgctactttcccactaacttcagtgaatcccaaattcatgggtctagccacagccagcgtactgaatcccagtgccatattccagaccccaaatatcccatgtgcctctgaacctgcaatcaatgtgtataacactcatgtccttctggaaatttacttgttttacacactctattctgagttctcttggttggcctaaactatccatgatgccttcctctccctcacccattatttcttattagttgcaagttctgtatatttggccttctgtgttcatgtgaaatctctgcacatcccctacttacctgagatcctgtcctctcatcagtgtcattagactcccagccagtcaccctacctct

SEQ ID NO: 154970 - DNA, 675 bp, Homo sapiens
gtggcaggcagaatctaataacatagccccaatgacctttgtccccagtgttattaccatcctatgttattgcatggcaaaagagattttgcagatacaattaaagttactaatcagttgaccttaaaacagcaaaattatctgcgtggccctaagctaatcactcaaattttcctgtcttgtagcagaagggaagtcagagagatctgaggcatgacagggatgcaacatgagggaggttctactgctgagatgaagcagcccacaaaaaaagaccaaaagtggcctctaggagcagacagcaatgctcagccaatagccagtaagaagacaaggacttcagttctgtaactagaaggaactgaactcggctaataacagggttcagtctgacagtggattcctttcagagccttcagataagaacccaacctggccagagaaccctgtcaagcacacccagtcttctgacctaaagaaccatgcatgaggtaataaatgggtgttactttaagtggtgctttgttacgcaacaacgaaaaactaatacaactgggaaacactgatgtacaggtttaaaaatcacccccacagaaaccacaggaacggatgacctctcccatggaaagtatatctgaaaaagccttgaaggatgcctacagttagagtgttttt

SEQ ID NO: 154971 - DNA, 557 bp, Homo sapiens
tgctacaaagaagacatgttttagacaaatactcatgtatatgggcaaaaaactcgaggactgtatttgtgactaattgtataacaggttattttagtttctgttcttttgtttaaagcattccaacaaaaggttttaatgtagattttttttgcacccatgctgttgattgctaaatgtaatagtctgatcatgatgctgaataaatgtctttaaaaaaaaaaaaagttgcacacacacacacacacacacacacactaaatatatgcatgaaagcatcaaataacttgaaagatagtaaggtatcagagagacaggatctaaagagggacaccctacatttataaccactttggtccctgagagcaattgccaagtgttaaggaccagctgagaacttgacagcttggtaagattaggagaaaagaactaaaattcggaaaataccaaagggggttacagggggactggtaaactcacctcccttcgagttggaatcctgaattgctgaacttaagaaggagggaaaagggaagctgccaggctctaagacatgt

SEQ ID NO: 154972 - DNA, 311 bp, Homo sapiens
tgctacaaagaagacatgttttagacaaatactcatgtatatgggcaaaaaactcgaggactgtatttgtgactaattgtataacaggttattttagtttctgttcttttgtttaaagcattccaacaaaaggttttaatgtagattttttttgcacccatgctgttgattgctaaatgtaatagtctgatcatgatgctgaataaatgtctttaaaaaaaaaaaagatcatttctttctgtttttcgattctatattattacatacttatagattttaacttgtttcctcatctagctgaataatctcaa

SEQ ID NO: 154973 - DNA, 490 bp, Homo sapiens
ataatatttattttaaatagtggagatagggtctcactctgttgtccacgctggtcttgcctcaagtagtcctcctgcctcagcctcccagagtgctgggattacagatgtcaaccacttcacccagcctgtgctgtctttattgaaaatagcaagcgatgattttccaaaccagaaggccaagcaggaaagcccagcgcgtcccttgccctcaaactcagctcttggggaggtgtccagtgacgtcctctctgctgtacaggatgatcccaccccgatcgttaggaagatgtgccccaggaactcgggatttccttagtgtggtgattaggggtgaaatggatcctttgatagggagtttcttgatggaacgaagggcgagagtgtctctgagaagtgctgcagaccaaggagggccagcctgtcctggagcacctggggctgttcttggagtaaggctgaagggccagacactgatggcttatggtgg

SEQ ID NO: 154974 - DNA, 400 bp, Homo sapiens
tctgcctggaatgctcttcctccagacatctttcaggcggattcctcaccattcaggggtcaaccaaaaaaagatattgccttagagaggaagggctatccagcccgaatgaggaatcctactcttgtagattgaatcgtccctcctgaccctaccaaaaaaatatattcaagtcctaactctagatcctatgaatgggaccttatttggaaatagtgtctttgcagatgtaatcaagttcagatgaagtcatactagacttaaaggggtccaggctaatgacagctgtccccgtgagaagaggaatcaacgcacatgcactcgggaagaaggtcacatgaagacagaggcagagatgggagtgacacagccacaggccacagagggccaagggtctcca

SEQ ID NO: 154975 - DNA, 509 bp, Homo sapiens
caggcagtctaggttcgttcttgcttgatttttccttataatttatttgttgaaagaactatttctcagaatctggattttcttaaaatgcatcctcatggtgttaataagttcctctgtcttctccattttctgtaaattattagttgggtttagagcagtgattttctgactaacagcatcagcatcatctgggaattgtaggaaatggtaattcctactcatcccagagaagctggccataaaagtcaccatcttggtgagacctagcatctcaattctgtgaagtcacccattgaaagagatcaaaacaattggagtggagaggggtgaaatattggatgaggtagtggttggtctcttgatggtatggcatgcctgttatttctatgttttcatttcatatcaatcaaaaattggggtttttgcataacagatggaatgcaaaaaagaaaaaaaaaggagtgttgaacttatggttaaacagttaacttagctgatttaatgta

SEQ ID NO: 154976 - DNA, 167 bp, Homo sapiens
gggacagaggtgtaagaattatctgacaaagaattcaacatagctatcataaagatgttctatgagctcaagaaaattgttcataaacaaaatcagaatatcataaaaaagaaactataaaaaattaaacagatattttggagctgaaaaatgtaataactaaaaca

SEQ ID NO: 154977 - DNA, 472 bp, Homo sapiens
aattggttggtcggttgcctagttttgagacggtatcactgtgacccaggctggagtgacgtggcgtgatctcagcttgctgcagcctcgacctccctggctcaagagatcctcccacctcagcctccagagtagctgggactacatgtgcacatcaccacacccatctagtttttgtattttttgtagagacggggttttgccatattacccaggctggtctcaaactcctgggcttaagttatcctcccacctcagtctcctgagtagctgggaccacaggtgcaggccaccatgcccagctaatttttggtatttttgtagcattggtggtctcaccatcttgtccaggctggtcctgaactcctgggctcaagcaatttgtccaccttggcctcccaaagttctgggattataggtgtgagccaccacacctggcccgctatccctgtttttttagcattcatggtaa

SEQ ID NO: 154978 - DNA, 377 bp, Homo sapiens
ggcagaggcgtgcgtcatggaaaacttggaggctggtgattgggccgtctctgctgcaaagtcaagtccccgaacgcttgaaaaacaacataatgtattcctgtctgcagctctgagcgaaagctcattttgtgtcctgtgtttccatttcctgaggattaataagtgtggaggggaactcgggcttcgtgccgaatatttatttagtcaatatacgcatcaatttagcaaattagagatcgcaagccatttctaagcaatgctgtaaaaataatagctgtactttaaacttgtaatggattttggtttggtgggaggtggtggctactacgtgcctggtacttgataaacaaagaagtttagttctccttaaactt

SEQ ID NO: 154979 - DNA, 275 bp, Homo sapiens
gtctaacactggacctagcacatagtaggtgctcaaaataagctggctgatgaacaatcttttcaactttccagaaaacatctcacccttctccttccttctcagctctctctgcacagcagctctgttctctatctcttacagctgttcttccattatttcctcttatactcttctttccttcttcattgtcagaagagaaagaggacacatttgggaagtgaagaaaaaccctagccaggatttctcactaataacttgacactgaaaacatt

SEQ ID NO: 154980 - DNA, 367 bp, Homo sapiens
attcacactcctctcactgtgaccttggagaccctcgctctggcccacccctcctgtgcctcaccttgctccttcttccccgtcatcccagccttgttttctctgagcctgttgaggtccttgccttggtggctcccaacggatgttcttctggccagtgctgtgctgccaatgccaccaatcccttccaagcaggctgatctgctgggagctgtagccctggcgcgtcccgacatggattcccacagcgtctgcctgtcccgtcatgctttctctctggagtcctccctccttggtatggtatgtttctgctctgttcttttgtgaccaggaaagaatgtcttgtttcttccatccagccctcctg

SEQ ID NO: 154981 - DNA, 488 bp, Homo sapiens
tggccatatttctgcatccccatcttctcaccttcccatatgagggtacttaccccaaggacagttaatccatggccatgaacctatatcctggttagaaaagataatctgtgccaaataagacgtcttgggagtctgaactgaaaatagggaacaacttgagcagtttatagtaggacagaaagaaatgacatggaattcggttgagccatattaatagcagagaaccagagagaagatcctgctatgagctcttaagctgtcatgaatccagagctcctttccagctctggtcttcagggttgtcctatggcagctccaggtgtccctgttatcctgttcttattattccatagacatctacataagtttgctagggctgctgtaacaaagtaccacagactagacgaacttaaccaacagaaatttatttcctcacagttctggaataataagaacaggataacacgttcgcgaggggtaccgag

SEQ ID NO: 154982 - DNA, 540 bp, Homo sapiens
ctgagccttcagggtcaaggggtgccagcccccagggagctggggaaagggcacttctggcagaggagagaaaggactcatccagggccttcgtggaacagaaagaggggcagtgggctggcatgcacaggctcgcttcaggtgcagtaagacctgtcacctccaggagggcaagacatcatctgtggtgctcatcgttgtgtcccacttcatggaatagtgctgggaatatggtacacactcaagaaatatttggacagctacagtggctcacacctgtaatcccagcactctgggaggctgaggtgggtggatcacttgagcccaggagttcgagaccagcctgggcaatatggtgaagcctcgtctctacagaaaaatttaaaaattagctgggcatggtggaacgtgcctgtggtcccagctctcaggaggctgaggtgggaggatcacctgagcccagggaggttgaggctgcggtgagctctgatcatgctattattgcactccagcctgggtgacagagtaagatcctgtctc

SEQ ID NO: 154983 - DNA, 398 bp, Homo sapiens
tttgtgtatttagcatatttacatttatgtgtaaatagccagaaggtacattcggttcccataatttaatatttactgttcaggcacatctaagagcataatggtttcagcaaaataagagaggctttgtaaatcttatatttaattttgatactgaaataggcaatgataccattacttggtgaattattttaactttgaacatctttgaggcacaaaaaattcaagaatttttacaaacacaaactttaccttaaaaaaagaagacacttacactctgaaagaattagtcttggaaagtcctcaaatctagactaataaaaggtcttaaacatctcctgggaccaaaacaaaaataccaccaaatgatctctttcagaaggacgaatagatagttg

SEQ ID NO: 154984 - DNA, 282 bp, Homo sapiens
tcagacaggagagaatccaaaaacaatgaaaacggaaggaaaaaacactgaagtcaagaattctctgatttttttgaagctataaaatgagagaagcggagggaaaaaatcacataacgctcactctaaatcaagcaagatcaaacagtcttggaagggatattgccgattcatttcaacccaagagtcatagggaaacaattaatgggtactgagtatcttactcagccttctgcaaatctatcaatgtcgtcacggattttttttttttttttttttttt

SEQ ID NO: 154985 - DNA, 647 bp, Homo sapiens
ttagatcatggacaacaccatgacccaggcccctgtggctggtgagacttctgggccctgggtaccacagactatactctaaacatggtctttactatctcagatcctgccctgagtgtcctttgcagcatgttgagtattagccattttcaatgtccagttcaagtgccattgctggtaaggcttctgtagttcttattggaagaattgtcactctatgtcccagtaatagtactaatttggtttcttattttaacatatcatttaggaatcataccatagtttgcataatggttaattttatgcctgcttcttctattatttacaaatccctttagtttgggctgtgaaatattcaattcccaaaacatcacccaatatctatatgttaaaggcttgttgaattgtattccatctattagttcagagttatttgctattcttgtttaaggacaatgtatgtattaaagagcaactaaaaactcccattactgtttgccaacccagttgtcttttgatttctctgtcaacttacaagtatcaaatatctaagtcacagaacccagagacacatcaaataccccaaataccccatggtagttttcggatgaactctgacagctattggccatttctggtgcaagtca

SEQ ID NO: 154986 - DNA, 613 bp, Homo sapiens
tagaggacccgtgctgttgcgtaggcagatgagctgtataatatgcctcatagggatagtacaaggaaggggtaggctatgtgtttgtcaggggttgagaatgagtgtgaggcgtattataccataagctactagcttgggtgaaggagtgaggaaacttccaggcaggaaacaagacagaagttaacaaaggtgttatggaagaaatgtcaccatttgagcacacctgagctagatctttaggatctatgaggggaggtgggatgaggactgtcataagaatttggggaggaaaatcattgtgtggcagtaatggtctgggcataaagccggcagaaaagccctggggaggtgaagaacaagctagaaacaagcagtaaatgccagcattttagaggtcatttagtcaaacacatatacccgtactttgttgatgatgccccgctggcaatgggtaaaaaagttagttcattttttaagattacatcttacaaaccaaaaactgtatcagcgatgatttctacttcgcttagtttttgtttttaagactaacagatccttcccttgttttgtttttgtttttagacaaggtatcactctgtcatccaagcta

SEQ ID NO: 154987 - DNA, 280 bp, Homo sapiens
gacaacattgtctaagatctaaacctgagtatctccagcttttcctgatgataagaatcacttgtacccacatctgtaatcacagattcctgggccacctcctccccaggagcttgtgatctaagtgattgctcctgctccaagcaaggaggttgagttgcttccttgtagctcattggtcctctctttcctctgtgaggcctattcacccaaagtacctctttcctaagaggcttctcttcccaaacccctgaggctctcagctctgctcaccattcag

SEQ ID NO: 154988 - DNA, 461 bp, Homo sapiens
cctgattagaccagtacaaagtacaccctgtctttttgtttggggctagaaagattcatacagatactgggagacatgctttgatcgtttaaatttgattttcctatttaaaagtatttggcttagggatttcttacattttcaaggcttaaaaaaactggatccttcccagcctctgagtttgttgggtgcttggagtggtgtcctttgtgagtccttaggacctaacaaatgaggctggctcctaaatggtgtgttgtagaagaaagagtgttttctaatgagtgtgggaagccagaggcaccatcagcccggccagagaaagttccctctccatttccaagaaaaataattaaaaaaaaaaacttcattctaaaccaaaacagagttggattgggcttgcaggctctatggggtatgttatgccacagttgtctacatgttgccaccaacataaaaca

SEQ ID NO: 154989 - DNA, 595 bp, Homo sapiens
ttaataggaaaaaatcctccagtaagctttttgagtgtatttaggtcttttccagtagagagaacatactgctatttggaggtagtaaaagttattcaagtggtgttcctttcaataaatttcttttcaacatccaagttgcaagccttctcttcagttttcttatgtccttgaaccacaaaggacagttgagtccagaatgatatcagtgtgattggatccaggcttataaaccaaataggtttttactgatcatgatcacaaccaattgacactttctttttcaccatgtatactatgtcagtgaggtacccacagaggttgtcttgtcaacagacagacattcaggtccttcttggggaacaaaagactttcatatcacgtttttttgcatgtgatgcttgtatgcagaacctatggactattttctacatagaaggtctatagcacacaatttaaattggcctgagaccagtgtaattacttaacttggttgcatgcccaggtccgtttcatgacacataccagtgacaaatgttctcattgcaagaagcttttgagtattttcccccttttgtttcttaatacattatca

SEQ ID NO: 154990 - DNA, 294 bp, Homo sapiens
accatagaatacacattctattcaacagtgcatggaactttctccaaaatagaccatatgataggctataaaacaagccttaatacatttaagaaaattgaaattatatcaagcactatctcagaccacagtggaataaaacaaaatcaactccaaaaggaagcttcaaaaccatgcaaatattaggaaattaaataatctgctcctgaatgagcactgggtcaaaaacaaaatcaagatggaaattaaaaacttcttcaaactgaatgacaatagacaacccatcaaaacctc

SEQ ID NO: 154991 - DNA, 437 bp, Homo sapiens
cagagaggacatttctgcaccctgcccccctactaggtcaggcctgccattattatcaccccctccccagtgtcctaaactcctccttcatggcaagcatcacattcaacatgattttgtgtgtgtgcaattatctgtttaaataaatctttctctctgaggaccaggactgtcctccttcgacatgacatcactagcgtcagtcgcaatgggagcttgagggagcacgtatgatgtgcagaacactatcctgggcactggaggggaacgtgacagtgagggacccacctggtccttgggacctcacaggtttgttcatagacctatactgaaacactcatgcctgcagtggccatgacacatcatggggtacaaagtccgttctatagtgcatgtgggcctcggctactgtgcagagcttctgcttgtaaacttcc

SEQ ID NO: 154992 - DNA, 426 bp, Homo sapiens
ataaaagcttttcctcaaataaaaaacacatcacaaatgcccaatctcatcacttgcattcaacatagtactggaagttttcaccacagcaataaggcaagaaaataaaaagcatttaacttggaaagagttattatttatttatttatttattttttaaacatgacatgatcatatgtacagaaaactcttaagaatttcaccaaaaacaagtctacaaaaggaattaaatatcactggaggagacaaatgcaacaaaaacaaattagtaatatttctataatgaaacagcaagctatctgacacaaatcaagaaaacaatcccatttacaatatctaacaaaaaataaaatatttagaattaaattacccaaggaattttaatgcctacacaccaaatattaaaaatttttacttttattgcat

SEQ ID NO: 154993 - DNA, 362 bp, Homo sapiens
ctgaccatgtgactgaggtcggtcagtggatgtaggagttaaaagattaattgcagaaaagaaggagtcagtagggaaagggagagaaaaagaaaaggaagaccgaaggaaaaaagggattgctggcagagaggaggagctggagccccacaacaaaacagtggatcaggcagctggcctgagatgctgattcagcgctttaacaaatcaatgccactagaaaagcacaatgtgagccctcactgggtagatgtcaggggactcagaaaatgcattctcaagtatttcacattaagagggaataatgtgttaatttataacgcttcaccctatacacttggattatctatctgtgtcagcga

SEQ ID NO: 154994 - DNA, 204 bp, Homo sapiens
aacaattttggaaagctgagaacagagttgtaggaggagagccaagaaaaagtgtttggaaaccttgagtgaaggtgagtaacatgaacatttattttcctagagaaaggagaaatgtaagaatataaaaggggcataaatcgaaactatatttctgcaaagtattttggcaatgtatagttaacaaaggcctctaagatgccc

SEQ ID NO: 154995 - DNA, 495 bp, Homo sapiens
  misc_feature (275)..(275): n is a, c, g, or t
  misc_feature (279)..(279): n is a, c, g, or t
  misc_feature (349)..(349): n is a, c, g, or t
ggaatttcaacttttacaggagagcattgatgactccaagggagtaatgtaatccgacttgtattttagaaagatcactctgacaataatgtcaaatggattggaatattgggagcataattagagacagggtctcgctatgttgcccaggctggagtgcagtggctattcacaggcaaattgcctaaaatctgctatgattctacagtaaatagctcagggtatttctatttatcactactaaaagggcaccatagtatgttttggtactttangcantaaacactgcttggtttatcattttgttattaaattagaacaagaacatcaaatggatttgctgcactanttattctttgtactgttgagcaacttggtgtgcttatatgttgtgttggttgaaaaactcatccgttttattgtcttgtaatatgaagttagaatgcctttttatatttgtatattctgaaaatgtctgtggaatgttttggtatt

SEQ ID NO: 154996 - DNA, 412 bp, Homo sapiens
ttttcctgatgtccctggacacttctcctttggaaaagaacgatacattattcaagagatgggaaaagcgagagaaatagggctcagtccccctcacaaaaatctggttcatagaacccagaattttggagctagaaaatgcctgagtagagcccagctctcattctgcaggcaaggaaactgaggcatgaggaggttaagtggcttagcagctagctaatgggaaaatcagcagtcaaacatgagtctctttcttcctctcccagcacatccatcagtaaatcacattttctcttttcttggtggtgcaggccagtgtttaaggtgagggattatgattactaagagactaggcattttaaagaccctttgctaatcacaaatttttgcaaagtttacatcaggctctttt

SEQ ID NO: 154997 - DNA, 327 bp, Homo sapiens
gcacttggcagttgaatgggggaggagactacactttcagaaatctgagatggctgagtcacacaggtttgcaaactgatatgggacctagccatgcctccctccacagagttggtatggtaagggtgtggtgtatttccctaccagacctctgcccaagggagaccagcgaccccaaagacataagaacaacagtagcaacatgacgggcatagtgccagtgattggaggtggccgccttaagtcccagagtagacctggcgagggtgtcatctgtctccccttcaaaccgcatgacacagctacaaacaccagaggagccaaatg

SEQ ID NO: 154998 - DNA, 232 bp, Homo sapiens
gcctcacctggtcgcaagtctctactcattcattgtgtgaagatgacactcaaaccactatctgcctcagattccaaacttcctgatggaaacaaatcaaatctttctctgccaggactttgttaagataaaaagcatccaataaacagaacctagaaggctgggcatggtggctcacgcctgtaatcccacaactctgggagaccgaggccggtggatcacctgaggttcg

SEQ ID NO: 154999 - DNA, 484 bp, Homo sapiens
tcaagttgggagacttttgctttcagtaatggcagtctcagtgaccccaagaaattctcctgctggggacaacaagagaaactagtcaaaatataaatatgacttacagcagacatcaaaaaaaattttaaaggtaaaaaattacacagctggaatccaggggatgagataggtgcatgaagatgagcccagaactgggggcctcttttcttctgtgggcatttgctaataccagacgggggtcagctaagaggctaagaactttcgacaacctcacaaacctaaaacagacaccagaatccagagcccacaaagtggaagaagcctcacaaatctttcaacatccttcccccaacacactttaatttgtttgggaaatccaaagaaccacaccatgggaataagagtgaatcagacatggacagtcagtccctgaacatgaattaaagtgatctgagtattgtataaagcggggatcctctag

SEQ ID NO: 155000 - DNA, 315 bp, Homo sapiens
atgcaggacaggaacgctgaggttaaatacaaactgacaacaaaaatcataagaataatatgtaaaagcaagtatgaagcctttgtatttgcttgcgacttgcagtttgaatagcaaaatgatctttcacatcaggctcagtgtgttaaatccagccttaggcaagaataagcaaatattgtttccatatgacaagcctttagctgctagtgaaatgctttctttgtagtgaactgtaggcacaaactatcagcagatgactgtgtatctgagcatatctttaaccacagttagctacaaattatttatagaggt

SEQ ID NO: 155001 - DNA, 357 bp, Homo sapiens
acccgggaggcagaggttgcagtgagccgagatcatgccactgcactccagcctgggcaacagcacaggactctgtctcaaaaaaaaaaaaaaaaaaagtgggtgtgtagccacacatttgtgtttatctacacccagcagatagcacagcctctgccatgtttctttatgttgtggatgacatgccaacttcatctatgcgttgcactgcagcccccagagaaagcttttgcacacagaggggcactgaggtcagagggactatctctgtccttaggagacggcagccctggggtcccaccatgacactccctggcagccaggtgaccaggccacaccacagtctgggttctttct

SEQ ID NO: 155002 - DNA, 602 bp, Homo sapiens
gatgaaggagaatttccttattgctcaagagctgtgctcacatgtttaggagtaaggtttcatgatgtccacttcgaagcagtttagaaaatatgtgtatgaaatacggcaaaatattaactgttattgaatctagatggtgggttttgggatgttcatgacattatttttctacttttctgaatgtttgaaatgtttcagactgtgtgagtgatgataataatggagtcatctcagggagagaagtactgaggggcatcgtaggtcttcctgagcctgccttgtagtttgggagaaggctttgctggaagagagccacacaggtggtgggtggggtccacaatgaagtggaattcacctgcccggaggtcctgatggctcaccaagccacacagaggcattttcccaggctcgtccatgaatggtctcgtaatagctgtgggagaggacttcccactgttacgcaccagaccacagactcccgttggcagctgtggggaagctcaagtcgccttagctatgaatcccctggaaaacaagtgaggctggatagttttacagtaaaatctctcattgaatatttgctctcagtgtcttgggac

SEQ ID NO: 155003 - DNA, 362 bp, Homo sapiens
tgctgtgagaagtatctgtgtccctagaacctccaggccacacaaaacatcccaccccctgaagcccgggggtctagagcctgtcttctgtgtgcagtcttccaccggcgtcagcctacgtggctggcaactccccacaggtgactcacctggacctcaccggcatcgttttcaatggtggggctgggctggggctcactctccctgccctggtgcaggtgagatggaccctgggggcagagcagaagactccgctttcaaaacactctatccccaggagcgtgcagcatgagctcatacctgcctgggctgcaggctttgtttcatgattgctgtcattttccaatttaagcatcttaatg

SEQ ID NO: 155004 - DNA, 424 bp, Homo sapiens
tgctgtggggacccacagttttagtaaaaatcatcacatctgccagagcaggagttcaccttcaaaccacatgctggccactgtgctgagcccctggcatggctcacctcgatgaccactcacactgctactgtgaggaggatgaacatcatccccattttgcagatgagaaaactgaggcacagagaaggaagtgtcttgaccaaggttgcacagccaatgagaatggtgcccaaatttgaacctccagagtgtatgctttcaatgactagaatgtgcatcctctggacaacaaatataacttgcttagctcagtgcctggcatccgggaagtgctaaataattgttagttcttgttattgttatccataataagataggcagtggcatctacctcttggaaattctgggcgtcagttgtctc

SEQ ID NO: 155005 - DNA, 263 bp, Homo sapiens
ggattcattttcccttgcagccatttcaccctgtggacatggcctaggctcaatgtgtgagtgtggggtggccactcctggcttttggagcaggatggtcctctatgagtgggatgttccacacacggcaggaggttttaacatccttgagtgagtccacaaaatgccagtcatgtggcagtcaaaaattccccccgcatttccacctgggagtggtactgcccatttgagagctggtagggtaataggcaaatgaaggggga

SEQ ID NO: 155006 - DNA, 360 bp, Homo sapiens
tcctgctctccctaccttcacctccttggggtgaccagccattgcatttctctccccgataaggtactctctatctcatcaccccatttatttcctttgatttgttcatttattgacctcctactaagcaccaggcactggaacacaacatgaacaaaacagactaaaatctctgccttgaggagctgatgtttaggaggaatccagcaactaacacattaatgcacaacagaaagaacagctcaccctcaaatgtccaaagaaaattttgttttctgttcagtataacatagaaggatgaagattaagagcacgaagtttggagtcagaaagacccagttctctgcctttttttttttt

SEQ ID NO: 155007 - DNA, 518 bp, Homo sapiens
ccacattgaatttaactgtcacatctccttagtctcctctggtcagtaacaaattctcagacttcccttgtttctgatgacctcaatcgttttaaacaatatagatcaggtatcttatagaatatggctcagtgtggatgtatgtgatatttttctcagagtttgcatgggatcatgagttttggggaggaacaccgcagaggtgaagtggcatcttcatcgcatcatatcaggggtatgtgctgttgaaatgacttcacggatagtaaccttggtcacctggctcgaggtagtgtctgccaggtttctccactgtaaagtcacttttccccactttccttatctactctttggaagcaagtcacctagatcagcccactctcaagaggcactgtaaatagtttttaaaattttatttttaattgacaaataattgtacatatttatggggtacaagtgatgttttgatagatgttgacaatgtggaatgattaaactgggctaattaacaaatccat

SEQ ID NO: 155008 - DNA, 459 bp, Homo sapiens
tttgccctgagtgaattcaaagaaagcacaactttactctgtgccagcagtttcatctacaggccagtcacactttccatttcgtaaaatacagctaaaatgtcccaaataaacatttattttgaacctacttccattttctactcctgccttctgctcagcagatgagcatatctcatacttcatagaaaaaattaaagctatctgtgtgatttactcaaattccaacccttatagttacaaaatctatctaatctgtatttgaaataattcttatttctttcactgaagtttcagaggaagagctatcttttccctgttcaaggataattgttttaatgtctttctgtatctctaataatctatttcaacacttattctgtcttcattctgtttttttcagtcattctttgtatattcattcttttacataatctatatagacatgttaagaattta

SEQ ID NO: 155009 - DNA, 433 bp, Homo sapiens
ttcgagctccgaccctacccacaaaccctctctcattgccttttgttaatgtttttccttcccctaaaacacacaactcgcccaactttacaacacaattgtgacaacgaaactgatgtgaggcttgaggacttgttaataaatagactgacttactaagcttgtactttacaaccataaaacatttagttcttaactatttattcataagcacaaaggtagaacatttgaaaatacacattttgatgttattctcattaccctaagcagagaacttcagtactgtgaaataacactaccatctgaccaactgggagaaaaaaggttaaagcacagtcacatgccataaagtactcagactgcaagaccaccagcaaaaggggagggaaccagtgcaggagaaaaaggcaagtcagaagcctacatacaaatc

SEQ ID NO: 155010 - DNA, 252 bp, Homo sapiens
tcgtgatgggcacagaaattagtttttaaatttcctgattctcgatcttccttgttggtggaagctttaaactggaacgtgaacttttttgctctgtgcttactttataaaagtgctgctgtgtgaaatggagaaagttacggcgtgtaggggagtgagactcaagtttatagtctggcgccatcagctcacaggtgtaggactttgggcaggtatttatcactagaatttctgtgcccacttaggaaaaag

SEQ ID NO: 155011 - DNA, 364 bp, Homo sapiens
gagctgagatggcgccactgcattccagtgtgggtgacagactgagactctgtctccaaacaaaaacaaaaacaaaaacaaaaaacaaaaattagctggatgtggtggcacacacctgtagtcccacctactggggaggctgagacaggagaatagcttgaacctgggaggcagaggttacagcaagccgagattgcgccactgcactccagcctaggtgacagagtgagagtccatcacgcacacacacacacgaaatcatcaatctcatagaaagcaccgatttccacactgtcagttctctgtgcctcagtttccccttctctaaaagaaatctaagtacctactgagacaaagggaaaca

SEQ ID NO: 155012 - DNA, 355 bp, Homo sapiens
ctcaggtcaggtgatgattctggaagacaatgatggcaatgtaaaggccttggaagattaaatcattcattctgctatccacccattcactcaacacttatcgtaacatattggattgtgctggggcaggaattacggaagtaaaaaagtcatggtctctgtccatttagtgatggacagacatgtaaacaaccataccacaatgtgataaatgctacaagagagaaatgtacaaaaccctttggcaatgcaggtgtgaatcattctctctcaaagaatccaggaagctttcaaggaaggttacatctgggctagattttgaagcataaacagaattttggtaggtgaaaagtga

SEQ ID NO: 155013 - DNA, 294 bp, Homo sapiens
tgatctaaaggttcttggaagaaaggcatgtccatgtgtggttccatctgcagcaccatttggagtttaatagcttctaggcaagaagagataaattttacaagaaggtttagaatatagggtttgaatatgaatattaagaatcccgctgggagccaagatggccgaataggaacagctccggtctacagctcccagcgtgagcgacacagaagacgggtgatttctgcatttccatctgaggtaccgggttcatctcactagggagtgccagacagtgggcgcaggtcagtg

SEQ ID NO: 155014 - DNA, 377 bp, Homo sapiens
ccagtgagaacaagacttggatcacaccactttaagtgcagattccagcaactcctgaaaggcttggcctccaatttccattctgatgggtcagattagagaatctccagtgaagctgtcagaacattctaatgtttgcaaattgtgaaagttcaagcaagagtcaaccatgtgggaaagaagggagggcggctcttagaatgttgtggtcttggaccacttaagaaaaacaatcaaaaatcactttcaacacccacgccttctttcggaaggagaaaaacattaaaaatcactgcctattggggggaaaagtggtataaatcattttatttcatgctccatcatttactcagcacaaacttcagtgacacctcctg

SEQ ID NO: 155015 - DNA, 264 bp, Homo sapiens
atcacaagccatccctgtacttgcaggaccctgagggggagtgcccccttaagagtgaggtaggagtgccctgttacattttgcatcttagacctctcttgcctcaatctcaccctggaggtgacagcatggctggtgatggctgtaatgagggatataagcctgcctgtagcttggaaagcatgttttgtcctcagaatcctcatacaggctgggcgcggtggctaacatctctaatcccaacactttgggaggccaaggcag

SEQ ID NO: 155016 - DNA, 125 bp, Homo sapiens
caaaatgccacaagcatgcactacttttctccttttctatctttagtaccatagctaatgtctagggaaaaaaaagaaaaaagggaacattccactaatcaataaaattcatgacaacacaaagg

SEQ ID NO: 155017 - DNA, 591 bp, Homo sapiens
attatcaaggtaagtgttgagacataaaattgttatgctaagatatgaaaaaatatcaaactaacaaacctgcctgctgccattttcaactttggcaaccaacaaacacaaacaaaaggctgaaaagtgagtttcaatgacagtttgccatcatgtgacgacatataatgcaaaaccccagatactatgcaggtggcatcaaagtagaatatatctggttcagggccaacacaggtacatcaatattcccatctcataatactattaaacaggccacaatgagaaagatctaggataatttgtgagcttatagaccccatactcatttttaaaaaatggttgtgttagactgggtgtggtggctcacgcctgtaatcccaacactttgggagtctgaggtgggcagatcacctgaggtcaggagttcgagaccagcctggtcaacttggcgaaaccccaaccctactaaaaatacaaaaactagccaggcgtagtggagtgtgcctgtaatcccagctactagggaggctgagacaggagaatcctttgaacccggggaggtagagattgcagtgagctgagattgcagca

SEQ ID NO: 155018 - DNA, 480 bp, Homo sapiens
gtctcttcagaataaaaatgagggtaattagactcaattcatttattcaacacttgggtcaagtccatgaactctacaaagataactgtgccatggattttgctctctagagtggtaagacacgtatatggtttgtctactcattcagcaaacactttctgggcatgttttgtctcctgaggtcagctctggagatacaatggtacatggcacaaatctttgcaagtgctaaatataatacctgatattaataggctgtgagtgaagagcacaaaatgtgtagtgggtgttcctgggatacagtagctctgtgcatgtagaagggattagtaagggcctcgtgaaggagacagcatttgttctgggacttgaaggaaagacaggattggaaatgtagagatgctaaggaaggttgtcctcaatagagaaaatgccatagctgaaggcccctcatatgctattcttatctaactatgtgat

SEQ ID NO: 155019 - DNA, 252 bp, Homo sapiens
ctcggaccccctttgtctgtaagtattatatttcactctaaaaatgtccaagaatgctctgcttctccctctccttgcctccacctgcttcctttctctctcccttccccctcttggcaaaaataaaaaataaaaataaaaaaaagaacgggcgcagtgcctcacaccagcaccttgggagatggaggttggcaaatcacttgaggccaggagatcaagaccagcctggccaacatggcaaaacccagtctc

SEQ ID NO: 155020 - DNA, 369 bp, Homo sapiens
tgtgtcatttttttagaattagaaatgacaaagtggtatattccttttggaaaatttttacttaaatgacatgcagcataaatgaagaaaaacctgagtaagaaaactataagataagcatcattgaatagcattcttatcagttattaaatcagtaattagtaatttaatcataaacatatttgagtactatagttagtttatgttcttctggtctggttatttggtttaatgttctgaaatattttcttagactattttgtcaatatatttgtaccctttgttaatatttctttgacgtataactacaaatatagatgagtcatccttccttccttttgtttttttgtttttttttgtttttgtttt

SEQ ID NO: 155021 - DNA, 379 bp, Homo sapiens
aaaagaagagtttgacatgacagataacaccaaagacagcttattgcaaggaaaaaaagtaacagaaccagaagtttaaaactgaaagataccttttaggttcatgtatctcactttacagatagagtcaaggtaagaaagataacccctggtgcaatcttattagtggtcagactaaaacaacatatcacttttcccctactagacattaccataaatatttttttatttttcgtggaagtataaattgctacaatcttatacctagcaacttgggcccacagattttatttttaagaatttactgtgcagaaatacaagtttgcaaagacaattaaaaatggatgtttccttcagcattgcttgtaataaaaaaatg

SEQ ID NO: 155022 - DNA, 164 bp, Homo sapiens
cagccactggcttttcctctccacttcgtgtaagtttggagttctggcctgtaaattaggtcatcaaccacttcaccttgaaaggagaaaaacacgaagagcttaagcagtttatctatgctcttacagctctttagtgtcagagcagtgtgttcacctagaaa

SEQ ID NO: 155023 - DNA, 187 bp, Homo sapiens
gcagactcagcggccggctctaccggcgtcccggctcgggcagcgccgaggggcgctcctggtccagctctcctggctcgggggttccttgccgaggcgcccgcgccccgggctcccagcctcggccgccgcggccccgatgccgaggcatggatagagcagcgctgcgcgcggcggcgatgggaga

SEQ ID NO: 155024 - DNA, 450 bp, Homo sapiens
tacttaagagtgtgaagtggccagtcatggtgtctcacacctgtaatcccagcactctgggaggccaaagtgtaaggactgcttgattccaggagttcaagagcagcctggacaacacagcaaggtctttttctacatacatgcacacacacacacgcacacatacacatgcacacaagggaaaaaaatttaaaatatataaaaagagagttaaatgggaaagaaacttgcactcaggccatttgtggttataccaatatgaccaggcatccaggtggcaaatcacactgggccttaatttttggccttacactacatcgtagctgacaccatccagagtgtatggcccattcaaaccgatccaatattaccacagaactgcaattctattggatcctaaaaggagcggtggtctcaagtaattctgtgaggacctccttgcatggctcc

SEQ ID NO: 155025 - DNA, 357 bp, Homo sapiens
agtaagtgttgaaaatgaaggctgcagtgcaaaacgaggaaaagaatagaactgcttttcacaaagacttttttttatactttttaatattatgctacaaaagatttttctagacccagagcagtggctcacacctgtaatcccagcactttgggaggccgaggcaggcagatcacttgaggtcggcagttcgagaccagcctggctaatgtggtgaaaccccaactctactaaaagcacaaaaaattagccgggtgtgttggtgcatgcctgtaatcccagctactcaggaggctgaggcagaagaattgtttgaacccagaaggcagaggttacagtgagctgagatcacaccac

SEQ ID NO: 155026 - DNA, 1604 bp, Homo sapiens
gtcattataaaaatattagatcacattttcaaaaattaacttttgaagaaactgctgtgttttaagaaaatgaaagttagtaggataaattctctgtaaaacgtccagaacaaatgtatgaacataatatgtggttattaccatgataaatgtgcacaacagcttagaaaaatgttaaatagttgtgaatgtagaaatggtggtagccatgaatatggcccaggccagttataccaatggctaggtaatagtgagaaattataatagcaatctctaagatgatactaaaacaaaatgttactttctaagaattaacattactaggattatgaaacaactccaatttaaatgggaatttaggttctcaaatattctagtataacaggtgttcctttcattagtatggctgctcaaagaatatgaaatggatttctatctggtagtaatattcttaaattcacacaattaccatgcttcggtggaaattgaaggaggtcattattttgaaggtccaacatggttagattttctgtcatcttcattttcggagggtccacaagatacaatctgatcgttactaatcaaaactgttttaaatgtgaatgtatgttgtagaacttaaggtagtattttgaactagatagttttaactggccgcctttccagactgcctttaacagcccctgggttatggaggtattgcattctcttctattaacgttgaaacttacctggggaccccaccccactcttctactgccatatgttcaaacttttatacagctttttttctgttttaaaatcttgtttttgttgtgattttattaggatctaaatcctaataaaaaccatattactgagttttcataattttttcttttttccgtttttcccctattctaaccctaatatatgatatatcttaattatatcgtattaaagagacaggatcttgctatattgcccaggctggactagaactcctggcctctgccttgtgagtagctgggacgacaggtacacaccaccgtatctatcttcagattttttttttttaccccatttcttaaattgttatgtcatatttcattgttttatccaaacatgacaattagttgccatttactagaatttaacagaatgtttagatttctcaggatttctatgatgttgtagaacttttctggttttgcctatttcttaagccatagtgagttttatttggttataatctgtgaaaaaattttcgtatcctaaaatagatgatagtttggaatcatttcttgattccttgacctttccattataagtatttcctatatctattcatctcttttgttatacttggaattacttgggattttcactttttcattattgtaattcaaaacagccaagaacagcaagccatttaaatatgaagggtgttgattccatttttctcctgtccagaaatacagttgccacgtctacatgtgttctaatttgagaggttttttttttttttatttagttcttgggggctggcaggggaagtctgttttgggtactaaaagtgcttgcttttttatgtaaggagtttgtctctgtgtgtgtgtgtgtgt

SEQ ID NO: 155027 - DNA, 287 bp, Homo sapiens
cttcctttagatcttgacttaaatgtcacctcctcagaaagacctttgtcagcagctctcccacagtataccctctcccatgtttctggtcccccgtgagttttctttccatagatctacatgagttgcaaatttatatatttgtggttgacttgcttcttgtctctcttccccattgggctttaggcttcagaacaggtgagacattgtatcactcatcactgaatgcccagggtctaacacatagtagatgctcaacaaatcacccactgaatgaatggttggtg

SEQ ID NO: 155028 - DNA, 1031 bp, Homo sapiens
ttactacatgttatccaacagcctttttcatttcctcttttgcaagctgtcagctcacgctgcttgcccatttaccttctggctaaaccaaacactcgcttgggaccagctcatgatgagcatactttacttctaccatttatttttaggaaatgagaaaaattccattccaaagccataaagctttggtttaccaacatccttacattaaaagagaagtggacagtcttcttatgttcgatatttagaaacgacaagggtaagggcctgcagcaagtgcccagcatggggccggagaaatgcgcacatcttcacgtttcccacaccaggcagcctaagaacgaaggtcactcagcccagacgcaggcctccagatgacgccccaccctgccacctgttccgcctgtgtctctctacacagatgcatttctgccagctgctgagaacttcttcattaaaaggcatgtgctgggtgctaagattttcatattttttcaaactatgcttggaattcaaaaattatacgtcattaaactacatgcccaactcctgtcccacacagatgaaagtgttagtgttatgtccgtgattcctggactatgtggtaatttaaacacttcttagaaagaaaaagcctcatcacaactcagtcagcagtagaaaagggtgagtcacattctgtttttagtgcatgatgtgacaagaccctactaccacagaagtactcccgcaaaaattctttgagatacaaagcaaaaaccaagggaatgattcaatagatatgaaggaaacactctcctagagaaacatgacaagctgaatcgcaaaagggaggcaggaaattaaaacagcaaacgtcatacatgcgagccagggaactccctaaatgatgctgcagacactttcccctggagagaagatactgtcaaagtcatgtgagtgggtccccaaaaggactcaactttctaaaaaccaaagggaatctataaaaagggagcaaacatccagtgtattaggctctaaaggaccaa

SEQ ID NO: 155029 - DNA, 167 bp, Homo sapiens
gtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatactt

SEQ ID NO: 155030 - DNA, 310 bp, Homo sapiens
cagcctgggcaacagagcgggctccgtctcaaaaataataataataataaataataataaaaggacagcccacagaatgggagaaaatatttgcaagttagttatctaataaaaatctagtgttcagaacataaaaagaacgttttttagctcagggctaaaaagacaaataaccctaatttaaaatgggcaaaggatttgaatagacacttctccagagaaaacatacaagtggccgaaaagcacatataaatatgctcagcatcattaggtcttagggaaatgcaaatccaaaccacaaaatgctgca

SEQ ID NO: 155031 - DNA, 141 bp, Homo sapiens
atgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggt

SEQ ID NO: 155032 - DNA, 1037 bp, Homo sapiens
ggacacagactgagcagaagagatgagtgccccatgccagcctctttggaagccactgtcaacagagagaggtcacaggacaagcttgggtaaaggcagtccaacccaggcagaagaggaaagtgggaaggcccaggaagaaaggggagaaggcctgaccctgtctaatctggtggccactcactgcatgacactgaattgaaataaataaaattaacagttcagttcctcagctgcaccgttattccagattccacattccaaatgcccggtggccacacatgattaatggctaccacactggtcagtgcagaatggacgtaaacatcgctgcacaaagttctaatggacagcgctgtctagaccatggcctggagccaccagcaaaggggaggcgcatacaggggctggccacataggaagagataggtagagatagagtataactcaggaaaaagaccaggcaaatccttagcagaaatgaggacgtggctcagtctgccaacacagctacccggagcaatccctggtgaaggaaggcagctctagagaatgccagccacaggcacgcgcacggcttgcaaaggggtactttggggaattcccagaattactagtgatgggagccctggcaggtttccttcctcgaagagaggagaactggatccagggatgggcattcaacagcgaagcggcacagctggtttccagaaccgtctcccgggattagacagttctgccgcctgaaccctccgacgatgggcctgccaaccaggccaagcccactgggtcaaagccacaggctgtgctacggccccaccccatggcctcaccagaacacagaaaccagagcccagcagcactggctgggccatgtgttggtggccccccgggactcgctaagagtagcaaaggggagagggaagctctgacacacaccatttctacgacctaaatcagtggcctccctctttcctcctcttgtgtataggtaccgagctgtggatacaggagagaatgaataaaattctaacaca

SEQ ID NO: 155033 - DNA, 239 bp, Homo sapiens
aatactttgatgttatttctattatatttaattatgggagaagtagatttttttcaacttgtttaccaattttcatctatattttagaaagataaaattccttcagcattctgatagcaaacatacaggttttgtcaagagactcacatgaacacctacaaagaactgaaagccaagttcacaatctttgatagtttacatcccagagaacgttcaccctgaacaggattcagaatgag

SEQ ID NO: 155034 - DNA, 669 bp, Homo sapiens
gaaatggcctcccaccttcagcgttcccagtactgacctgctttgttccttccactccaccgctccccacagctttgcctgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggatttcttatgaataaaaaagattctactaaaaaaaatgaataactgtacatatgtgggcatattgtttgaatctgtattctttcactttgatatatttatgaatacttacaccattactactgttttaaaattactgtagctttaaaatcaggtttgaaatctagcagagtaagtcctccaacttattgcttcttcaagaccgacttgcttattctaggttctttgattttcaaatacattttgaaactagctttcaaatttctctaaaatctcctactagaaatattcaacgatggtcctcagctctgtgagcgtcgtctcagcagctccaacctcagcagactgtgtggtgaccactgtggtgctctcctccatctgctgagcccagtacttgtctagctcctctcggttcttcgaggcag

SEQ ID NO: 155035 - DNA, 168 bp, Homo sapiens
tacgtttcttttctacagactttaccccttatttgggatgtgtgaaaaatttttacaggaagtagacttttttcagaggtaagtattttataactcttccggcttataaaatcttggttacacggagtatagcacttgcaggcaataggaacaatcacaaatcacatt

SEQ ID NO: 155036 - DNA, 241 bp, Homo sapiens
caacagctgttgctgatgaagagaaaaggaggcccagtcacttggggatatgagcctacaaatctcaccacctgcctgcttctcagggtgacttatgacctcagtggcagcaggcgaggggccacaatcccatgtggccagggcctgcctctcccctctgtgtcctgtatgccactctctggtccttggccatgcttgcctctcacagctttgccctttgatgtctgcacctccagtcatg

SEQ ID NO: 155037 - DNA, 162 bp, Homo sapiens
caccaggggtatcttattgagtaacaacaaaaatttttagagatgatagtctagaagacattaataaaacaatcacacagttaatatgaagttgtgatggggacgggtgctgatgaggagagggccagaatactttgagaggacatcataggtgaatttgac

SEQ ID NO: 155038 - DNA, 223 bp, Homo sapiens
gtaaaataataataatctataaaccaaaatactgacttcacagaaattgagatagatcaagctgtgagtttaagaaactgaaagaagcaaaggagaggccaacttcaaagtcggcttatgcagtgccttcacaggcattaattgaagcctggtcctgctgttctttaatgccctcttattaatgtcttaagtaatcaacatctccagtaatcccttctgcagc

SEQ ID NO: 155039 - DNA, 217 bp, Homo sapiens
tgttctcctctcatttccaaagatcttactcttccctgctccatctttctcccacttccatctgcattcttcttcattgcctcattgagtagatgaatgctattaaagagtagttcaacagggctacctttccttacatttaataatataaaccacaaataggcactcattactgcccagcaataccatatatttaccctaggaaactctccatccc

SEQ ID NO: 155040 - DNA, 188 bp, Homo sapiens
tggagtcagttctcaaaaacaagaggttcattctgctctgctaaaaccagagggacaacttcactttccatatttatccaaatgtattgataatttggaggatggatctggttgccagaaggaaggtctcaaatgaggaattaagagatgcagatcaatttccaattggtaaataaacactttttttt

SEQ ID NO: 155041 - DNA, 308 bp, Homo sapiens
agttccatgataacagaactgatgactgaatgactttcacaagaaacacgtggagtccagtgagcaccagcaatgaactttcgcaactgcagaaattagtgattgtagctgagttgacacaacagtagctgaacttattaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgagaaactgaataaacat

SEQ ID NO: 155042 - DNA, 338 bp, Homo sapiens
caccgtgccgggccaagttgaacttttctcttgggggaataatttccctgctcaacatagacctggtggaattttcttgtctctctcttccctggcattttctctggtcttaggcaagcatttcctgccttttctgattccctctctgtgtgtgcatgggacttaggggaggaaggaggagggagttttctgttaagggagccgtgaatgagcaggaaatggctatttggtaccagttattctgcagaattagggagtgctgatgctgacaaggagtcagaaggattcagtcatcatgacatctgcagtcacaactgggtgggttagtgagcgcccct

SEQ ID NO: 155043 - DNA, 258 bp, Homo sapiens
atggcagtgtcctgggggagtgttcacagaggatatgcgattggtaagaaccttccaggacagaaaagcaaggcatccccttaacaggacttcctattcatgcagcctttagatcttatgtgacctcatgacaactggctgagccaggaagggttttccttctagggtatgaaggaaaggagaggcgaatttgacctgcccctcatgccatgtggaaggactgggatgggaggacaggccatctgctcccaagatcaa

SEQ ID NO: 155044 - DNA, 196 bp, Homo sapiens
catctgcagctcccaaactgcctacatctcgaatgatgctggcagtgcacacagagcctgcagctcccgaagtgcctttggctccaacaaagccaacagctcaactgatggccacagctcaaaaaacagttgtgaatcaaccagtgttggtagctcaagtggaacccacaactccaaaaactccccaggctcagaa

SEQ ID NO: 155045 - DNA, 370 bp, Homo sapiens
gtgagcaaacctccagagcgctcccagcacaactttctttttctgggagttctgctctgccaattccagccacattagcctccgctgacttgcagctccatctccccagctcagagagaccacgggcctccacctgggttttcccttcttggaaactctatcctggggcaatcatacagctcaccatctgtttctcctcttgcaaggatcactgtccatgcctaaggcccaatgtcttggaaacctagttttcaaactgtttcagctgggagggtaaatccagaccttgttactcagtcttggccagaagtgaaaattccactgcattggttcatttgtaatttttccagagcatgggctaacagcagct

SEQ ID NO: 155046 - DNA, 344 bp, Homo sapiens
gctgtatacatgccccacccgttagtcacttcgttctcagttctcagatagaaaatccaagctagtacagctctatcatggaagagtgctttcttatcctgagctgcaatccttctcactgacttctaaccctccagttctatttcttcagctttcagatatctaaaaatctcttttccaggctaaatccctttccttcaaccaactctttttttttttttccacccaatctggagtgcagtgtgtgaggaccagccagcacctgcttcatgcagtgcctgtgaattgtaaacagaggtaaatttgctgtagcaagttaaacttcttggcctacagaaagttga

SEQ ID NO: 155047 - DNA, 372 bp, Homo sapiens
cccaaaagagtacacaaaagagtagagacgaagggcctagatcctgaaggctgagagaagactctacacattgagaagaccttgactttctgtgtcacagtttcttaacgcaattgccaacttctaagcagcacataggtaggatgagacacaacactgagaaatcaagcagaaagtagctgctaggagccttaaaagctaagcagagatttttttttgcagtctcacaaggccttagggacaaaaatttgactggagggccagccgagaagaaggtacctgggaaatacccctaagctttcaattgagatcccagaaatgctactccttaggaagagtaagaacaaacaagggatagactagtctcaacac

SEQ ID NO: 155048 - DNA, 723 bp, Homo sapiens
ccctcctcacgaaaaagggaataaagcttcctcccagacaaaatgtactgcttgagcagcactcccatagcacttgatcactttgataagattgcacatttagttgcctgtcttttctgctagaccttcagctccacaacatcatcaaggacaggaccatgtgtcttttgctcaccagttacctcaggattagcagagacaggctcttaacatgcacacatcaaaataaaccatcagtcgattaatgactcattcttctgttcattccaagggaaatcgtctattgctaacataaaaaagttacttgaataaggacgatttatagagttgtcacgcttaggactcttcggataggttggctgagataatttaagacttttaaaaacctgtagaaaagaatattactgaatcttatttcaataggtgagtgttattcatattggttatatttctttattttgactgaggcagagagcacagaggaagactgggagaggggaggaggtagaggtgagagggagaggaaaaagtaaaaaagaattgattctcgaaaggtataaaatatatggttagcagagattaaacagactcttaacttaggttttatttgtaaatatcccaaataacttaaaaattgttagcagggagactttatttctatttgacaactcacgcacacacaattcccgagttattttgtcctcagttcttcaggagatatag

SEQ ID NO: 155049 - DNA, 203 bp, Homo sapiens
ctgcgcagcagcagcctttaaacccggacccagccggggaaaacctgattgacacggacgcccgaacacgtgggatagcctgggaaaccaaacccggcgtggatgcggagacccagccccgagagaggaggaattccttcggggtttctccctttctcgggcgtccgggaaagctcctgcggttcacttgcgcctcctccagg

SEQ ID NO: 155050 - DNA, 506 bp, Homo sapiens
ttgtaggctgttcacccttaaggctcccagacttcgagggaggaatcagaggcaactgcaataaacggcaagaaccttcctgtctgggggtgactgcaacctggctgagtgcattcctgttttctttcttgcaatgggctactgccttgcatttctctttttggttctaatattaagctcaaaaatgatcttctcttgttttgtaaaggctcattaaggggcaatgtctcttcagtttaggaaacctgcatgcttgcatctctaatactgatggtgatgtttttagctttttcttgatagtgacgttttacagtaaggaattaatggctttaatagcaatagattccagggaaattcaaaaataaggttcataaaatgaagagggtttataatttttatttccatacattcaggttgaaaaacagtcatgaaatttaaatatgacaatctcataactagcttattaatgaccattcctgaaaatattgccgccatcctagttctct

SEQ ID NO: 155051 - DNA, 314 bp, Homo sapiens
tgctatgtgctggtgccctttgacttgctgggtgttgggagctgaaggactgtgtgctttcctcagcatcttctcaagctgcaattccttggctacaatgtgggctttaaaaaacaacaactatttattttgtagagatagcatgtcacctaggttggtctcaaactcctggctcgagtgatcctcttgcttcagcctcccgagtagctgagaacacaggcatgcagcactacgacctgctaatttttgtgtttttgtttgttttgagacagagtcttgctctgtcgcccaggctggagtgcagtggtgtgatc

SEQ ID NO: 155052 - DNA, 461 bp, Homo sapiens
agccagaagaaaaggcaagtctcaagatgtatgagacagaaaacactgtaattcctttttatcctaccataataattatgatacaaataaattataattataggttgaaatcttttctcagataaataaaagccacaacctgtccaaaatgtgacaagatccaaaagttattttctataactaagacaggacaaatattgattgatctttggagaaaagcaaaaatagtgaatagccttacatattctgactctaaggaaaaggtgaggttcctcaccaagggtaaagattaaaattgaggcagcaggcaggaggtgccacctgctggtaaaacacaaattctcagtattttgactgtgacagagatcagtcttaataggaatttcaactaaccgaattagaggttacttatgtctccaataatagcttcttgagacagatacagaatctgagacttccca

SEQ ID NO: 155053 - DNA, 380 bp, Homo sapiens
gtgagactgagctattcacaaaggctgatgggaatacagacaaaaaggaaactcggggtacaaagctgctgaccttgagttgagcagaatcttaagtcacctgatctgagttcaaatcctggacacgatatctactgaatgcatggttcacctcatgtttctttaccactgtgagcattcgttttctttctcatctcgaaaatggagattataggcgtgagccaccatgcctggcatacataacagttttgaaggaataagaatgacatatgtgggccgggaggctgaggcaggagaattgcttgagcctgggagatggaggttgcagtgagccgagatcatgccactgcactccagcctggccaacagagcgagaccct

SEQ ID NO: 155054 - DNA, 311 bp, Homo sapiens
aatgagacagcattttacaaccactggttggcaaaccttgaagtttaaatgacaccaagtgggtgtacccttataccctgctggtaaaaacatgaaacaatttagaaaataatttggaattagccagtgaagcagaaaaatatacatagttaatataccactcctaggtatacttcctagaaagattcttttgcatgcagccaggaaacatgtacaagaagtttcagagcagtattattttggatagctaaatatccatcacagataaaaaaattctgataaactcacaccattgtaaactacagagcagt

SEQ ID NO: 155055 - DNA, 442 bp, Homo sapiens
ctagaatctaaagctatccgccctctctctgaccacccctttccccattcttgaaatttctttcatttttcttactccgaggtcttttacctctttgccagtatttctcacaaatacttattttacctgcttctaaaatgtttgtgtccacaaaaacacaattccccagtactctccttgcctgctctatgatcttgaactcctggctttaaaaaaataacgaagttggctgggcatcagctgcacgcctgtaatcccaacactctgggaggctgaggtgggtggagcacgtgagatcaggagtttgagaccagtctggtcaacatgctgaaatcccatctctactaaaaatacaaaaaattaggcttggtggcatgcgctggtaatcccagctactcggtaggctgaggcaggagaatagcttgaacctgggaggcagagg

SEQ ID NO: 155056 - DNA, 367 bp, Homo sapiens
catggtttgaggatgagagggccctgcttcaagatgctgctgccattgcttcgcaggcctcttcctgggcccctctgagtgctgccccatccctgggggtctcctgggtctcagaagcacccctcccaacacctcccccaacacacacacacccacacacacacacacacacacacacacactttctctgttctccagcagccttttagctgctaagatgctctttgatacttaggcctttgtttcattttgcgtgtggcttccccaggctgcagtgtgttcgatgactctcccgcccagccatacatccaggcttctgttcccttctccagatggcctttcatccctcccagcctccccctgcacc

SEQ ID NO: 155057 - DNA, 531 bp, Homo sapiens
gataatgaaaatgctctaaaattagattatagtgatagtggcacaactctaaatatactaaaaatcattgaattgtacactttaaattggtggactttatgatatttaagttgcatatcagtaaaattgtatgtcagtaaagtttaaaaaaaaagtggttgtcaaaaaatgaggactgtatgctttttccatctctaatgccagttgaaagaattttagatctaaacaagcaactcaaatcactttataaacttttgccagaactcatcttttttatttggtatgagttcttagaaatagatatatagaatgatatttaacactatttattattattattatttttagagacagggtctctgtgtcaccccaggctggattgcagtggcacaatcctagctcactgtaacctcgaactcctgggctcacgtgatccccccatctcagcctcccaagtagctggaaccacaggcatgcaccatcatgcccagctaatttttgtattttttgcagaggcagggtctcaccctg

SEQ ID NO: 155058 - DNA, 208 bp, Homo sapiens
tatgtaattaaatgaaaatcacatgtagtttattctttgaaccatcattatggaaacgtactacacatgctctcgcccaacatatgagctccaacacagcacttttccagtggtgcagagcagaaatgattcctgatacagcaaacacttccagttagcacctctttccagtaaactaaactaaactgtgcctgtgttttacctgatt

SEQ ID NO: 155059 - DNA, 358 bp, Homo sapiens
tctgtttcatagctttgtaagaattctgtgtctttataagacacagaagcaaggcaggtgctacataaaaaagtaatctcagccaggcacggtggctcacgcctgtaatcccagcactttgggaggctgaggcgggtggatcacaaggtcaggagatcaagaccatcctggctaacacggtgaaaccctgtctctactaaaaatacaaaaattagccgggcgtggtggcgggcgcctgtagtcccagctacgtgggtggctgaggcaggagaatggggtgaacccgggaggcggagcttgcagtgagccaagattgcaccactgtactccagcctgggcgacagagcaagactctgtc

SEQ ID NO: 155060 - DNA, 458 bp, Homo sapiens
atctcatgtagctcaatctctcacttgaccatgtgagattcatttgccaaggctagaatgaaagtctacaaaggaaattcaaaaggcattgccaataaaggactagttaggccattaagtatatttgaaagtgtaatgaggatctaaagggaaattttgtcttattgcatacagtctctcaaagatgttgtatatacattccacacatttataaagcaagtaccatttgccaagcactgtattacaaagtatgtgtcacctgcacttaatctttgtttatgcacaatcatagtgcagtgtctgaaaattacatttagatctgattcttcaaaccataaattaaaataattgaaattccatagtttagaataaaagggacttattaaactaaatatctggatctatttctctgtatttcaaaaccaaacattctttggtacctaatccacatagagtat

SEQ ID NO: 155061 - DNA, 580 bp, Homo sapiens
aggaagaaggtaaaatttgatgtttgcgcttcaatgtgctccgtgttgtttgattggattgccttgtataattccatagctgcttcgcttattaccagttacagcttatgtttgaagtcacaataaactcttcttcaaacatgaaagcttgatttttgaggaaaattattcacattatttacagattcaaagatgtttatgtcctgtactctagaaataaggagaaagtgggtggggatggggcagtcaggtggaatggagtgtcttggcagtgtaaaggaaaaaaaaaaaaaaaaaatttttggggcgccttgggcccctgaaaaagctttctaaaacacatccgtggggcgcggggccccagataggtcaagcacacctgggccaaagcgggtccaaaggaaaacccgcgcaaggacacgggctgggaattcccgcccaaataaaaaaaggccccgggggcgaaaccagaaggcttccgggacaaactccgagaagggacacacgggagggcaccagagggaaccatcacagcggagcccagaggaaccgaaattcaattagccagcacaccgtggat

SEQ ID NO: 155062 - DNA, 225 bp, Homo sapiens
aacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaa

SEQ ID NO: 155063 - DNA, 297 bp, Homo sapiens
agaattgcttgaacccgggaggcagaggttgcagtgggctgagatcatgccactgcactccagcctgggtgacagaacgagactccatctcaaaaaaaggaaaaaaaagtatttccattatgttctgagaggcctatttgctatttcttaacaactgtaggtatttataaaataaaacatgtgcacatcccgatatattattcagcattcaattcctttctcctagtaaaaagaggcaggtagagttttggctacatagctaccattaggaaggaacagaatttgtagttgaaaatt

SEQ ID NO: 155064 - DNA, 911 bp, Homo sapiens
tgaattcctgagcttaagcgacccgcccgctcggcctcccaaagtgttgggattataggtgtaagaccacacctggctgtatgttagtattcttacaacaaaatgtaatcagttgtatggtatttttgctaaatcaactttgtaagcctacttataacagaaatgtccacattattgtgggctattctttgccagacaaattgatggcaaattcataggtatctaatgtcactgcttaattcctgccgtttcaaaaagacagcaaataagcaaaaccacagcattaattcttcatgtaatttaagaaaaatagtgtttctctaactccattaatcatttaaatcccatatggttctcttacagcagtgtgatctagctgcatttcttcactgttaagaactgttaggcgcttctgttggagatagtttctaatgttgaaattatcagtgaatgttcattaattcttcatgttgaagctgtcaccatggaaacttaggtgttatagcaactagttatatgctataacttacttagcattaagatgattaaataacatactatatgtaaagcagttggaagaatcatggaaagcaatgtcatttcttagcagatactactatcattttattcttgttttttggcaagtgtgaaaattaaattcaaatattctttaagatgtatacttctggtcttgagatgtaacatcactttgtgatcttacctaagtcctctgctctgtaggaattacaattgtttacataaagatgctattactatctttggtatgaaactcaaatatttatcaatagatttaccatgatgttttgaaaatcagtgggattggggacagtgacatgtcaaaatcatctaggaattaaaaaagaaaagcacaacactgcttatttaaacac

SEQ ID NO: 155065 - DNA, 259 bp, Homo sapiens
ttaaatgtgtatttggtatttaacattgactttccctaataaagcccttgatcaaacttgatacatttgccaaacacataatgtaaaaactaatagtttaatgtgcccatttttcctctagtgtttgattgctacagtttctaagtaaaacctatttataaacttgtctgatttccaaatgcaaacatttttcttttaaaaaccttaacaatctaattaaagccaagcatgagcacgacttgaaaatgataccaacagt

SEQ ID NO: 155066 - DNA, 233 bp, Homo sapiens
cgtccatgcagattttaggtgtatcctgaatgcggctgaccaggagagaaaagtcagtctgttttctgggctatgatctggataccaagttaatataattacgttatctctcaggccaaattcccccataggagtgtgttgctttatgccctggtaagggacaatggcttctctccatccagacatcgtgggtactttagaaactttccagctctcgagtgaaagcccatgag

SEQ ID NO: 155067 - DNA, 336 bp, Homo sapiens
ccaacagaaaacaggagaaaatctaagaagccagtaagtgtaagaaaagatgatgaactttaccagtaatcagagaaatgttaattgaaacaataagtacataccattttcaatctacgtaattgacaaacgttttaaagtctgacaatgcaaatgatgttgagaatgtggtgggacagtaaactggtccaatcattctggagagcaatttgaccatatctggtaaagctgatggttgtgatactctgaagcatcaattcataatttgtttcaattatagatacattctctagagaaactcaaacctgcatacaagatgactcacagatgactatc

SEQ ID NO: 155068 - DNA, 624 bp, Homo sapiens
tgcttctgcttaggcatttgagttatgcctgggtaacatagggagaccccatgtctaaatagaaataaaaacaagacacatagagaagtttgagaataaaatatagacaacagaataaaaccccacattaacataaatcttggaattctctgaaagttgtataacagtaaatgttactacatatatatagaaataaattcaaaggtaaataataccagcataacaatataaaatattttaaaatattaaatgaacattttgcaactaaaaatacactaactatagcgaattgcttaatgaatgggtttaataccagatatttcatagctaaataattcataaattggaaaataaatgagaaaacaacatacagtcttaagaaaaaaatatagagaaaaggcaatgaagaagcttatagagcttaggttgaaattagacttcccaaggagagataagatagaatggagaagaagctattgaacagataaacacctggaatttttcagagcagattaaagatattgggttacatattggaggagaactatgagcctgaaaccagatataagaaaacatgtttaggcagaaaatattcaaaagactataaaacacatattaaagaaa

SEQ ID NO: 155069 - DNA, 548 bp, Homo sapiens
gtagtatcattatcattattattaaattcatgaaaagacattttcctcttagcagttcataattgcttgataacagtgttatgagaaagtgaactatgtgtattaataaaagatgacagattttgtcattatgtgtatgggaggacaaaggaagcagatgacatttactgttcccctatgatgcaccagacactgtacttactagccaccattgtgtacatgatatctgaacaacattgtgtgatgaaagtattattcatccccattttatagaaaaggaaacaaactcaaaaagattaagacagtatttccatttcataaagcaagtattttatgtagccaggatagaaaaccaggtgtttctgtgtccagaattcataatttgccttttcacctatgaaaataattgataaaaatgagactttgcctcaaacactgcatttaagttacagtattaagatacttgcagcttttctttcctctttattcaggaacaaaaatttagcatttctaagggtgtcacatttaaaatatatttaaaaaagaaa

SEQ ID NO: 155070 - DNA, 195 bp, Homo sapiens
tcagtggctcccgtccccacgtcttcctacacagtgctgccgcagcattcctgttaagcaaaacaacacggtggctcaaatctaatatcttcctgttggaaggcaaaggccacctgcttaccttggccctgctctccacagttgacacctggcttctgtttccagcttctctccatgtaagcaggtccccaaatg

SEQ ID NO: 155071 - DNA, 194 bp, Homo sapiens
taatggtcccggggcgcaggtggaccaatttgcagcctcatcagctctccctagagctttgcgctcaccctgccctattgacggcaaacaccgaaaggatgggaggagagaagagacgtatgttttatatggatgtgcatattgcagtaacttaaaatgaacaaaaatctggaacaaccattctgtgtttatag

SEQ ID NO: 155072 - DNA, 479 bp, Homo sapiens
tggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggttatttcaagctgaagtgtcttcctggagcagttctttgttcttcaaagaggcccatgtaatatgaaactttgaaaggactcaaatataaggtgttgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactagc

SEQ ID NO: 155073 - DNA, 372 bp, Homo sapiens
gacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgat

SEQ ID NO: 155074 - DNA, 216 bp, Homo sapiens
ctttttggaaaattaatgtgaaaatataaaaatgtaattgctaagcaaactgtgcattaagcatcattttcaattaattttagctaagaattgggttattaattttaatatcttgcaatcacatttataattaattaaagttaatctctttaaaactcactttagagactctgtaaactacagtgtattcttattttttaaggaatttctcttctt

SEQ ID NO: 155075 - DNA, 396 bp, Homo sapiens
gtcctcttcctggtatgcctttcccacttctctatgtgtggttggctcctcatttttctggccttagctcaggtgtcacctcttcaaagaggccttcccagactatccagctaaagcagtcccagccacagacacactccatctttatttaaaacctcccccaggccattttcaagttcatccaggttaaaagatcagcattttctggatctgtgccaccttttcatagtcagcagatctctgtctgctctcaggggtatgccaaaggccactgggtcattggtaagcagccagggatcctgaggctcccagagacctagatgcccagtgacattagggatggcaaaacaagctgggcatggtggctcacacctataatcccagcactttgggagg

SEQ ID NO: 155076 - DNA, 539 bp, Homo sapiens
catctgtctgacttctgtcctagtttcttctctcctaaatctgagaggtgacttgtttccagtggccaagacatcaccaaaagcaaccatttgattgtgcacaccaggaaaaaaagtggacttgaggaggcgaatgattgggaacacccactaatttatgttaaagtcaaattatttgatggctgagtgcggtggctcactcttgtaatcccagcactttgggaagctgaggtgggtggatcacttgaggtcaggagtttgagaccagcctggccaacatggtgaaaccccgtttctactaaaactacaaagattagccaggcgtggtgggcagtgcctgtaatcccagctactggggaggctgaggcaagacccaggaggtggaggttgcagtgagccaggattgcaccactgcactccagcctggatgacggagcgagactctgtctcagaaaaacacacaaaaaaaacaacaatttgctgtttgacttaaactggccacacctttgttgaagtgctttaagcaaaccctggcaatg

SEQ ID NO: 155077 - DNA, 551 bp, Homo sapiens
caaagttctgggattacaggcagaagtcaccacacccagccagccagctttgagtttcatttctttcattttcttgctcatcctcagagagagaggtttaagaagagaaataaaggggaaaaacgggaaacagaaaggcgaaaggtatagatgcctcaggaactgacagggagtagcagtcaggctcctggaagaaacgagaaatgtagcaaggcatggtcaggaaacacatgtctatccatgctcccactctctctgcctttccctctctttcccatccctcttgccaagaagtgagttggcaatcttaccaatgacaaacaaaatagataaagcctccacactgagatttagaaaccccactttagccaaaactaagtcacttacatcaaattgtaccatgacaccaagcattcctgtcccctcccctgcaatggcaatcaagtgtcatagaaaaatagccttttaaaattaccatgagccttttatttttatttatttttacacccaggctggagtgcagtggcgtgatcacggctcactgtagcctc

SEQ ID NO: 155078 - DNA, 354 bp, Homo sapiens
gcaagttatttccctctctttgccaagggggaaaaaccaaggatctggtaaattgcccaggatttcccagcctcggatgctatcttgtgggcggctctcatgctcccggctgcatgctgtcccttccattagacgtgctttggccgtttgaggaagggcctggtcagtaacctcagcccacattttcatggatttcatggtcttcctctggaaggaggaaagcccaattcagagaaccatatactgttagaactgcaagttttcaagacagagttctagtccaaaccaatccttttatactcgggccaactgacatccagagagggaaagtgatttgcttaaggtcacagccca

SEQ ID NO: 155079 - DNA, 395 bp, Homo sapiens
ccatactttcttcctgggaaacatattcactcttccccactacgaaataataaccaagtctatagccctagacatgactaacgttttttcctgagctttcagcagacttgaatttcaagtatctgtaaaatatttataaatattctaccagcaactcaacatcaacatcccaaaacctgaatcattatttccctcttaaaaaaaaaaaaaaccggcggggctcttccaatattcttaacagcatcctcctaagctagaagcctcaaaatctaactattctctcacattccagtgataattcagttttatcgattctactttccaaggcttggtcacggtcctagtcatcttttaccaaaactaattaagtagtcgcccagtatggtataaaggct

SEQ ID NO: 155080 - DNA, 517 bp, Homo sapiens
ctagaacatcgtttttccttaatagcataccctccacactgtgtggtctaaattcaagctctaccacctactagccattaagcaagttattaaggtcttcgtgcttccattttcttacgtggaaaatgaggtggcaatagtatgtatgagttcttcggagggattaaacaagtcaaataggccaagtgccatggcttacacctgtaagcccagcactttgggaggccaaggcaggaggactgcttgagcccaggaggtcaaggctgaagtgagctgtgtttgcatcactgcactccagcctgggcagcagagtgagactttgtctctcaataaataaagaaatagtcaaattaaatataactggcaaactaaaacaactccatagtccttagctacaatttgtctcatttctccaaagaattaaatcagatgattcttaactaactcaaagctctgcataatttgtcttctgctacacatacatctttatagtaaaataaaataaatctgtcccctc

SEQ ID NO: 155081 - DNA, 586 bp, Homo sapiens
ctagaacatcgtttttccttaatagcataccctccacactgtgtggtctaaattcaagctctaccacctactagccattaagcaagttattaaggtcttcgtgcttccattttcttacgtggaaaatgaggtggcaatagtatgtatgagttcttcggagggattaaacaagtcaaataggccaagtgccatggcttacacctgtaagcccagcactttgggaggccaaggcaggaggactgcttgagcccaggaggtcaaggctgaagtgagctgtgtttgcatcactgcactccagcctgggcagcagagtgagactttgtctctcaataaataaagaaatagtcaaattaaatataactggcaaactaaaacaactccatagtccttagctacaatttgtctcatttctccaaagaattaaatcagatgattcttaactaactcaaagctctgcataatttgtcttctgctacacatacatctttatagtaaaataaaataaatctgtcccctctgtattgagaagttattctggtaaatatttgacctcttcaaatatatgaacgagcacttgccttctaat

SEQ ID NO: 155082 - DNA, 440 bp, Homo sapiens
gacatacatgtattcaacactcgaataacacatcttagaaggaaagagcagagcacaaaatcaggaatcaagatgtgggaagaagaaaaaattcctttaaggagagaataaagcctgaagacaacatgcagcaggtaatggggtgaccagcagctaaatcaagagatatgagctataacccctcattacacccaccaagctggtttcctcggtttccttccgaatgttccttaacttttctaagtcttagaatctttaggtttagtttgaacagggaagatgatatgatatccaaaggtctcctccagctctgataacagactgggagtttgtttagacgatgaacagatacgtttaaaggggaaaaaataggctacttttatttcagtgacttgaagttcacaagaatgaaatttcacagaagggagccaagctgtcag

SEQ ID NO: 155083 - DNA, 563 bp, Homo sapiens
cagtgtccatgatagtgaatccattttggttgtgttggatttgaggtggcaaagaaataaggaactggcatgtgactgcgggaaattggagctacaagacaggagttcaggtgaaaagataggactagagttggatgctgaaacttgcagtcacacaaggacttgaacctagagcttttctaaagcccgtactctttccagtaccctgagccaggggagccagcgggcagaaatgacgtgtgaggtaccctctctctcttcacttccatgtgatctgttactcattttgtcaagacatcctgggtcccagagaccactcttattcccaggtgtgtgacctcctcctacagactacagtgggaaagacaccatctccaggtgccaggtgctacacaagatactggctatagcagcgaacaggacagcccgtctcatcctcatggaggtcacaggacaatgagaagaaagacttttttatttttatttttttgagacggagttttgctcttgttgccgaggctggagtgcagtggtgtgatctcgactcactgcaacctccgcct

SEQ ID NO: 155084 - DNA, 398 bp, Homo sapiens
tcagtgtttctgggtctgggtttcttgggaatgttacctttttagggggttgttcaaaagacgagattagatggcagaggtgaaaagtggtgtgactgaagttgtctgtctgactaaagctgaagtagtccaaagtccaaactctgaagcctggagtctgaaatccagggtcaggagtctgaagtctgaagtcagaagtctggtctggagtctgaaatatgaaatctggtctggagtctgaagtctaaaatctgaaatctgggtctggagtctgaagtctggtctggagtctgaagtctggagtgaatctgaagttcgaagtctgatctggagtctaaaagtctcctgttgtctggagtgtggagtctcttgtctggattgtggagtctcttgtctgg

SEQ ID NO: 155085 - DNA, 551 bp, Homo sapiens
agggggtatgtgtaaactagtactagacatacttgcagcacaagggaggttgtcttgcattctgcataaggaggcagagatggtgagagaagcagaggagaaacctgagagctggttcttgtagaatgagaagtactttgctcaagaaatggatgtgtgtgttagtatgtgggtgggaaaaagaaggagtatcctttgaggtacatggtaattcatagaaaagagaccatctgtaggaaatataacaatcctttcaggagaatatggaaatagagacttctggttccaaaatggtatcatagaagcaagttggctacactccccccaccacagaaaaccaaaaataaatatatagcaccaagatttatcaacagtaatatcccagaactgatatacaaggagacagttcccaaggcacagagaagtggaaaaactccaagcaggtggtaagagaataggacttccattctgtgatgctcctcctccgaatctgattggcaccaaaaatgcagaaaatttcttcccaactcattgtctctacactagaaaaa

SEQ ID NO: 155086 - DNA, 530 bp, Homo sapiens
ggagtcggacctacttttcacagggaaaggccatgtgaagacacagcaagaggtctgcaagccaaggagagtagccttactagtaactaaccctgtaagcatattcatcttggacttccagcctccagaactgtgagaaaataaatttctgttaagccacccataagtccatggtattctgtatgacaggcctcgctgactaatacagagtgccataagttctcctgtctcaaaatggaaatttagggggatttggaacaagaatcattagataacaacagaattataaggatattaaataaactccatcctcatcccttgggccaaatagcagcttttttgtctagtgagaaactaaaatataactccatcatggagcaagggtaagaggaggataaaattgtccatagtgaggtggaggacaagcaggaaatctttaaaaggagaagatgaaagtgagaaagttttcctctaacctaaggaagtacctctaccctcatacccctgtggaaagtaccctgtgaaaagta

SEQ ID NO: 155087 - DNA, 283 bp, Homo sapiens
actgactaatataccctgtgacatctaatttctccttatacaactgtcttatgctattccttttaggcaaatgtctgacccaaaagaagctatggtagaaaacacatatcaagatatatacctgacttcatttcgctcggaaataaaatatattcaaacaaagttggagatttccccaaattagtaaatgctatttccccatcaaattccatatacaaatcaaggattcacagagacccccaaaaacctcctatgagaaagatactgcaacagaagtcagccc

SEQ ID NO: 155088 - DNA, 138 bp, Homo sapiens
acattccaagaaattcctttttaaaggttacacaagagaggcaggcctgtggagccctaattggtgttcttcagttgccaagcccaggcctaggttctttctctctccttgaggtcaggaaatctttttttttttttt

SEQ ID NO: 155089 - DNA, 257 bp, Homo sapiens
tgaaacttcctccacctgcttgaggagcgccaaagcccaggtgctggctggacaaccccttctggctgcctaagcaggtggcagaagaaggaaacaaggtcagaggcagagtgttgaaccctgcctcccaggtgggtggaagatgcctgtcgccaaactaggtcccagcttgccgggtgagatgggtgaactggtgatcccccgagagagtggacgtcagaactacatgtttccggacttcaccttggccagcgaag

SEQ ID NO: 155090 - DNA, 630 bp, Homo sapiens
gctatgatcacccatgacaccagctgggtacagagctagaccgtgttcaaaataaatagataaaataaaatttaaaaaaatttttaagtaaaataaagtacctgccactctagtctttatcccatcacatctatcacaatctgtaattaactggtttgcttattgtttattgcaatgtaaactccaagacaagataggctaccttccttgtctgtttcattagtggctacatccccagggcttagaacagtgccttgttctgccataatagtctagcacaggcttttaaccaacatggatttccacgcccccaaaaataattgtttatttttctttagaacaaatgttttcttcagaaataaatgttgttttactcaccattttatctgttactctaaggtactgctgaatcctgattagaaaggtctaacatgggccatgcacagtggctcacatttgtaatcctagcattttgggaggccaaggtgggcgaactgcctgagctcaggaatttgataccaggctgagcaacatgtgaaaggacttattgaaaaactttttggaagttttagcataacttggcaccagaagtaggaacgataatttgaatgcacaaagagaactttaaat

SEQ ID NO: 155091 - DNA, 534 bp, Homo sapiens
actcaaataactaaaaccagaaatgggacttggaacattactaccaaccttccacaaatgaaaaggatttaaggtgaatcctatgaacagttgaacaccagtgaattagataacataaataaaatggacaaattttttagaaatggacaatttacctaaatgccccaagaagaaatagaaaatcttacgagacctataacaagtaaataaattaaatccataatcaaaaaccttccaacaaagtccaggactgaagacttcactagtgaattctatcaaacatttaaagaattagcactagttcttctcaaactcctccaggaaattgcagaggaaggaacacttcctaacttgttttgttttgtttttgtttttgtttttgtttccattttcattttatttgctttattttatgagacagagtcttactcttttgcccaggctggagtgcagtggcaccatcttggctcactgcaacttccgcctcccaggttcaagcgattctcctgcctcagccacccaagtagctgggat

SEQ ID NO: 155092 - DNA, 1940 bp, Homo sapiens
taaactattaccggtgcttccgtgcagtaatatcaccctagcacagacattgcatttagtggaaaaaccttctgatgtccaaagagattgattttaaaggtctcttccaggaaaactacttattttcataaatgaataccttcttttattcttttttttttttttttttttttttgagatgaagtctcactctgtcgcccaggctggagtgcagtggtgggatctggctcactgcaagctctgcctcccgggttcacgccattctccagcctcagcctcccaagtagctgggactacaggcgcctgccgccacgcctggctaatttttttgtatttttagtagagatggggtttccccatgttagccaggatggtctcaatctcctgaccttgtgatctgcccgcgtcggcctcccaaagtgctgggattacaggtgtgagctactgcgcccggtctcctttattcttataactagaaatatgtagcattcagtcattgtatgcatccaagcaatgataaaagtaaatatcgtttaaaaagtgattgagctgcatgtggaaatgtctgttcttcattcttttaggagcaggaatacatatagatataaaaaacatcccatattttaaaaggaattcttagggcttgccaatcttgtagtaaaggttgaattagcagtatatgtcttctacataaaggaaaagagaaaacagtaattgggggaaatttcttgaccatgcctttcttctgtttgttcctgctttcctttgttccttctttgtttcatcagcaattttttttttttttttttttgagacagagtctcactgtcacccaggtgggagtgcagtggtgcagtcttggcttactgcaacctcgaactcctggactcaggagatcctcccgcctcagcctcctgagtagctgggactacatgtgtgcaccaccatgcccgcctaatttttttgattttttgtaaagacagggtctcgctttgctacttagtctggtcttgaacttctggcttcaagcccttcctcctcagcctccaaaaacgctgggattacaggcatgaactgctgtgcctgggcctcagcaatttttaaaagaacttttcaagtaattcagtcgttgtaaagtcatttaatgtggagcataattaacactttccttaaaaagtgtgcctcttgaggataaagcaaactttaaataaatttcttaaagcatatactaacaatcagaaactgagtgtaaagacctattatgggtacctaagtattagcagcacgcaatagagatactagatttggaccaggaaacagaacccttagtcccctacttaaaataatgataattcaactctcttcctggataaatgctttcatatcaccttgacttacgttgaacaaaactaaaattaccttttgcagaccaactttgatacccttgaagatgttaagttttttttactttttattgccagttaacatagggaccagatagtgaaaaatagctgaagtgtttttccagagaaattggagatcaagacaagatagaaaattacaggggaattgctgatctgtatacccaaaaccctaaattcctgcctcttcagtgttaagaataagacataagctttgtatacaagtttaaaaccatatgatttccagtttcttacaaatgaaccatatattcatctaaaaataaattctaagtttaccctaagcatgttttacagttgtaaatttttgtggacgtgaacttagttatcttttacttacagttatatcaaagcccccagcttattttaaaattattaatgcttaaaaacagtttgctgtttttagtcattttgttgttgttgttgttgttgtttttttttttttgctttgttgccttttaatgcacttttgtgatttaaataagaaaaaaacatattatt

SEQ ID NO: 155093 - DNA, 395 bp, Homo sapiens
ttagtcgcagtccagttcagttggtagaaatgaatcaagcacttacaaaatctcacttccactctttcctcatctttagaagactcaacaaatgcctccattcctacttggcccccttggtcaagtaagttaacctcactgtggctccactccctcatctgtgaagtaggcacagtgccttgtaggtgctgtcgtgaggcaaaaagagataacacctgaaaagcacttagaatagtgcctggctcatgctagtgctccatatatgttagttagtatcctaaagccttttctcttacctttgcctgctcccctggacctcacagcagcccgtgcttatctcctcattctttccctagtctgtcttcctctctggtctcaaagatgcttgccaaggg

SEQ ID NO: 155094 - DNA, 564 bp, Homo sapiens
gagctcaaacaatcctcttacttcagcctcccaagtagctgggattataggcgtgagccactccacgtggccttttgctggtttttaaaaatcaagttttttactttattattgatttgtagtcattctttatatattctggatataagtcctttgtcagctgtatgtattgcaaatattctctctcagtccgtggcttgtctttttattttcttaacagtatcttttgatgagcaatagttcttaatttgaatgaagttctaattaatactttttaaaatacttagtgctttttgcatcttctctaagacatctttgcctgccccaaggttgcatgatatttaccatattttcctctaaaagctatatagcattaatttttaaggttgtttgtttgttcatttgtttttgagacaaggtgccactctgtcacctaggttggagcgcagtggtgcattctcagctcactgcagcttcgacccctcaagctcaagcgatcctcctacctcagcctcccgagctcgagcgatcctccctcagcctcccgagctcgagcgatcctcc

SEQ ID NO: 155095 - DNA, 607 bp, Homo sapiens
gattgaggtcagtacccttcgccggttctcgttgcatgctaaaaactgcctgctagcctgatggctcactcctgtaatcccagcactttgggaggctgaggcaggcggatcgcctgaggtcaggagttcgagatcagcccggccaacatgacaaaaccccatctctgctaaaaatacaaaaattagctgggcatggtggcacacacctgtagtcccagctactcgggaggctgagacaggagaattccttgaacccaggaggcagaggttgcagtgagctgagatcgtgccactgcactccagcctgggtgacagagcaagactccatctcgaaaagaaaaacaagatttaggatgcttaattgggaaggtacgtgatacaaatattctaaaatccagaatccaaaacacttctggttccaagcatttcagacaagggatattggacctgtatctatattttaaatgagtgtcattaaagaaagagaacagcacatttattatgatataatattataatatgatatacatctgtttgctcttctagagtaggtctttagaaaaaagtttatatcttattaaaaccagatttcaatcacttaatcgag

SEQ ID NO: 155096 - DNA, 270 bp, Homo sapiens
tgactttttccttggctttcacgtcaaaatgaggaacagtccttcacatactggctcctatcctcactataattcacctggtgcaagtcacagactaccaatatctacatggattacaaagtcaggtaaactgaaggtaattaagaaatgtgatactctgttattacaactgtttttatagcataatatctcctgcaaaaattacttttaaggcagtctcactgtgctcatgcattcttttcctaaataaagaacagatgtaatttactg

SEQ ID NO: 155097 - DNA, 576 bp, Homo sapiens
ataaataaatacacattggcatcttgagtccatttactgtgtaacattcaagaaattactcaacttcgtgtctcagtttcctcatatacaaattggggatagtgggaatatctacattatatgtttatgagactaaaataaaaggcatttatagcagtgcctgccacagtaagcacacaataaatatcagcttcttttttgtagctagtgtaacttcactgctttgaaaaacaggtctaattctatagatttttttcacattcttaagaagtgctaggatatgtagcagatgcaaccaaaccccaatctagacatacagtcagcgaatgtcctctcaaaaaatgggcattccctcaaccagtgtacttccctcaatcagtctgtcttcacttttgcaccggcaactatactccaaaaaggtatctctcatgcctgtcaccacatataaatgtaaatttcagtttcagtggaaatttacatctatacatccagactatcagatgacagatataagcttggcaaacttaccctttggaatcctaacatgatcagctcagtcctgtctcactgcctatc

SEQ ID NO: 155098 - DNA, 293 bp, Homo sapiens
gcaactttgcttatttaaatcctattcatttttgaaagctcaagttttgttttccctggatgcttatgtgattattttggctcacatttgccctgttgctcagaacttctttcaggaggcagtactatgtggtagcttaaagccaaagacttggtttggaatccaaggtctgccccttactagttgtgtgacctgaggcaaattacttaaccttactgaaactcagttactttagttataaaatagaaatacaaatcagctttttttttttctttgagatggagtctcgctct

SEQ ID NO: 155099 - DNA, 448 bp, Homo sapiens
cccagatccttgaaaggaaatattaggcccctacatcagttgagactcttttacttacacttggcagaaaacccttcataaactgcctcaaggggaaaagaggatgcgcataatggcaatgttctgaggaactggatttgagcttggcttgatccagagttgaaataatgttaccacctccaacaccatccttagaccagagcaagggggcctgcgctgaaccctgcactggagggccctgatatcacaaatctgaaaatggagaaacatttatctgtcagtttaggaaatttttttttcgagacaaattctgactctgtcactcaagttggagtgcagtggtgtgatctcagctcactgcaacctccacctccccaattcaagtgcttctgctgcctcagcctcccgccctcccgccccccccaggcggcagccgcggggccgccca

SEQ ID NO: 155100 - DNA, 494 bp, Homo sapiens
ctcaaagctgatgtctgcccccctaaaaatcctttctagaaaaaacagtctttttacacagcctcagttaatcagctctgcccccatctccattacgtctgaataatttgcccagtaggaaaataggccaatagtcaacaacataccctctgatatacagccttgcagggttcatttcaggccgcgggattgcgccacgggcgctaattcaactgcattcgatgcggcttttaaacccccatgggacacctcggcgagctgtttgcctgcagtatctggagaaattaaagacggacggacacaagaaaattaaaaagattacttgtgatcctgcaggtttcaagaaggactacctgaaaaagctcgagtataccttctagcttgattaaaggacagtgatacaccctatcaagaggaggccaggatactctaaacacatatgcctatcctatggccccttggcttagaaaacacagcaaggtttactactatta

SEQ ID NO: 155101 - DNA, 134 bp, Homo sapiens
caagtggcaattttaaatacccaaaaaaggaaggtgcataaaaaaggagctgagtgttttacacaggtcgccacaatgacaacatatgccaaggagaccacatctggactagtgtcactcaaaaaaactaaatg

SEQ ID NO: 155102 - DNA, 496 bp, Homo sapiens
tactggcaccctgtaaacttgaagtttctttttccagtgagagtaatcaaggtgtgaagtagccaccatgttctaagggatggagcgaattgctggtcctatctgttttggctgctgcgggttttgcttatgggatatcctcgtgccctcagtaactcctttgctcaaggtggtgatttagggggctgagaatttgtggttgaaatacagtgctttgcaaagttgtactaaacttctgcagtctgatttaaggtttgtggagacttgagtccccagtctcactttgttgccatactttgctgtgaggcttgtggagctggggtacaactcggaaaagcagcccagcatcctcactccagctgggcggtccagtgcggtcccagcatgaaaagtcagtgggatccataccaaacactcccacgcaagaggaatggggggtcccaacaacggcttcagtgcctcgtggctgccagagctccctccctccatggcatct

SEQ ID NO: 155103 - DNA, 457 bp, Homo sapiens
tactcaatatacaccatagaaatttgggaaatggtaaggatgttacagagggattggtgagtccaacaaggttttatgggaatagacttcgtaaaacagatgtaatatttggagaaatgaaaggagaaagcaaggctgaggaaactgcctgaataccaggtttattgcagggagtcccagaaaatgaagaggaagggtgggactatcttatgacgtctaaacctagagcaggttctcatttggagagtaacatcatcccgctggaatttttgtccaactaacctgccaactgtgtataagattgaagggggcaaatatggaattataaaaaaacgtcatagagacaattacagaaatctaaattcacaatgatcattggtctagatctgtcctatccaatacagcagccactaaccacatgtggcctttggcacctgaaatattagtagtctgaact

SEQ ID NO: 155104 - DNA, 376 bp, Homo sapiens
ggatcgtgctacccaaaggatttcccaacactgtggtatgtaatatgcattttagggcagtgtctccctacccatcacattccccattctcttgtcagtcccataaatgtgtacaattgagaaggaaggaatgaagaacaagtaagggagtggggcgctgtttactttttgtggggagccctctcagcaactttgtcaaatctagcccctttacttcattgccacattgctttctgtggcatcttagtccagtgggagcctgcagataccaagccaaagtcctcatgctgttttggttactttgataactctgtcagttagcaccctggttccactggtcatgaaagtgagttgagtcaggaacttccagatttga

SEQ ID NO: 155105 - DNA, 561 bp, Homo sapiens
ggctcagctgtcatcactagtgaggcaaggagatggagaactctaaattagaaatgatcaggttgccatttggctccaaataccagagatttttaagcacagattgaaagacttctgaactaaatttgtaacttagtaatttaattactttttgaagggccagttaagtcttaaggattttatgagaaagttaagtttatatttctgaagtaaacttggaagtttggaaataacagctaatatgctgttttctttctcctcttcttcatgtggctcatcccagatcacactcctagttaatatcaaagctaggactagaattcttatttctcattactagttagtgtacttcctaatagcctgtgctatcttctatacatatattattaggaggctgatcaaaggtgtcataaggaagcaagtactgctaatgagaatggcaattttttattaatcagaattagacaatataaccagcagtttttcttccaaccatttctatgtcttggagactttgaacccatgctgagatgtaattcatttgcatcaatagctatgtcc

SEQ ID NO: 155106 - DNA, 328 bp, Homo sapiens
tcccacatcccaaaatgacacctccatgcagccagattctgagctcccaaatacggacaggatccctgatttccctcctgccctctgcgctcccaccagacccatccacaggtcctgttgattctagcttgaaagcacattccagctgggcacagtggctcatgcctgtaatcccagcaataggaggcgcaggcaggaggatcacctgagccctgggagtttgagaccaaactgggcaacatagtgagaccctgtctctacataggcgggcagatcacgaggtcaggagatcagaccatcctggctgacacggtgaaaccctgtctct

SEQ ID NO: 155107 - DNA, 507 bp, Homo sapiens
gaaaacaggcacaaagagggatttaaagcaaaagatactgtactttgcaagtgtaattcatgattacttaatagggaaaagaagcaggtacttcaaaagaagcataaacggaaaatgaaaacaacatactaccaacaatgaaataaaatcggtctttttagtttctgatttaaagcatacatagtaggcatgggtttcatttagcattcccagactcagaataatggctctgtgttgaggcaattcagagaatctggcaatcatgtaactctgttgagatgttggccaattctattgcaatccttagtcaaatttttgcagtgcagtatctgtgtgcttttgtctgtatcttttcaagtgagagttgggaagttcccctcatgcccttgagcatttcaggttccctcgaaacagcttccacaacattgttttcctttatgccaggtacaaaatcctagagagatcctgattatacgatttgccaatccaatgttaaaaaacaagaaa

SEQ ID NO: 155108 - DNA, 593 bp, Homo sapiens
tgaggatgtaggtgaggacaggactgaacaaaaatcagtggtgggggctttgagccgtaaataactgtaccaggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttaactcccatcagctctcctacacattctttttacaacacttgcccaaggtgaggactcttctcctggacattgatatggaggtttctctgtctatt

SEQ ID NO: 155109 - DNA, 493 bp, Homo sapiens
caaaaataattgtccagattttgtcaactctctttctttcctttcactgcctttggggaagggttaggagttatgcctcagctttctgtcccaccaggatcttctgagatttaacttccttgccctcaatttttcaacctttctattagctgcttttgatttttgtcttaaagcacgcgtgcacacacacacacacacacacacacacacaatcgttttattacattaggaaagtgagattctgatagtgcttccttcccctgtcttaaccctgtagtaatcagaatatgtattttttttaaaaaagtcctttccagattatctttgctatcagccgtgtttgggaacaattgtgttagatgacacagaattgggccagtggagaaagccatcagagctctcctttggttaataccgcaccgttcataaattcacctgctgatatttttctgtaatgttgggcaatagcttttctgctataatcaagaacacc

SEQ ID NO: 155110 - DNA, 379 bp, Homo sapiens
aaggaaatactgactataaaacaaaagcaaacaaaatagtggcctgtatgtcttcttgctctgccagagttgtttttaacaaaagacttaaaagccaccaggtatggtggctcatgactgtaatcccaatcctttgtgaggctggaggaacacttgaggacaggagttcaagaccagcctgggcaacacagaaagaccccatctctacaaaaagaaagtaaaataattggcctggcacggtggctcacacctgtaatcccagcactttgggaggccaaggtgggtggatcacctgaggtcaggagttggagaccagcctggccaacatggtgaaaccccgtctctactaaaaatacaaaatattggccgggcacggtag

SEQ ID NO: 155111 - DNA, 179 bp, Homo sapiens
catgctgatgccactcatgcataggggatgaataggaaacagagacctgacactctatatccagtgacctattgggaaaatgctacagtaaattagggctgctaaagtgtttaaatgtgtgactcagaagtgccccgggcaaggagctccgacttcaatattcctgcctgcctcctttc

SEQ ID NO: 155112 - DNA, 308 bp, Homo sapiens
taatttttgtatttttagtagagacagcatttcgccatgctagccaggttggtcttgaactcctgacctcaagtgatctactcgccttgccctcccaaagtgctgcgatgacgggcgtgagccactgcgcccggccgatttttttcttaataggcttctgccttgtctaacttcccagagtgaacatggctagctttcagaactgaatgagacctccgtgaatgctatttcacaggcaggagggtgtgaatgtatttgcagggagctggtgggggctcagcctgcaggacacagcctgaggatgggct

SEQ ID NO: 155113 - DNA, 235 bp, Homo sapiens
tgctagtggggagcagccccacagccaagggctggccctgccagcgtgcctttgctgggaagaggtataagtgctgagctctgcagacttggaagcaagggaagccgagctgcctcacggggaacatgctgagctgttgcttgagcaccaatgccagccccaggtagggtcggcccaggggggtctgcggagctgtactgtggctctgacatctatgaggcggtggcaagcagag

SEQ ID NO: 155114 - DNA, 242 bp, Homo sapiens
ctaggaacagtgcagcattatttggagaaaaacatctacctttcaattctgtgattactaataactggctgaatactctgagcttaaaatgactagtaacaacaaagaacaatataaacatgactcaaggtcacaaattctgtatacagaatagaaagtaaaaattgtttgatgtgcacagtaaggtttcacagagatttccaatgtatctttttttttttttttttccggccacggagcac

SEQ ID NO: 155115 - DNA, 168 bp, Homo sapiens
gacgaggctgggacatctggggcatctgcattactagacagcactggaggttgggtgagggaataaggtgacaaaaaaaatgaagaagctgtatgaagttaattttcaaaattatttttattttatttacttttgtttttatttttttttttgagacagagtcttgca

SEQ ID NO: 155116 - DNA, 184 bp, Homo sapiens
gagagagacaggacacaactcaagatcgagaaggatgctatttgctcgctttgcaataggcctgtgccaccaacatagcgatgtctgcttttaacaatgtcctggagtagccctggaaggttccagatttagaagcctgctgcagcgtgatctcttttatctacactcatcaagggttccgctg

SEQ ID NO: 155117 - DNA, 386 bp, Homo sapiens
cacggagaattaaattccattttttgttttgtgacatatttccgaaaccatataactaaagggttttaagaaaaggaagcctccttggtgatgttgttgattttacctgacttggaaattgttcaatcccacaattctttccattttgcatttctggatgctggactttctaataccgaatatgtgttaaaataatccccaattcactacactagaagcctacttaaattaaccactatggcaggagagtgttgtcggggagggctgttttctttttttctttttggtggaaagcagtcccaatcaataggatttaaatctataatgatgcattaaacctacaaaaataagctttaaaacataaataaaattaagtcaacaaacat

SEQ ID NO: 155118 - DNA, 468 bp, Homo sapiens
ggtcttgaactcctgatcttaagtgatccacccgccttggcctcccaaagtgctgtgattacatgtgtgagccaccgtgcccagcccatattttcctatttttaaactaatatcctttttctgttcaaggattctatccaggataccatattatgtttagttgtcctctctctttagcctcctattttcctttttttaagactgttacttctgttaaagtattttttgattcctcgtcaataggaccaaaattaggcttttctggatgttttgtggttgtgttaaagtattaacctttcccaggtgactcctaaataaataggtaaaatcattatagagttcagcaaacagctgtagtggtaattgagaacacctattgggatccctgttacctttggagttaaaagtttcaaacaaaacaccacttagaaacttccctacattaagaatttacacatttaagcgtga

SEQ ID NO: 155119 - DNA, 148 bp, Homo sapiens
catggaaactggcccaagcatttactcacagatgactgggcaaatccctggtcctatgggtacaaactattgatcaaacccccaatctcattcctacccctaaaatatagcaacgtgaaagatcttattacctatttggactgagatt

SEQ ID NO: 155120 - DNA, 472 bp, Homo sapiens
gaatataatgtaatttccttctctgtgtctggttgtcatgactccacatggagatactggccaaaggtagaaactgtcatttaaatcaacagagatttaacacagtaaggacagaaactttagtgcaactagatgaaaaatcatggttccaaatgacacataaccaggaggtaagagaacagttcattactttcctagactttggaacctaagcactaaataaatgaatataccatcaaatgttgatctatcagcatagacaagcttccctctgcaatctctgcatatccctaggccagtgaattcttaccttgtaatggttttggtggatggggcttagtatattgaattgaaggttcagagtagcaccttaagaatgttcaaatagaaaaggatggtttcaaaatataagctcttagaaattaggaacaatctcaattttcttaaccacatgatgcttagatgtaacctg

SEQ ID NO: 155121 - DNA, 261 bp, Homo sapiens
tccctcgtctgtgcggaccagcgggcacgtgcttgtgaccacgtatgttctcctctgcagtttttaccaagtatgttggccgtgtccatctttccctggtagtgaacgctgttctcgccatctgaggagcttctcagggtgcggctccactgccctgttcctcgtagcccagtgcccggtgctccctcttcgaggcggtgccctgttcctcgtagcccagtgcccggtgctccctcttcgaggcggtgccctgttcctcgt

SEQ ID NO: 155122 - DNA, 312 bp, Homo sapiens
gagcatcaacctccttggctgttcttacagtagcctcaagtctctcagtttaatgtgtttcagtgacatatctttcttccacccacttctgttttactaaaataagacagttataggaataggcctgtggtttaatttcagactggaaatggaggttaaactgttgctttagtatttgtgctgggaagggaagttaaaatacaattttctatttatcttaaagtgagtttgggttaaaaagtaagtctttcttctccccacctcattccccagaggtaaccatttatgtgtgtgtgtgtgtgtgttttctag

SEQ ID NO: 155123 - DNA, 333 bp, Homo sapiens
aactctaataaccagtgtcagaattttttaagagtaaaatttggcataaggtccaagacagcagtaacttatgtacattttctagaaaacagctgaaagtgagtgctaatctgaagaagtatgctgtctcaaaatgggctgtagtcaaattacactgagttttcactatattttgagtatatgaatgaaaccaagcgtctttttggagtctagcatacatgaaaatgtaatatggaccttggagataatttactacagattctcttatatcttagggcttcattttcttcctctatggagtaagagacttattaaggtcattcaaaaaggcta

SEQ ID NO: 155124 - DNA, 355 bp, Homo sapiens
acaatagtgggaggttacaggttatgatgaaaaaatgggggtaggtggtaggtggataaaaatatcatgggaggaactgaaggacttttaagagcagggatttctaattttaggttttttgcatccttaatttaaaaccacttatctgctccaaaccttctaaagagttggctatagaaacaaccaaagaaaaggggctgatttcgaaattatgtgtcagcaggagtagagagaggagagttgtaagaggtgatatgtggagaggtctaagtgttcaggaaaagcaagaactgagagccagaagtgacggtgcaatccttgagaggacattggccgtggggaacaccacaaggtg

SEQ ID NO: 155125 - DNA, 235 bp, Homo sapiens
ctccacctctgcccaccctggctttagtcacacatacccatggggatggccaggcagagaaaatgcccacacctctactgtgggagggccaggagagggtaggttggttttactggcctgtggtctaattgctccatgataactgtgggcaaatgggcaaatccattcttgatgggaatgtcaggagtcaagctatgctaagtagtgagtgacataaaaacagctgtgttcccaa

SEQ ID NO: 155126 - DNA, 529 bp, Homo sapiens
atcagctctgtcacttacgaaacgtgtaatcctgaataactgaagaaaactttttgaagttcaattttgagataatgatggatgatttcagactttgtgagaatttcagaggtatcggcagtaggttgaatggtgaaccctccaaaagatatatctatgttccaaactcagaatctgtgaatgtgacattatttgggaaaagggggttttgcagatataattaagttaagcatcctgagatgagatcatcctggattttctagatagggcctaaagccaataatgagtgtctaagacagaagaagacacaaagaagaagagacgggaatgtggtcacagaggcagagactggagcaatgcagccacaagccaaggaacacctggacccaccagaagctggaagaggaaagaagggatttctttttcttctagagccttgggagggagcatggccctgctgacaacttattttcagacttctagattctagaactatcagataataaatttatattgttttaagccaaaa

SEQ ID NO: 155127 - DNA, 376 bp, Homo sapiens
tgctcccgatgctctctctgtggtggtgcccacgttctgaagttgaaggtccctcagggctctgtcctgcccaagctcacacccccactgagggtcacgtgttgctggggaaggtcaggtcccgggagcaggtgcgggcagcgctgggccaccttctgcgagctcccttctcatcctgacatttccctttcctgcagtcttgggctcatggccagccgtcagccagcaccctgtggcgctctcctaggaggctgatctggtgagcggggacgtatagggggtcagcaagtggcccaggtggaacgtggctccgggccacgtgagtggagggcttgagttttgtgaccacaatgtggatgccctctgtgacctgctg

SEQ ID NO: 155128 - DNA, 107 bp, Homo sapiens
tccctttgcagccttgagtgcagcacctatctttaggtgatgtagggtcaattagggctttaatgtcccacaactgtggcagatttgctgattaaaatatagcagtc

SEQ ID NO: 155129 - DNA, 588 bp, Homo sapiens
caaggtagaggacatgtttgttgtaagctttttttgtgtaaaggatggattctttattcctgatacacataatcagtgcacagcagctctctgatacatccggttgatgccttaagtctccctggcttcttacaagtatcttctgggccttgtgtgtccctgggcgcctgtccctggtcaattcccgaaagctactgtgctcctcttgcccatctccccttgcaaataatatcctccatctggggaccggcttcctccaattccaggagaggtggggctgaaggtacagacttgggcatcactggcacagatataagtaaatacagctggagtctgcagagaggctggactaagtcagggagtcaggaaagagaagccacacacaaggacaaccaatcatgtttctcataatcttcttaacctagggaataggacacaatcattttttctttttaaaacatctttatcccctgatcagcctcatttcctcaaaaactataaaggaaaatgctgctgacttgtttttgtgtagtaatttcagctgtcacataataagctaaggaaggcagtatatagtaaataaggacc

SEQ ID NO: 155130 - DNA, 517 bp, Homo sapiens
caaggtagaggacatgtttgttgtaagctttttttgtgtaaaggatggattctttattcctgatacacataatcagtgcacagcagctctctgatacatccggttgatgccttaagtctccctggcttcttacaagtatcttctgggccttgtgtgtccctgggcgcctgtccctggtcaattcccgaaagctactgtgctcctcttgcccatctccccttgcaaataatatcctccatctggggaccggcttcctccaattccaggagaggtggggctgaaggtacagacttgggcatcactggcacagatataagtaaatacagctggagtctgcagagaggctggactaagtcagggagtcaggaaagagaagccacacacaaggacaaccaatcatgtttctcataatcttcttaacctagggaataggacacaatcattttttctttttaaaacatctttatcccctgatcagcctcatttcctcaaaaactataaaggaaaatgctgctga

SEQ ID NO: 155131 - DNA, 259 bp, Homo sapiens
tgtaaaaatcagtagtaacctgacagtgacatggtccaggtactttaggctgtcttatcccttaatgtaggctattaccatcaagcacagttttgcaaatagccagtggaatgtagttcagatacatgactttgtgggtaatccaggggtagagactaaaacagtactgtgcagtatgtggttatttacagttaattaagattaaataaaatttaaaaattagttccttgactaccaaatgctcaatagccactagtag

SEQ ID NO: 155132 - DNA, 483 bp, Homo sapiens
taaaaagatcatttatttccatacaaataaaaagccacttggctctcaacaaagatcaggagattgaaattgaagaaaacaaaatgaataaacatggaaaggatatctggggtcaaaaaagaataacactgttccccaaattgcaaagacaaataaacttaaaaatagaaacatgacactttaaagagcaaatcttatttatccaaaggaagcaaagactcaggagggggacctaataggagatctattagagcatagcagagacctcattgctgtgtcattttttaatgtttttggagtggtagcctaaaatatgtggtggcattgcccccttctcttgctgtgacattgcctcccctttattatacaccactctctccccttggagactaaaggggagtaggttggtcaatagctgcatttgccaacatcagttcactccctgaggctactcacagcactagctttgtcttaattgatagc

SEQ ID NO: 155133 - DNA, 565 bp, Homo sapiens
cacagaacgtgcttcccattttaaaaggtagaatgaggattaaatatgacgatttatgcaaaattacctaaaataatgcctggtgagtagtaaatgctcagtaaatatgtgtgcctttctagtatcctttccaatattaggtttgccttgtaaaaccgaccattttaataggagcaatagggttaaataaagtgaactgttgtggagatgagtcctagcacacaccaagagaaagttctagctcagcatccatccagtgcatgggaggaaaagtaaacctgactcgatttttcagtattcttatacttagaacatcaaaaactagattctaacctaatcccgatttgaggcatatggattacagaagacaaattaaagacaaaaacacataaatagtatttattcccttgccctaagactccacagctacgtcttgagattcctccttaaatcttcgctgcattagaagctggggtgctgaacttgaacgggccccgtgcttagagattgagtcaggagctgcatctgtgcctcccgagcacctggtgtgcgccttgctggggag

SEQ ID NO: 155134 - DNA, 205 bp, Homo sapiens
gaaaaacagaccccatagaaactctctggcacaaaaactctggaatcactgaccccagacattgttccctgccatccactctgccagacatttcttggatttattcaagctgacttgtattccagaacaattgtggacaagatttgctagtaatgcttccaacaagttaccgtttagcaagttcagaacttgaagaatccctttt

SEQ ID NO: 155135 - DNA, 582 bp, Homo sapiens
gtaggtaccattgttagatggggatattgctattggaatatatgaatgctcagagtgataaaagctagtttttaaaaattcacttccagaatgtcaacacaagaggagttatttcagatagcttggagtccatttcttattacagcagtaaaagtatttccaggaacaattagcttctcatcttagagttcacatttacaaacaacattataaaagcatctttgaaatatgcttctctgttttaacttcaaataagatattcattcatgagcttttataggatttggtgaattctcaaatgtcaatactggagcaatatttaaaaggaacatttaactaaactttttaaataagtggttcacaaaattgcttgacatgtgctgtgataattttattcattttaattaactgcactataaattgccaaattcagtcactagcaggataatgcatgctgatcagatcataggagtcacacaaaactgtgagggaaacggagtcagattaaagctataattaagtatctcttcagtcatagaggacaaatggaaagataaggtaaatcattcagtcaaatgccaa

SEQ ID NO: 155136 - DNA, 83 bp, Homo sapiens
tgctgggtacaggtgtgagccactacacccggcctcccctctttttgagaaaaaggtttggctcaagttccatccccttcccg

SEQ ID NO: 155137 - DNA, 248 bp, Homo sapiens
ccccctgccatgcccaaataaaaacttttctgttttgttttcataaaataccactgtttcaacaaagtaaacattagcagaataatttaacaagaatggtggttgtttttcttcctagtaaaatgtacaactacaccggctattctttagagttttagaacaaacaaagccttcacaattgatcactctttagaaaatcattccaaatatttgtttccctgatttgtatgcttcctctttctaatagt

SEQ ID NO: 155138 - DNA, 358 bp, Homo sapiens
aagaaacactggctaacacaataataagtaaaacagcgtggcagtgattcaaaactagaaatttatactgatggctagaatgagaagcaggtttggagccagaataaaaccatgacagccccagcatgttatgcagaatacggccttgagagtctcagagatgagtgaaaagtgccaagggcaagggatcacccaggagtcagaaagggggtgactcatgcaatttgcaaaccctaatttcctctccttggtcacacacttccttctgatttctttcttctgatgattcattaaaaaaaaattctccttttaaattcacatcagaaatgtctgagtacctcggctcaccctgccctaa

SEQ ID NO: 155139 - DNA, 335 bp, Homo sapiens
gaacccagccctgctgccaccttgactttgtcccagttaaaatcactgtggacttcagacctccagtactgtaagataataaatttgcactgttttaagccactacattcatggtagtttgttacaacagcaatagaaaattaatacaggcacatgttacttttcttaaactttattttttagagcacttttagattgatagcaaaattgagtggaaagtaccaagaattctgacataggcctacctgtccccacatacccaaaactttccccactatcaacatcacaccacagtggtacaattgatacagctgatgaacccacactgatatggc

SEQ ID NO: 155140 - DNA, 296 bp, Homo sapiens
ggctgtgggtagcatcactttttgagcctggagtgcagcccctatttattatttctgtggatgtaggctgcaatttttgtgcatcctgagattcctgtgctagtgatgttttagtttcattatgtcattatttggggagaatacctaactatactggggatctttgttaatacccataggtgactattttccatttcatgtcttctgagttcttcctgttttatcataaataattatgtgtacttaatattcacgtgaaatagtttcataaaatggactcagtaaaaatttcgatt

SEQ ID NO: 155141 - DNA, 417 bp, Homo sapiens
tatagagtacaatgaggtttaagagatgatgcagtttgcttgtttgtttgtttgtttgtttgtttgtttttgagacagagttcactcttgttgcccaggctggagtgcaatggcaccatctcggctcactgcaaacttctgcctcctgggctcaagcgatcctcccacctcagcctccagagtagttataaaatggggcaaaaagtgaatggttcaggttactgaaagttgctgacccttcttatctctgtttgctattccctttctcctgctccaacactgcctacattcacataaatatttctaccttcccatcatcttcttccaaattctacaccctttagaatctacacacttctgcatctcacttctacatctctctctctgcctagaacctgagagtccaagggcagacta

SEQ ID NO: 155142 - DNA, 670 bp, Homo sapiens
ataatttacttctcttgggaatacatgtgaagtgaaattgctggctgtatagtaactttatgtttaactttttgagaaacggccaaactgctcttcaaaatgactgtcccattttacatgcttaccagcaatgcacaggggttccagtttcttcacaccctcactaacatttgtcattgtctgccttttaatttgagccatcccagtgggtgtgaagttgtattctttctgcttttgattgcacttttctaatgtccagtgatgttgaacatcttttcctgtgtttactggccatttgtatatcttctttggataaatggcttcagttataattccaaggccagattttgccctagggacagtactgatttatatagttaggctgactgcttcctaattgggagaattggtagttctgaatttcagaaacatctgagaagggtggatattgaagctttatataaaatatgtagcagttttcttttaatgtgattatgatttgggaactttttagttttactaccatgaaaaacagaacttccaagcatactttgccattcattgttagaataatataaacatacatgtttatagcagtgttctgttttcagatcatcctacatatattatctcattataaccattacaacactgccgtgaggtaggatga

SEQ ID NO: 155143 - DNA, 391 bp, Homo sapiens
ctttaaagtttttttaatgctgaaatattctaaaaattatagtgaataatgagtacgttattttttaaatatacaaaataaataggaccaacactatttattgagtagcattcattcctctcatttcaatgaggatcttaagtcatgtatcttatctctatatacatgtgagcctgttcttgtgttatttgcctatccctatgtcaatattacactgtcttatttaccgtagctttataataagtgtggatatctagtgtggtgaagcctcatcctccccaaactttgttactctgtaaaattatcttgattattctttcaaatctctcctaacctttaaaattctgtgatttttgtatatagtactatcgtactgcttatactctttgga

SEQ ID NO: 155144 - DNA, 759 bp, Homo sapiens
acaggattcacttagtgatggggagaaagcagatgacgcagaacaggcctgctgcttccacaaggctatgactcctgcatccaggatgatgcccaagacctcccagaagctggccctgcgacgaggatctgagtgcacttgggaggtggttccagaaagcactgggtaggggcaagaaaggcagttctctttgcccagcatttggccagggcgttggcccacctcaccaatgtgatcccatctatgcacattgctgctggaggctgggttgcgagtcagcatctcagggaaaggtggatcagcacagccgccctcctggccccagaccacaggctacattcccagactcgctgccattgcatgacagagaatccgtcagctcggggaactggatgaagcgggctgggactgatactccaaagtgctgtcaagctagtgtcctttgctggtgttacagttggattttctactttgccatttgactgtaaggtcagtgtcagtgttgggtctgcacctggaagccactgagggaggtacatgtcacatcccctggcatcaggaacgtgacggaccttgtcctgggtctgctatggggatggtgacaaggcaaatccctcctgcagcagggcatgctgctcaccctgtgcgcagctgtgccctgggccaggccctgcgctgtcagaatcaggagctaataacatcaaggcaatagcatctgaggctcgccactctttcatcttctgcacctgtcaacctacg

SEQ ID NO: 155145 - DNA, 252 bp, Homo sapiens
gggtataccactgcacagttctttccactccatttggaaataatcaatataaaatattagggacttcatgtaataagttacaaggtaaggaacccctagttatgaaagatttcctccctggtagttagaatgacatggcaacatacaggattcaagccacacaggtccgaccagtctctagagaaaagacaggagtcgactcccgtaagtaggaacaccgcaatcttctttcagtaactaaaaacctgccca

SEQ ID NO: 155146 - DNA, 505 bp, Homo sapiens
ctaccaagagaggttaaataaatggtgaagatgtgcattgaatgcccagcttttctttccaaacttaagaattagttattctattcctccagaagggaaattaataaagggaagaacaaaggcccacagtgtgcttagagaaaatatattttatggaaattaatatcttgggaaggggttttttatttgtttgtattgatgttctggtctctttcattttggtgcctaagaaatctgttacacactacacaaacccctccacatacttactttttcaacaagggctctattgattcttgtcataactgtgctgtgaaagctgtcaatactgacgacaaatggaggcagccagtactgcatgcattcaaacctccaaacagactgaactattttaatttcctggagatatcacccctatccttatcacactattgagagtacctgttattgtcgtttattttcttcctaagcttttaaaatcctattgactgattctccaaggctc

SEQ ID NO: 155147 - DNA, 541 bp, Homo sapiens
agagactcatgttatagtttaattttcaaatgtcattataggacactttggaaatcctttttcactgtttaaacttcagatgaagaaatgattaagatgtcaagttaaaaatgttccaggggacggggctgggcgcggtgactcacacctgtaatcccagcactttgggaggccgaggcgggcagatcacgaggtcaggagatcaagaccatcctggctaacacggtgaaaccctgtctctattaaaaatacaaaaaattagccaggtttcagtgagccaagatcgcgccactgcactccagcctgggcaacagagtgagactctgtctcaaaaaaaaaaaaaaaaaaagttccaggggaaacacagtggctataattcttttagtaagcatgcaaaaacaaaacaaaacaaaacaaaaaaacaaaccaaaaaacccactttttaaaacattgagataaaacatcatctagtgaaaatgagagaccagtcatctgggagtagaatatggacgtgagacagagccttaaaattggatggtat

SEQ ID NO: 155148 - DNA, 83 bp, Homo sapiens
catgatggttatggggaccttgctgatgtgtttgaactttatgagtgtgagtcctgatccaggacaggacagaaagaagtgga

SEQ ID NO: 155149 - DNA, 234 bp, Homo sapiens
gtctagagggtcccaagtctagcttgtcttcccacaacacttgctcggcctatccggaagccccgacgttactcggactaccccgatgcatcaccatagctcttgtaatttcagttttactacttttattttgctgtgcatgtgaatattatttaatcatacaattattggttttcatttatgtgctttgtataagggactacacgtctctaagtgtggtttttcttgaggtca

SEQ ID NO: 155150 - DNA, 183 bp, Homo sapiens
gcagacatcagaactccaggttctggggctttaggactcagggatttacaccagtgcctcccaccccccagattctcaagccgttaacctcggactgagaattataccatcatctcccccagttttcaggcctttagactcagactgaattatacctttagcttccctggttctccagcttcc

SEQ ID NO: 155151 - DNA, 366 bp, Homo sapiens
ctgtttaaagtgatggccgggcacagtggctcacacctgtaatcccagcacttggggaggccaaggcgggtggatcatgaggtcaggagttggagaccagcctgaccaacatggtgaaaccctgtctttaccaaaaatacaaaaattagccaggcgtggtggcacacgcctataatcccagctacttgggaggctgaggcaggagaatcgcttgaacccaggaggcagaggttgcagtgagttgagattgcactactgcactccagcctgggcgacagagtgagactctgtctcaaaaaaaacaaaagaggagggtaacctcttcttcccctaagtggcctcaggtgatctgtgaaaatggtttgc

SEQ ID NO: 155152 - DNA, 118 bp, Homo sapiens
gaggccaggagttcgaggccagtctgggcaacaaagtgaggcccctgtttctacaaaaaaaattaaaattagctgggcgtgatggtatatgcctgtcatcccagggaggctgaggcaa

SEQ ID NO: 155153 - DNA, 343 bp, Homo sapiens
aagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccc

SEQ ID NO: 155154 - DNA, 302 bp, Homo sapiens
ctgctctaggacaaatcgtgcatatgtctgcttctgcagctgtgctcacgcctttcacctgctctccaactcttctctcctctccaccatggcctctgctcattctctcatttccaaacaatccttcatccacaactcaaatcagttttacccaagaagccttccaaatggtctcaattcagcataaattctctttcagatttctaccaaacatattctcttttttttttttttttttcacaagggtttaagggatgcaaggggatccccctaaagtgacccggagggcttgaaagtggggc

SEQ ID NO: 155155 - DNA, 124 bp, Homo sapiens
ttttgtactgagagaagggggagactgaaaaacattaaaataggtggagcatccccatttatacttgtagaaataccttttagcttggtacatagtagagaacaagaaattggtggttatatgg

SEQ ID NO: 155156 - DNA, 670 bp, Homo sapiens
gatttctaaagtctaggatatttatattgaatgtgactagatttttaagtttcagataacttttaatcaatgcaccaaagttaacaaggaacacaacgttattgttaagtggtatgtgtgttttagatcccaggatgctttatgatgtatacgattggtgggaaattgaaattcgtatttcttctctataagcttgtattgccctttctttcagtgaagattaggagctctgattttattacaggtctgttcattttatggcattctcaaggaagaaaacatgtcctgtaggtaaatattttagatcaatgaagcttagcttactaagaactaatgtttgttttactttaatcatttgatgaaagtattaaatggattgtacacatgtgctttcttagaatatattaaaacactttaatttttccttggtaatttaggactatcatcataaactatttcccccccattgtaagtggctgccgacctgtatttttctggaattgtgtttttgatccttttcatacaactgagtatttgtttctagcaccccttaacttattttgtttccaagttgctgacttacagtatattaggaagagtggaaagtggtcaagaaaaaaataaggcaaccaagcttattaaatcaattatgtaacatttctgtacacag

SEQ ID NO: 155157 - DNA, 850 bp, Homo sapiens
tgatgttccccttcctgtgtccatgtgttctcattgttcaattcccatctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttactattgtgaatagtgccacaataaacatacgtgtgcatgtgtctttatagcagcatgatttatagtcccttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttccttttcagggtattgtacagactcaaatggattgaggactgcttcaattaggacaatcattttttgtaattcaatgtttacaacttagtatgtatgcaatcgtactactgacaaaatacagaatgataatattttccatctcttagtaatcttgtaatggaacagaaaaatatcctgtgtttgcatttcttgcaggaatcagctgttataaagaaacattagggcttgtttcttctgtcattgatatctgaatgcttttaatatactcatcctaagagttgaataatggcctactctgtttacctgggatgtgctacttcttaaacatgagctgatgaagtgtagcctttcaaattaatgg

SEQ ID NO: 155158 - DNA, 295 bp, Homo sapiens
tattaactaggagaagggactgaggacaagtctcaactcaaccactgatttgcagtgaaaccttaggcaaatcgatttatttcattttcccttttctcattgtctctcataagggaaatgaactaaaaatacctacattctttcctacctctaaaactgtgatttcaacaggctgccagagtatgttctacaaaatgctggctcttctcactatggaaaacttagtccccttttgaagcaaagagtaatttactgctttttgtttgcttgtttgtttcaagacgaggtctcactc

SEQ ID NO: 155159 - DNA, 474 bp, Homo sapiens
tgggtgtggttccccccaggctgttcttgtgataatgagtgaggctcatgagatctgatgtttgtaagtgtctgacatttcccctacttgctctcattctgtctcctgctgcccagggaagaggtgtcttccgccatgattgtaagtttcctgggacctccccagccatgtggaactgtgagtcaattaaacttcttttctttataaattgctcagtttcgggtatttcttcatagcagcgtgagaacagactaatacacactatttcttgctttgtgtctgtggacatgtctaatatgctctgcatactacactttacactggctttgtaaaggtctcgtcagtttccctgcttctccttgttcagcgaagtttaatttcacaaagtaaagataaaccatcccttaactctcagcacatcacctgcaggccacattccgcatttcagcaactacctcagagccaggcagcaga

SEQ ID NO: 155160 - DNA, 673 bp, Homo sapiens
ctcactcccttggctgcctcaaatctcttctaatggacctttacagagaggccttctgattcagacctctataaatggcaaacccacccatactttagcaccccaatgattgtatgatgtcactgacagttataataatatagtatataatgtactatgtattataataattgacaattattgacagtacaattgacaatagtaatacttgttatctactcccctcaccactagaatttaagctccctgatatagcgctatcacccagcactgtgcctaacagacagcagacactcaagtctttttttaaaaaatgaacaaatgaatggctgtcagagatgtgactggagaagctggagccaggttacaaagagttttttatagactgcaaccccatgttttagcgcctctttgataatgacttaagatctattcaagaattttaagcagaaaaaaaaaggtatactggaaagaccacaatttcacattttaaaaaattaaaacaaaaaacaattcattttggaaagagtgtgagggtaatctatgagaagacgtgagactgcagttaagtagaatatttaaaagacctctctaatacttcagcagggaaatacaggccccaaaattgtcttctggcaggtggaggttgaaaatgataaacatttagaagata

SEQ ID NO: 155161 - DNA, 322 bp, Homo sapiens
tgatgtggttgctactgctgcgtgccagtggccattctggtagtagagaggcccaacatgggtgattcatctaccaaactggcctgtgaaactccacgtgtgagtgattgcagtagctaaaaatagtctcagctgacgctgatggctgagtgttcagatgcctggccttctggcacagggtgaccctatttttcttacaagaggggaggctttcacattgtctagacactcttcctagctgacagattctggggcacctccttccttcctctgttcttcgtaggcctgctgttttctccttagcttttagaagtttcaactg

SEQ ID NO: 155162 - DNA, 318 bp, Homo sapiens
agggtaggtagataaagtaagactgacaaatattgacaattattgaagctgggtgataggtatgtggggattcattaaacctatctacatttttgtgtatgtttgaaaattcctaaataaaaagttaagtaagaaacacctttttttttttttttttttgggaaagggattctccctcggtggcccgggggggggggcgggggcccattctcagctcagtgcaccctctccgcctcccgggtccacacaattctcgtgcctcagcctccccgagtatagcggggaggctgaaacacaagattcattggaccccggggg

SEQ ID NO: 155163 - DNA, 359 bp, Homo sapiens
ggctctgcctcttcatcttttttactctttccattctgtttgtttcctattttttgcaatgtagttttattggaggccattttttattgcagacttgaggagctgatattcaccacctccaagctgctctgggttataggtctgcagtgttctgtaaaaaaaaaattctaatcctgtcagcctctccctctccatgtcaatgattttattcatgggatggcacatataagaatatttctcaaatacatttatagtggctgcgtcagcagcacatatcctaaaactggaatgaggcagaggagtttagcatggcccttgctcaaggatgacatggaaattgatgaagtattctatattta

SEQ ID NO: 155164 - DNA, 369 bp, Homo sapiens
gaaaaggagagtagaattgtagaggaagaaaagcaaaaggataagcaggtagaaagaagggccaagagagaaagacaagaaagggaaaagtgatagggagggaagaaacagataagaaacaaaaacaaatgtcatcataccatcatctgtctggcaaatggttttccaatacctgggccccaccagtggtgaatgctctggctctgaactggtgcagccataggcttaaattccacaggcggcatcctcaataaaatctctgccttctcatagctggctgtatttcctgggactcaagctaacacagaacctacagcctgctccgagtcaccattttccatgccttcctccccacttactcctgtcaca

SEQ ID NO: 155165 - DNA, 999 bp, Homo sapiens
atagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaatta

SEQ ID NO: 155166 - DNA, 350 bp, Homo sapiens
gggggctgtgaatcagagggaagggtgataaaaggaatggtatacacatgaggggccaagggtggagcagagggagcatggagttaccggctggcccaaagtccccagaaacctccatcaggctcttcctttctggcagggtggccttcaaaggaggactcagaacccagggaccactgcatttcccaggccctgagccccagtgtgggaatcacatcctccaaacccacagtgcccctcaaattcctattcaggtaagaaggcaaaaagtaacagccttccaagcctacgtggacccagcatcggtttttctggtttcccctgcgtcagaggtatggaggtctatgttc

SEQ ID NO: 155167 - DNA, 659 bp, Homo sapiens
ggctgcttctttactgactgcagcatgggctgtcggggaagagagacctgggttcaattcttgaccttgcccctcactggcccttggccttgcccaagcctgtgtcatcttggacacagcaccgagcttcttgagttcacgtctgtgggtggaggggagtgacaggccctacggctgtgaggaaggaaaaaggtcctgagcttcagtccccagtcagtgcactgcctgttataataaggaggctgtgccagagcctccaaaaatgcatcgtttgaagggattttagaaggctggagtgaataatgtggaatgctatgaacagacaattctctcttcatattatttcaaagcccacgtttaccttaacaaaatccaatgtttaaaaatccggctggacatggcggctcacgcctgcaatcccagaacgttgggaggccaaggtgggtggatcacctgaggtcaggagatcaagagcagcctggccaatgtggtgaaaccccatctttactaaaagtacaaaacttagccaggtgtggtggtgcgtgtctgtagttccagctactcaggaggctgaggcaggaaaatcacttgaatctgggaggtggaggttgcagcaattctcctgtctcaacctccggagtagctgaggaccatcgttg

SEQ ID NO: 155168 - DNA, 791 bp, Homo sapiens
ggctgcttctttactgactgcagcatgggctgtcggggaagagagacctgggttcaattcttgaccttgcccctcactggcccttggccttgcccaagcctgtgtcatcttggacacagcaccgagcttcttgagttcacgtctgtgggtggaggggagtgacaggccctacggctgtgaggaaggaaaaaggtcctgagcttcagtccccagtcagtgcactgcctgttataataaggaggctgtgccagagcctccaaaaatgcatcgtttgaagggattttagaaggctggagtgaataatgtggaatgctatgaacagacaattctctcttcatattatttcaaagcccacgtttaccttaacaaaatccaatgtttaaaaatccggctggacatggcggctcacgcctgcaatcccagaacgttgggaggccaaggtgggtggatcacctgaggtcaggagatcaagagcagcctggccaatgtggtgaaaccccatctttactaaaagtacaaaacttagccaggtgtggtggtgcgtgtctgtagttccagctactcaggaggctgaggcaggaaaatcacttgaatctgggaggtggaggttgcagtgagccgagatcgtgcctctgcactcccgcctgggtgacacggcaagactcttatcttaaaaaaaacaaaaacttgtgaccttaaaagcatacggtcgcatgcatttcagtccgtgaattccaagggcatgtaaggccgggcacagcggctttcacctgtagtcttgggtgcgtaga

SEQ ID NO: 155169 - DNA, 290 bp, Homo sapiens
gaggtggcagcagctcatccggatgcccagttctctaataaggtttgagagtcattcctggaagctcaacctagaccctgtttcttcagctccctctgtcacaatgctttcacaaacctcttaatagccaaatatctttcagcttaaacaggccagactcttatctaaaactgaactctggctataacaaacatgaaaaactactgtagaccatattcactggaaaaaataatttggcaaaaatagttctaatggcatggatattttaggtaaagctcatattattgtag

SEQ ID NO: 155170 - DNA, 285 bp, Homo sapiens
gaaatcagccttggtttttaactaatgtgtgggaagtgaggttcagagaggttatgtcatttgcccaatctcacacggccagttacaggaagagggcaggtctgaaaacacacacactctcaacacccaccgacacacacactcggaatgtacactcagtgcacctagaaattcaacacccacggacacacacactcagatatgtacactcagtgcacctagaaattcaacactcaccgacacacacactcgggatgtacactcagtgtgcctagaaattcaaca

SEQ ID NO: 155171 - DNA, 904 bp, Homo sapiens
cccgccactacgcccagctaatttttgtatttttagtagagatggagtttcaccatattggccagtctggtctcaaactcctgacctcaggtgttccgcccgcctcagcctcccaaagtgctaggattacaggcgtgagccaccatgccccacgagcatttccttctttttttaagggtgaatagcattcccttgtgtatatacaccacattttccttatccattcatctgttgatggctgggctgttttgaaaaatgctgcagtgaacatgagggtgcagatatctcctcagcatactgatctcatttcctttaaacgtgtatccagtagtgaggctgctttttaatttttcaggaaacctccgtagtgttttccataatggcaccactaatttacattcccaccagccgtgtgctaggatttctacatttccacatccttatcaccacttaccttttgtgttttgatagtagccattccaacaggtgccagctgtcatcttactgtggctttgatttgcatttccctgatgattagtgacactgaacattttttcatatctctgttggccatttgtatatctccttttgagaaatgtctattcggggctggctgcaggggctcatgcctgtaattgtagtgctttgagagtccaaggaaggaggatcgtttgagcccaggagttcaagaccagcctgggcaacaaagcaagatcctgtctctacaacaatttttattttttaaaaccaactagctgggtgtggtggcacgtacctgttgtcccagctacttgagaggctaaggtgggaggattgcttgagactgggaggctgctgtgagccttgattgtaccaccgcatccaccctgagtgacagagtgagaccttgtctccaaaaaaagaa

SEQ ID NO: 155172 - DNA, 240 bp, Homo sapiens
gagagcaagtgaggctgctcacctcaaacccctgatcctatttccctccatgagcctcttccttattgggaagcccggccctctccatccccactacctaggctgggccaggagtttgaagccagctcccaaacagccaaggaacagagaagtcagcagcctccagccactccctcccgctgcccaccccagctccccaaattccccatcacagccacgcaccccccccaccctcagacc

SEQ ID NO: 155173 - DNA, 493 bp, Homo sapiens
tggctctttctcccttgtttttcacatatttgttggcttacactaggcatttagagtcagttgtattcataagaaattgcactagtcaccagaagagtagctgcaggaaaaagggagagagatgttccaaaatttaatcagatttgggcaacacaccttgctttttgcaaaagcaagcaaacaacccaaaatcctgcttaaggcaaagcctgttcctttctgtgaagcagaaagagaaggccctgctaaagctggatgaaagcaaaaagagatgaggtgtagaggtgtgtcctgctcctgattgagccactgtgggtcatgccttttcccaaagatggatttgttagtgtacggcaaaaagtcaactgaatccccaataattccctagagttcccggcagggtttggagggctaaatgtatacatggtttgttcctaaaattatctagttggtgccacagtgtttctggctgtggcttcctaaactaccttct

SEQ ID NO: 155174 - DNA, 279 bp, Homo sapiens
cagggtggaggtggtggcaggaggggacccaggctgtgaggttcctggtgcgggggagtgagcagatgtgtgtgtgtgtacgtgtgtgtgtgtgtgtatctgtctgtctaggtgggtggttgtatgtgtgcattcccatgtgtgtgcaggcatatttctgcatttaattaatcaaacttttaccaaccatctgttgtgtgcaaagtaatggctttgagggtgactccctctccctgcctccaaggagctcacaacccagttagccgggcaatgtatgtg

SEQ ID NO: 155175 - DNA, 536 bp, Homo sapiens
aaaacctcttgtttctattcctgctaactccttttgccccatcttatttttctccttcactgacaccctcctatcacacacacattattggttagttatcattcccatctctgaggttcacatatgcagtggaccaccctgcctttagctgtccagactttgactgcaacctgtctttctattccactcctcctcccctcccccaaatgatttgaaatggagaggaaaggaaatggagtttgatggttttaactcttctgtggctgtggcttagggagcagaatgttttgattgcttgatttaggggtcttgaggtctcctaatacaatattctttttgttaatagaaaggccccactccattttttttttctctgagtattttggactcaaagtcttgtgttgaaatgtcggtacctgcccccgaaggggaaaagatccctttcagagtttatttttcccccccattcatggggaattcttctcattatcagaagatgaagattactggtcctttgaacagagtataaatatagc

SEQ ID NO: 155176 - DNA, 209 bp, Homo sapiens
gtttaaattaattttgagtggcttcaagttggtttagaaagtaatttttaaataaatcagaggtggactgggaaagagagctccaaagactaacgtgcagaaagaaacttcagggccaaatctggctttagttccttgagaggaatgcgagcatcacttaggttcagacaccgcgcctgctatccgaagaacagggccagcagagggag

SEQ ID NO: 155177 - DNA, 1216 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
gncangngngcgcggcctggcagtgctgcaaccgctacagcagccgcaggaagcagctcaccttccaccgcaggtgagggagaacacacacactgccagtgagagaggaaatgccagctcttctcagaaagaaaaggtcctccctgaggcgggggccggagaggacagccctgggagaaacatggacactgcgcttgaagagcttcagttgcccccaaatgccaaaggccccgtaaaacagatctcgccacggagtccgcaagcagcagagactgttggccggccggccggccctgcaggcttgagaaggccccccgacaagcagccatctgatcacagctatgcccttttggacttagattccctgaagaaaaaaactcttcctcactctgaaggaaaatgaaacgctccagaagcgcttgcaggcccagaggctggtgaagcgaaggatgtccagctgcctccgtgcctgcaaagggcaccggggactccaggccagacttgggccagagcagcagagctgagccccacaggctccggacgcagaggcggcagtggcaccagggccggcagggctttggagctctggctgtggacatttttgtctgctgtggacattgagaaagttggccgtgaggcctgccgggcgggggattgaaacagtaaccaagctccctggcgagagccccgacgccgtctgaaggacgtttagaggcatggtactaggactgagcatgacaagcttatcctcccatagtaacagaagtccaggctgaggctgattctgaactctgtcctttcagcacgcgcagagcgaaggtcgttggaagccccagtatgggagatgctcctcagggaggaagccatgtgagggggccggctctgtggcagattgtaatagcataaaatatgtaataacaataggctgggcacgttggctcaggcctgtgatcccagcactttgggaggccgaggagggcagatcacaaggtcaagagatcaagaccatcctggccaacatggtgaaactccatctctactaaaagtacaaaaattagctgggcgtggtggcatgtgcctagtcccaggtactcaggatgctgaggcaggagaggatcacttgagaccagtgggcggaggttacagtgagtcaagattgcatcacttcagcctggcaacagagcaagactgtgtctcaaaaacaaagaaccaaagg

SEQ ID NO: 155178 - DNA, 184 bp, Homo sapiens
acacttaggaccaataaagtttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctc

SEQ ID NO: 155179 - DNA, 394 bp, Homo sapiens
ggtctttcagagacacctgctgaagctttacagttgaaatgtcacgatgtctacaacttactttcaaatgattcagcaaaaacaaatgtgcatatatatgtatgtgcatgtactagagagaaagaacatgaatgtgactggcaaaaactggtcaatataggtgaagagttattgggtgtttttgtactaatctttccatttaaaattttgagtgattaaacaaaaatgggtgacagccaggcacggtggctcacacctataatcccagcactttgggagcctgaaaataagtaagtaaataaataaatgggtgagacagagtcacaaacggagcccaatggcacgccactagagacctccatcaaggttagaacagatcaatatgttttttgtt

SEQ ID NO: 155180 - DNA, 440 bp, Homo sapiens
accagggaagaagcgggtgtgagggctgctgatcatctttgtgaggggaataaagcatcccttcttcaatacatccacctgtcacaatttctcgacgtatagcattgttattaagtgaagatacttttaccactgtccacttaaacatgatcataataaatgtacgttacataatgtcttcagtgagaagcatgtctcctgagacctgcagaaccctacggggtgaccctgggtgcctcaacatcaaagctcaccccaaggacaagaaagcctcttcatgacatttcaaacaccacaataactatgaagcgagtactcagttacgatgatggatgttttacacaacttatgccatttcatgaccatgataatcttagaggaaaggagttttatccctgatggacagatgagaaaacagacctgggaaggttgagatttgc

SEQ ID NO: 155181 - DNA, 255 bp, Homo sapiens
atctagttagggtcaagtaaaacgaaataggttttcaatcaaatactaagaagctcacaaaatggaatttaggtgaaaacacaccaaagtagtattaaagttcaaattccaaaagaaatacttgcattaaaaaagaaaagccatgcatggtggctcgctatgcctgtagtcccaacaattcgaggtgggaggattgcctgagcctgggaggtcgaggctgcagtgagctgagattgtgacactgtactccagcct

SEQ ID NO: 155182 - DNA, 1132 bp, Homo sapiens
agcggtgtgcctccccaggcttctggaatcctaggccccctccagcagactcttctttttgcccatcatccgggccgttcggtaaatcatgatcgactcagtaatagcgtgccagtggtcaaggggttggttcttgtgggtgcaaaggaatgtatcctccttgcccacttcaaagtttgtcgtgagaagctgttttgtttgagacaggccttcgatttgctgattctggactgtcagaaattttaggttgcctcccacccaacatggttttctccctttgtttatggagctatatatctttatttctctctcttccccctaccttggcattttaaattttgaacgcataaattgccctcctcccttcattgctcacatacagatcccatcttgactgcaactggttgtgattttgcctgccaccaggttgtttcttttttgtctgctttcagtaaacttagaatgttagatttctgaaagccacacagtagaaatttgttggtatttgatacgtagaacagttaaagtgacttctcaacagccgatttttgtttgagtagagatttgattttttgcttgttttaagtagataattgctaatagtaatgtctcatcttgatgactgtgactaaaaatagtattatgatttttatggtaattttatcttagtcaatattgaccatttctttttgccttgtcagctgaattttttgtttaattctaaaaaataatgtgactgagttgacttttaagcaacagtaaatttattattgaagactaatgtgaacactgacattttaacatttaatagccgttttaaactgggtagttggccaatattgttgatcgctctgctattaatatgaaaattgtatacattcagttagaacacactgaaccaactttgtgctcaaaatgatatacgtatcaatgaaatatttgcctgtgaaataagctcacttaattccattggatcgtaggctttttaggacaaaaattcagataaaaaaaacgagtaagatttctcttggctgtataattatctaacaactgcatttgttttcagaatttacaatgttgtaattgtaataaaatcaccacctatcatttatcataaatccccaaaaaagta

SEQ ID NO: 155183 - DNA, 418 bp, Homo sapiens
tattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagacactggcattattctacattttgcaaatctctttattgtatgactttaaataagccacattctgcgtttgatctgttgttgcattgtgttgtttgggttaaagtaactgaagaactggacgggcgaggtggctcacacctgtaatcccagcacattgggaggccgaggtgggaggattgcttgaaaccgggaggtggaggttacagtgagctgaattcacgccacttcactccagcctgggtgatacagtgag

SEQ ID NO: 155184 - DNA, 268 bp, Homo sapiens
cagagatcgcgccactgcactctagcctgggcgacagagctagactccatctcaaaaaaaaaaaaaaaaaaaaagagggtcatgctctgtcgaccacactggagtgcagcggagtactgatggcctagggaagaaccttttctttgaaggggaaatggtgaaggccctgagcagggcctgctttgctcaggaatggccgtaagtcctatagcatcagcatcttagagatggggatagggtggccaaagcgtgtcagtgggtttccctc

SEQ ID NO: 155185 - DNA, 210 bp, Homo sapiens
aagcagttccaaccttttcactcttcaaaacctttcaaagccttccttctgccctgagggtaatgcctaaaccctctaaaatagcttaacagactcagcttgatctagctctccagccatacagctcaccattcactccctaattgtctttagccatattaactaacctacatggaagtccataattagaccatgtcgtcttcaagtgag

SEQ ID NO: 155186 - DNA, 403 bp, Homo sapiens
  misc_feature (391)..(391): n is a, c, g, or t
tgtcagaacattcaatgctttctggatatgagtttcttccttattctgtgctataatattttctcccagactgttgcatacctttcttaacagagagttaaaacttttatgtagccaaatttctctttctttgttgtttctcagttttattcttacttcaggtctttcttattactatattataaaaagtattaaactagctggaatttctattttacacaagaagagataagattagagctttcccccaccatcaaatgaacaaaccctcaaactttctgttgtttgcaatatcctatcatcaaaattagaggaaatccctgtattccccatcatttgaagtttatatatcatatgtacaaaacatattttcccagttctttaccagttnttaaattttgtt

SEQ ID NO: 155187 - DNA, 562 bp, Homo sapiens
ctttattctgtttttcaggattttagttggtaatactttctcatttatcaataacaattttctttaaaaactgagtgttacagcaattaattttagcattttcagacaaatgggaacagttggcatgtgtcccaaactggctatcagctgttgttttccatcattatctaaaatagtgtggccagcattgtgtattgaaatgtgcctttttcgtacattggaagagaagcctcttactgggtttgagtttctctgatacagaacatttgtagcagctaatttatggaatctggcaaataagctttgggaggaaattcttttaaaagtgttttcttgttaaggaataatctcaacaatggtaaatcatcaagaggttgagaagactcttaggtttgccactcagaaaaaacagtctcattttgctcttcataggtcctgtttttgcttgcacatttaatagtaggtggagatgcaaaacaacgtgaatgttcatttttttatgaatagtattaaagctactagaggtgggcaggcaggtcccagtaaatgttgcctttttttt

SEQ ID NO: 155188 - DNA, 442 bp, Homo sapiens
ctatatgactgatggggagtggggccaggaggtccgagtcccttctcactggggagagtgagcactgcaagaggcgggctcccgtctggcagcatctctacctgggacacactacaggcgtttggcggtcactcccctttgctgctattctgcaagcagggacatgaagaattgccatgtgcccttcacaggctgctccaaggaggagatgagcttatacatggtccttgtattgtaccttttcaaaaggcttttatagcatctctctctgacataaggatttgacaaaggattccaaagcaaggtactgccatcttcaagaaagctgtcctagtgtagtggaaaggggtagggagagcacagaagagggaaaatctgggcacgcattatgggcttcacggagaatgagccagatgcaggtgacactcctcccctcccactt

SEQ ID NO: 155189 - DNA, 211 bp, Homo sapiens
agatggctttatgtcttattggcttgccttgaaaaacctttattacatgaggttcattcactgattcagcagcttgcaagaaggtgctctgaagtgtgaggctcttagtggatagcaaagatgatgagagggttcctgctttgaatttattaatctgcttggttagcaggtattttgaccaacgtgatttagctgatgagcgttactgctg

SEQ ID NO: 155190 - DNA, 216 bp, Homo sapiens
tttctcacttaactcttccaaggggagcagtgcagtcagaagggcagctctgccccccagggactgtcaccttctgcacaatgacagtctgtagtcatgtctggtctgatgagagggagcagagtgcacatgctgaggtggcgtctgtcacttctgctctctccagaacatgtcacgtgcagcacatccaactggaaaataccatccagacagttc

SEQ ID NO: 155191 - DNA, 771 bp, Homo sapiens
agtttccctgcaatgctatgatccaactctagtcgccaggttcccaaggctgcagcaaggtaaatgggattccactcataagcaaggaggatatatatgatgccttttctcagatcagaacatacagagaaaaaaacaacagcctaatcggggaagattacaacagtttctgctgaagagaatgctggcacaaggcttccaacctatcccatctactgacctggagaatgaaagcatcctgtctctgggctggccccttatattggtatccagagatttatactccttcaatgataggcagggcctacacctgtaaaatcatcaggaagcaattacagacggtgggcctctaccctgctacagccctcttaagattcagaaggagtatctattctctgaggatgaagttaggaggtgggactcaactccagaggcagggactcaactttggaccagatagaaaactagctgaacaaaggaagaggagaaatcacctcttcacaagacatgcccactagtgccatggcaacacccagaagttatagcccctttccatggcaatgactcggaagtaccaccctttttctggaagattcagaataacccaccccttaatttgcatgtaattaaaagtgagtctacatatgactgaagaactgcccctgagctactacactgggcacactgcctatagggtagccttgatccacaagcagcagtacctctgctgctgctgtacattgctgcttcaataaaagttgctaccaccag

SEQ ID NO: 155192 - DNA, 411 bp, Homo sapiens
gtatccccaccctcaaatcctgttccaatgaaaaaagtaaaacctgatacgaaaaaaaaaaaattcagttaacctattttgggtctgtaggctgacctcaaccctgtaatataacccattacaatgaattttctttttttttaagacagagtttctctctgtcacccaggctggagtgcaatggtgcgatttcagctcactgcaacctctgcctccccgggttcaagcgattctcctgcctcagcctcctgagtagctgggattacaggcacataccaccacgcccagctaatttttgtatttttagtagaggcagggtttcaccatgctggtcaggatggtctcgaactcctgacttcatgatccacccacctcggcctcccaaagtgctgagattacacatgtgagcca

SEQ ID NO: 155193 - DNA, 625 bp, Homo sapiens
atcattttcacaataggagtggtcccattgacctatcaaaacatgaaaatgtgggggaaaatgtgtcttggaattggtagttacagcggtgtgatcattgtcacaatgggtgggaacaaaacgccattggaacccactggaggaaccccttaatgctgtgtgggaacaccagacaaggctcctggcaggagatagtgttggaatgctgccttctaggctaacagtggtggacaagaggatggtaaagagtccagaggaagcggggttccaggcagagggagcagcttctgagagaggtgggtgtgatgcatattgagagcagctctttattgtctttgtttgtgatcgttatcagcagtggagcagagaggggcttcagtctgaaggggcctggaccagtcttatcacaaagacaacagggaaggagacaggagcactgcagagcaattgaatgaaacatctttcctgaaatttctcatctcttgaaaagtttttatgttttctatttacataagtcataaaccaattgcctaatgcaaaaatgtcgtgttcttgaatagtaagaaaaggcaaacagatttcaatcaatagactcagaatttttcattaaatctgcttgcttatt

SEQ ID NO: 155194 - DNA, 222 bp, Homo sapiens
tattgtatatgagatacctgattagttttagtttatattcagtttatattcagttctgtagttcgatttagcagtgggtttcgtggaatacttggtgttatttgtcctctaaaaccttactataggtctgagagatatcccatatatctaagcttcttcataacttctctatatgtataacctagatttatctgaatccagcttaaagtttctatatctttg

SEQ ID NO: 155195 - DNA, 452 bp, Homo sapiens
tcagagggctctgagcgggctgtgtgccgggcgagaacactgcctgggccggggccactgtggcatgagaagggccgcctgggggcccggggcctagagcaggtgggcaaggagtgggtgctgactatgtctgctctgggccttcggcgctgagtcttacaggcctggccagggggctgtctccattatttcactccatttttgtttattttattttggtttgctttgtttataatattttattttgagacaggatcttactctgttgcctgggctggagtggagtggcacgatctcggctcactgcagccttgacttcctgggcacaagggatcctcccatctcagcctcccaaagtgccgggattacagacatgagtcactgcaccagcctgcttttgtttatttcaaaagtggaacgttttaaatgctgtgtttggcaaatcaggactc

SEQ ID NO: 155196 - DNA, 410 bp, Homo sapiens
gtagtgagcttccattgcatcactgcactccagcctggacaaaggagccagaccctgtctcaaaaataaataaataaataaaaaccctccaatgaattctcatctcattcagagtacacatcaaactctggacaatggcttacactaaaccaggagtcagaagctgtggtgggtgaatcctgcccagtgcctgccagtgtgaataaagcactgctggacaccctgtgcccctctgtgcactgcctactactgcttcggcattgcaggcagagttgagttgttgctatggactgcagagtcgaaaacgtttacatctggcccttcgcagagcaagtctgtctacaccagctcttaaatgatttcccttatccctctgacctcatctctctagttctgcacctcactcactc

SEQ ID NO: 155197 - DNA, 162 bp, Homo sapiens
ttcccaggagagcttacagtgaaaatacatcccagatcctctgtttgaaactaggattctatcttacaacagtaatatgataaaatgtgatgaaaaggaggttcttttttttttttttttttgggaaagggggtttctggccccaattttaatttttttttt

SEQ ID NO: 155198 - DNA, 391 bp, Homo sapiens
tcagtgggaggtcttgggggaccagcctgaatgtggcgtatgtcacatctgccacttcccactggccagaactcagctatgtggccacacctaagtgcaagagaaatataattttgttcttggccccaggggaaaggaaatgggtttgagcaaacacatgtttcattttggcactggtagcaagtggaagacatggatttgaacccagacagtctggctccagaagcttgctcttgagtggcacgctcctctaccttcctctgaatagtagctcagaggtctgggaaaaatgtgtggttgcacaagtttttactcagttttcttcccacatataactattatgtggttgcctggatgctgttgaagtcattgccttttagaaaaagagaaa

SEQ ID NO: 155199 - DNA, 282 bp, Homo sapiens
cctagttttagaagtttcaatagcaaggaaatgggtttgagcaaacacatgtttcattttggcactggtagcaagtggaagacatggatttgaacccagacagtctggctccagaagcttgctcttgagtggcacgctcctctaccttcctctgaatagtagctcagaggtctgggaaaaatgtgtggttgcacaagtttttactcagttttcttcccacatataactattatgtggttgcctggatgctgttgaagtcattgccttttagaaaaagagaaa

SEQ ID NO: 155200 - DNA, 162 bp, Homo sapiens
tgaaaagatggaagtaaattggaaatgccaaatgtatcatctaacggagaaatcaagaaaaacaaattcattctttagtggatgaaatctactcttggcctacctgaatataccactttaaaactaggtatcagaacattacatgttgtgtttgagagcaag

SEQ ID NO: 155201 - DNA, 503 bp, Homo sapiens
gaattattactcatactgtacagaaatgaaaaaggaggttcaaaaagataatttctcttgaaaggctaggattagaaatcttatctgtccaattccaaagactgtgttctttcgactgtgcctttcaatagatgaaagcattaaaaaaaagcgggggaggaataagtacttgggctactcaagagagcacttcaggctatctaggaaattcatttgtttaacaaagatttatttactgagcacccatcatatgccaagcactatgaccagcaatgggtgacagatacaaaagtattagtaacaaacaaggtagaaggatggagggaaaaactaacattatctggcaaagtcaaagaaatcttctgagaaaaaaaaaataacacctggatgagattttgaaaagcaaaattaaggccaggcacagtggctcatgcctgtaatcccagcactttgggaggctgaggtgggtggaacaccggaggtcaggagttcgagaccagctt

SEQ ID NO: 155202 - DNA, 427 bp, Homo sapiens
aggtgtgagccactgtgcctggccccttgctttctttttaaattattttttgtagaaacagggtcttgctgtgttgcccaggctgatctctcaaactcctggactcaagcagtcctccagccttaccctcccaaagtgttgggattacagtcacgagccactgcactcggcctgttgctttcttgaatgctgcttcctgcctccaccccacatatttccctctgtgttcttgaggcattgagtataggcaccagtaatgtcattaattgaatagctatttaggtcagatcttgatattatgttatttctgatttgtgtaaaattttacaaggttgatgtcatcattacccattctacaggtgaggaaagtgaggcttagagattgatcagcttcttaagtttacaggctaacaattggccatgccag

SEQ ID NO: 155203 - DNA, 253 bp, Homo sapiens
aagtttctaagtagaaaaggtgttcagtacatatttgttgaacttatgactaagagaatattcttattcctggaagatatgtgtgatttctagtggagactagaaatggcctttctctgaggcaaacttctaaatcctctgaataaaggtatctctagcccatctgactcagtcccacacccctgggctgtggaataaccagtttagggggtgattaaaatggctacataggtacagaaatgttaacttcagg

SEQ ID NO: 155204 - DNA, 247 bp, Homo sapiens
ggaatacaaacatggctttcggtctgagagcctgttgcttgctgagatgttcccagctgttcttcagtgctgagcattttttgggggtaggggttttctattcccaagcaccatcactgcccctctctgaggtgtaacagctgtgaaagtgatgtccagaaggacagggagggaaagagagattagtatccaagcccacagagaataatttataatgaagctttgaagttaatagctcttgttttgt

SEQ ID NO: 155205 - DNA, 307 bp, Homo sapiens
  misc_feature (1)..(1): n is a, c, g, or t
nggtgtgtacgagtacgcatacttatggcagggtcatgatggcaggagtactcagaggtgtctagtgtagtgataagggtggagaggttaaaggagccacttattagataatgtaggggagggaagaggctaggggaagggatatggagctggaggagagggaaatgggaagatgttagtcaaagggtataaacttttggttatgcaggatcaataattctgaagctctaatacagcacggtgggctatggttaataacactctattgtatacttcaaatttgccaagagaatagatcttacatgtt

SEQ ID NO: 155206 - DNA, 221 bp, Homo sapiens
tgctaggcctcctcccccatctttactctcggttttttgttgttgggaagatagaagccatcataagtctaccatcactactcacctacttccaagtacctatctaaggccttccctcccttgggtctatgggattctatctcttctctcttacttgatgttttcctctctgctggatcattccttctgacatacaaatatactgtaatttctcccaactg

SEQ ID NO: 155207 - DNA, 523 bp, Homo sapiens
acagattttggtctgcagatctcctgacatttctctgcaaattaacttcctaagtgaaggacacaggcttcacagaagtccattattggctccccgtttggtctgccagttatgtccactgttacagtgggacagagtgagaacctttgcaagtaggactatacttctctgagacagttcaagagaacttctccatcagcaaaggcagagatcaatatatagaattaatcaactttacacccccactccacccatgtctactaaggcctctgacacacttaaagaaagggttgttttttctaaaaaaaaaaaaaattattaaatttccaaagccaagacttgatcaaaaatgatgagaaatctggctgagaatgcctaggctgtccgccaaggtctcatcatcccttagccaaggaagtttgaggtccccatttgaagagttaccagaggaaacggctagaacagtgatccactctagaattccttctttttgtataccttctctttcaggtgggaaacagta

SEQ ID NO: 155208 - DNA, 279 bp, Homo sapiens
gtgtgtgtgtgtgtgtgtgtgtctctctggatgtgctgtcttggcttcagcgcatgctcagcttagcagcagctgcctcaggctggtccctgccagctctgagggctccaggtctcagccctgctttccttccagagactgaggacagatagctgtattatgtctctccatagtcagtggtcaacatcggaactggaggtccagcatccctactgagcatcttcctatcccagctctgctcatccaaatgccattaggcttgcagcatccagtactgac

SEQ ID NO: 155209 - DNA, 407 bp, Homo sapiens
ttagcagtgtgttcaatgggcatgaaacctggttgatgccttggcagccggaactttccttgtgttatctccatgggcttttagccctcatatgaacggctgacatcattagtcagaacaaaccacccagaatcggttcaactttcaaagctaaatggaaatcaaaatgtggaatgactcagggactgctcgttaggaaaactgattcctctgtgactcagagcagatcttgtaacctccaggggcttggcatctggacatggggcttaaaagagaacagactggggaatcgcaccccaactgggcagctgtggcacctggacaggtgattaaaattagcacttctacctgtgacccagcaattgcacttctgggtatttatagagagaaaggcaaacagctgcctt

SEQ ID NO: 155210 - DNA, 648 bp, Homo sapiens
aggaaggacacttactcagacttaaggagggtgtcagggttttctgagagaaaaaatagctaatatttgaatctatttaatctctttactccattaacacagcctagggttaggatcttttttcttacctggacaagtgtcttactcttccaattggtctttctgctttcagtcttacctttgctggaaaccttatcctcaagatagaaagcaaacttcacagactggggctctttgtggtctgaacccctgtttatcttttaccagacttctccatgctttcacattatactgaagacatgcagaaccattcccatttctgacaatgtgttactcacttctatctgcctaggttaccatttcccttgtttcttaaggctaggtcaagctttatcttcgctgggaagcctttcctgacccctaatctgggatggccgcccactgacccactgtgatacatgttttcaagtaactagagacgacataaacagcatgataataagtatgtgctatgtagttttgggcttcaactcagggatggtcaatggcccaaattaagaatctatatttcaggagagtccagctaacacgaactccgcaagacagccactaaaaaaagctcttcagctattcagatgttcaccaaca

SEQ ID NO: 155211 - DNA, 366 bp, Homo sapiens
ctgcactccaaccaatcagttggttgtccttttaattggacaaaccaagaaaaaatattgccactgatatgataagttaatgtccttaatatataaaatgttcaggcaaattgataagagagttatgaaatccttaatagaaaaaaatggatgaggccgggcacggtggctcatgtctgtaatccctttgtaatccctttgtaatcccagcacttcgtgatctaggagggtggatcacgaggtcaggagttcaagaccagcctggccaagatgatgaaacccgtctctactaaaactacaaaaattagccaggcacggtggtaggtgcctgtaatcctagctactcggaaggctgaggcaggagaa

SEQ ID NO: 155212 - DNA, 180 bp, Homo sapiens
aggagtaattatagcaactgtacctataatgggagatcagtgaggagtgatcacctataaaaattagatttgccttcagccattttaattaaagtataaatattttgaggaaggaccaagttaataattttaaggcaggggaaataatgagtggaaatgcgtgtgtatgtgtcttcttca

SEQ ID NO: 155213 - DNA, 185 bp, Homo sapiens
ataatatgaggaaattcttcacaattgcttcaggctatagaaagacttaacgagagcatgcgtttaataaggtaagaatgatgaactgtatgaatgctgctggaagatccaataggatggctgccagatttggtcacgtgatgtgattgatgactgtagtaaagaccatgcccaagcagttgttg

SEQ ID NO: 155214 - DNA, 471 bp, Homo sapiens
agccctgcctacactcaggagctttttaaaaaatgcccgtacctgggctcaattctatgccacttgaatcagaatctccaacattatgtttttgaaaattgattcttatgggcagccagggttaagaacacttgaatgagatggtctctgaggcctctggcaactccagggttctgtggttgtaaattacccaaagtctgtgtgtgggatgaaccacaacctctgaaagctccacctggaacccacaatgctccaagttctctgcccaatgggaggcgacctctctggagctgctccctcaggtcaggagttataaggatgcctgggggtgctttccttcggcttggtctgagcttggggtctttggctgctttctagaccctctgtgtctgcagcaggtaaataatgttgtatgtgatttaatgctgagaaccggggtcaagacttttaaaacccctgaaatactcccca

SEQ ID NO: 155215 - DNA, 582 bp, Homo sapiens
ttccaacatgtaggatacattaagtagagattggagaaaggttcaattcagcaggcacactcaggacataccatgtctaaagcaacttaagctaagctgagcctttcatattataaaacattcacaggcttttccaaatgccccttgtcacaccaagtctcaatgtattgaactatttactataagttactattaaacatttaaaattaatttcatagaccatcaacaagtaggacatttgtagctatctttactaaatgatagaatgccccagagggctggtggcagctttaaagatttttcatagatggtttcagttggatgtaagttctgttttgcaaccaaaagaatgtaagaaatttgacccatatattgcaaaccttctgataagtgacatgaacctcatgagaggattcagccaacaatgcctcattgactaggcaagaaattttgtaacttctcaatgaatactcagggctttatgttaggagctggaattcagtgaacacaaataaaatcattagcataaataaatgcatcaccctaaagggagatgttggtgatgcttctgcattcacattc

SEQ ID NO: 155216 - DNA, 281 bp, Homo sapiens
ggtggcgagctgaggcgaaaggggcagaggcaagggccccgtgtgaagtccctcaggaggcaggaatgagcatggagcagagaggcagctggcatgcgcccggagcacagagaggagaaaacagatcctgcagggccttggggacttgcaggtttgatcctgagggcaagggacactgatcaagatgtcaagcaggatgttctttggcccctatgtgaagaatagatgggagtgagtggggggatgcagggaaacccgccaggagctgttgctcgaacttg

SEQ ID NO: 155217 - DNA, 222 bp, Homo sapiens
tcagctgcatttatccaatttgtagttatgtttgttgatttgtaatctgtaacccccagaagactgcaaggtccatgagggaaaagacctatgctcttattgccttactataaccttgaacttaataaaagcctggccaataaatatttactgaatgaatatttttctttaacaaataacctttctgagaggatgcccttttttttttttttttttttttgg

SEQ ID NO: 155218 - DNA, 354 bp, Homo sapiens
tccaggaaaggaggacccttggcagcgttcctctcagctgctgctctttgggaatcagctggactcttctcaggctctgtttttgttccacagtgcccaggtttacacataacaggcatagccatgcagggagacactcttgaccacccgccctgccttagttccacgttgccgagaaacatgaaatgattgttccgtcagctatggccaggcctgggatgaagtcagaaacacacagggctcccaggagcccactcagcagtgatgagaaaatagtcataaagaagaggtttaattggaaattcagtttgctatattcgtaaaaatgtctttgatgtttaaaataattaatat

SEQ ID NO: 155219 - DNA, 112 bp, Homo sapiens
cttgcagaaacacctcaaagaatggagcataaactcagagagaagactgactgactgctggctactctctgcttccagtgctgtcttcaaggctagctatcttctcattgtt

SEQ ID NO: 155220 - DNA, 274 bp, Homo sapiens
gggagtttccaggtcattaggaatctggggaatgaagatggtgtgggtttagacagggaggtgagtctttaaggatgctcagatactgagaaaagcagactggtggcagggcataaagatggcagaggaaagtgaggagaaagcagcccaggttggaggtgtagtctaagagtagaggttggcacaatgttgcaaggccctgtctgtggaggctcagctgctgctctgagaagttggaacttgatctggctggcagcggggagctattatgcct

SEQ ID NO: 155221 - DNA, 416 bp, Homo sapiens
cactaagaggatttttggtctattttgttcacactgtgtcctgagcacctgggacagattagcacgtagtaggcgctcaaggatttgcggaagactctatggagattttctgatttgaagctagcacactttacttgactgcatctacctttatacgtaagggaggtaaaggtgaagaacaagacagtggaaagcaaacacactatttcaaaggagtttccaaaaataaaaaaattcattcatgccaggtgcagtgctcacacctgtaatcccagcactttgggaggcagaggcaggtggatcacctgaggtcaggaggtccagaccagcctgaccaacatggagaaaccctgtctctaataaaaatacaaaattagccaggcatggtggcaggcacctgtaatcccagcaacctg

SEQ ID NO: 155222 - DNA, 326 bp, Homo sapiens
gccaatggggacaacttacagctcctgcagctccagctctcagaggccaagcacagacaagctgcccatttaaaaaagtaaagtctgagggtttggggggttttaacaggagcttctgaaacaagaatgtgggtaccacacctatgacccaaggtcctcctgatgaaatgcggacgagagacagacacattccacccagaggagccgacagctacagaaatctccatctcgacttttgacagggcgaggtaacgacagagtgcagaagcaataccagcaagaatcgactaagggcgatacttcccaagggggcgacgctgacctta

SEQ ID NO: 155223 - DNA, 228 bp, Homo sapiens
aggccttccatatatgcagtttcctcaaaaccatcctatcttccctactcccaccccaaccagaacgcccttcatctggttaattcctattcatccattctgctttaaatatcttatttaacagatcctaatgcagtatttattgtgttttcatttcattttattttgaggacagtctcactctgtcactcgggccggagtgcagggtatgatcatggttcactgcag

SEQ ID NO: 155224 - DNA, 297 bp, Homo sapiens
acagagttcaggagagcagagcaaaggttttttgctctgagctggtgcatacagtgttttcaaccttggcagctttagtttttctgtctgtacaaagggctaacaacaggaaactcagatctgagggtagcatgagaaccattttgtagggtattgggctgaaggctgggaagtgcagtgaggaggatgggaatatctgagaatcgcacacgtttgagggcaaggggctgcaatgggagaacagaccctccagccttgtgcttatcacccttgccttggagctctgggaccctaggg

SEQ ID NO: 155225 - DNA, 395 bp, Homo sapiens
aaccaaatacagttatcagaagagaaatgatggctcagaggaaaagggactaagaactgagtgcgccagatgctaggtttcctttctattcaattatacacatcctcaagagctccatgacattgctatacttcctagaccactttttaacaggtggtggttcgttttttttaaaggcagaattgctgcgtttggttacacactgtggagggggaaaaaggcccaatttgtgggtgaaatattagtataattaccagccacataaaagtcttattagttcgagatctaaaaaaatattttggaatggtttagaccaatactatgcagtgtgactatagccctgtgctaaacacatattgctggagtccctaatcctatggaaatgatgtcaaatg

SEQ ID NO: 155226 - DNA, 270 bp, Homo sapiens
tgtagtataaatccagaaaacttgaaaagttcaaaatccagaaaatgttttacttaatattaagcagcagtgtacatactgatttatcattttactaatatgattttttcacaaattcaagtatgaatatattcacccctttcttactatgaccctaattagtgtttgtggcacaaggatttctttctctgggcttaacatagatactatattattatcagaaaactacttaaaactcttcactaccagattaggatggagatagataga

SEQ ID NO: 155227 - DNA, 212 bp, Homo sapiens
gttaatttcttaaaaacttgcaaatttcaaaatatttgaacactttttacctatgtattcaaatcatttgcttttattaaaataccatctttatcttactggtatcttctgtggcaactgaaactattaaatttttctggaagttcggctcccttaaagtatgtgacatgggtcttcatagttcaactctcattgttacaatttctgtacca

SEQ ID NO: 155228 - DNA, 125 bp, Homo sapiens
ctggaaagattcttagattctttccttccctcttggcctggctgaggcctcctgcagggctcagtttaaatatctaaccctgaagttgtcctttgcctctcacacccaggtctcttgcagcacgt

SEQ ID NO: 155229 - DNA, 1588 bp, Homo sapiens
actcgatattgcgaaaccaaacttggtataagagctcccaacactgctaaactggtcatcgctaaacctttaaaaaaaaaaaaaaagcattcgctggtacccagatttccacaggagttaaacatttcctgcgcagctaaagcaagtcttaccagtaggaaaccggaacttgctaggactaagaaacttgaggctaggctgaccccatggttgttatgattagaaatccgaggccactggaaacccggagctgctgaccaacgagtcacagggtaacttcgccttcgcatggggaaacgggctggtgcagtggtgtcatcttggctcagtgcagcctcgacttcctgggatccagcgatcctcccgcttcagcctctagagtagccgagaccacaggtcacccctcgctgccaggctctcttcccggtccagagcccacaggatcctacaggaggggccaacaactgcttgcctttgaaacttgaaactctcggtctaaggttccttaggagcgtaaaaggcacagcgttttctgatcgcagcttcaggtctcccgcccctgtcccggtacctctcctgcaggacggaactctgtgggaacgctcgttgattctgatggttaactgtcagatatccttgatattggacataggatttggaagagggcaggagagaaaaatgaactgcaagactccagcacaagaggtgggattgctggcagatgtctgctccctctccaaacctaatgaacatctcaaagtgccatccactttcctatacccttgatctgtgaaatggatcactgacgctttctctgtctttccggaaatgcaaaacaggtgaattttcaagcgcttgaattgtctctcacacttttcagtcaagagtggggctataaactccttcctcataggaaataaggaactgccactgcttggaagtaaaacgtatttttcccataagctttcacatttcccaaaaaaaattatacatccagatgtaatccccctaagaggcttacagaccctaccaggagcgttcccacgcgaacgcatcatctcccaatcggatcctgaaaacaccatgcaaccaattccatccttttctggatcaacctgggcagaggacaggtgcagaggagcccagagaagggccttgacaagtcaggagacccaatttggggtcgcaattgtcactcactccccaggcgtttgctttgatcttcccctcccaccatactacttcttctgctacctggtttctccctggtatttgaggatcctccaattgccttctggtcttacagacgggagaataaaggaaaaatggcatcgtttccaccttaaaagttacaagcacttcaccagatggtacagcctaggtagagcctttgtaaaacaaatgcccgcccactgcttcaccctcctcatttccacctcagcaaagcattttagcagaaaagctgacccagagcagtagctccctgctataatcctagcactttgggaggctaagtcaggagtatctctttagcccagaagttcaataccaccctaagcacaaagtgagatcctgccttaccaaaaaa

SEQ ID NO: 155230 - DNA, 474 bp, Homo sapiens
attgccctgggagaggaagaaaggggccttggggaaagggtggattgataggtggtgggtgggcaggattggaacctccagggtaccctatggtggggggatatggatttggtcctggctggccggcattgggattccacatgttgaggtgtgtcctccagcctttccaccaccgcctgggcttgatgcattctcctcagctcaatacatttttagaagggaaccccccatgtgaccacacactaggtgaaaatgtaggacattacgagcactgtggaagctttccttgggcttccttcccttgatcctggttactagtccggtggccaagaggtgataaatactgatgggacctgtgtatcctatgaggtagaagcgcctgtattgtcttcaggtgaaggaggagtgggcctcttctgcaggcccagagagtttaaggtgatctggggtttcaagattttcaagcctgtcgac

SEQ ID NO: 155231 - DNA, 698 bp, Homo sapiens
aaaataataaagagcaagacagagaactacaacaacagatatatataaaagcaacattatatacacatggatagagaaaagatgacagaaatacagcaaaatatgagcctagtaatttgtaggatttcggtgattttattagtttatttttccctgctttctataaggacaatgtagtccatcatttaacatcagaaaaaaagtcaaaaaagtcttttttccaagccaagttgaagaggggaaaaaagcacccccttaaaaaaagaattcactctctgagggtgtatgttggggtgtgaaagcttgtcctgcttgactgtatgtggtaacaggggacaggcttctcagaaggcagactaagtggatgtcccaagtaaagctctaagataatgagaaacatgatctgacaaatgtatcagaactaagagaaccaaaaaggaccatgttctttctcagtagtcactttttccacttattcaacaatactgttgctgttcaaaatacctggaacccctcatctggaactacctacagactagtagtaccatctttccaatgttttcaatagtagtgcattttcattctttgagattgggtttaattttgtcttgggtaatatcatcttttgaccaaaaattaggtatgactataaaatgactatggagtttctttttttcttttcttttcatttttttttt

SEQ ID NO: 155232 - DNA, 292 bp, Homo sapiens
ggaggataccccctataatctaggtgcaagtctgggaaaattcatgctcagatgaacacataggttggctcattaaataacacccgtttctgtgaaggacacttgcagagagctaaaaggcaggaaagttggtgagtaagaagtacaaaacagtagattaataaacgtgtgattattcctttcagtattcagaatttaatgagcatatattacagatacaaatctgtatcttaaaatagttgatagcctctagagaagggatggggtggactgttaggtgctgaggccagtg

SEQ ID NO: 155233 - DNA, 200 bp, Homo sapiens
actctgtcccagccacgctgccctccatgatgctccctgagtatcccacctgggttcctaccccagggccttcggacgaccgggctactgcctgatcctgacacttgcatggctccctcctgccctaactctacccgcaccctccccacctccatcctccttttccctcacacaacacgtcacgtatcctgcgcttgttg

SEQ ID NO: 155234 - DNA, 585 bp, Homo sapiens
ccaacctgtaactgtcctactgcctaaagcagtagtttccaaataggatacatggcttaattatattcaaatttcaagattaaaacattatcagtttactaggcttttaacatacagattctttaacatcatttatatttttactgaggtcgtttctttaaaaagtgttagctaagttaaaaagatcagttttcttaagagtcaatattaaagagagtgtgtgtatatgaatataccagtgtcccacagtcaaaaaactttaaaaaatatgaattatccaatccctcatttcatatatatggaaaaaaaccctgtgaggtatagagtttgctcacaggctttcacaggtttctgctaaaaaagtactgtaataggccgggcgcggtggctcacacctgtaatcccagcactttgggagaccaaggcagacggatcacctgaggtcaggagttcgagaccagcctggccaacatggtgaaaccccgtctctactaaaaatacagaatagctgggcatggtggtgggtgcctgtaatcccagctacttgggaggctgaggcaggaaaatcacttgaacctgggaggc

SEQ ID NO: 155235 - DNA, 266 bp, Homo sapiens
atcttcctctcaagtccagtgtggcggtggagcagtagcagacacagggaaagtgacccgggccatctggggttattcttggactttcttgttctgtcatgaccaagggcaaaaggaattgtttgaaaggtagacagtgtgtctgggtttacccctgaatgtcatcagggaatgtcttttaacacaagaagatggcaaaggatattagcctttcttgtgatgttagcaagcctggatctcccggggggtgtgtttgtgaaggcagt

SEQ ID NO: 155236 - DNA, 401 bp, Homo sapiens
gctgggaaaaaagacacgtcaactcaatacccatcctatttttagacggcctgagattcgtccttatccatgcagggcagtcgggtaggacaatgaagaggtggacttctgaatttgagagaaattggtcttatcccagagaagtgaggccaccacccacctgcaatagcttggcttcctggatccctaagcaaagacagagtcttgctctgtcactcgggctggagtacagtgacacaatcacggttcactgcagcctggacctcccagctactcaggaggctgaggcagaagaatcgcttgaacccaggaggcaaaggttgcagtgagctgagattgctccattgcactccagcctgagaaacaaaagcaaaactctatccccaccccccccaaaaaaa

SEQ ID NO: 155237 - DNA, 502 bp, Homo sapiens
cttataacagcatgagaatggactaatacactactacctgatactccccggggaagaaccccacagcatcaggataggggataaggaaagcaatttgggtcaatggaggagcaaatttgccagcagtttggagctgttgatagttggattagatggtttcatgaagttttgagcctctagattcagagaccaagtgaccaccttccccttgcgctgagagggaatttcttcaactggttggaaatggaatgataggtaggatccagaagggctatctaacttgataatttatgtgattgttttctcatttaagggagagaatattatctacagtgtttctgatttttttaagggccttggggaaggacataatgaattattcagagacttctctctgtgaagcaagttgcacagagacagacaacttgatacaaattacgattctaaatttgttagtaatatattttattcatgcactctacttacaatagatttcctgctt

SEQ ID NO: 155238 - DNA, 291 bp, Homo sapiens
tgcataccggtgacatcataccgggccagaaaactgtctggcattgtagagagaggggttttgccctcaaaagactgttgcttactttcagtagaatggggaatgacactggtatcttccttaagggttgttatggggatgaaatgtatgtaaagtgctcaatagggcactggactcactccattgatggctgtctttgctcgaagtgtcttcctgatgctgctgctgttgctgcttgtgcttcttctgtgcttacattctctctctctcactcactcactctgtctctcc

SEQ ID NO: 155239 - DNA, 416 bp, Homo sapiens
cgtggtggctcacacctgtaatctcagcactttgggagaccaaggcaggaggatcacttgaggacaggagcttgaaaccagtctggtcaacacagcgagacctagtctctacaaaagaaaaaaaaagttagccagacatggtggtacacgcctgtggttccagctacttgagaagttgaggtgagagggttgcttgagcccaggagttggaggccgcagtgagccatgattgcaccactgcactccaacctgggtgacagaacgagactctgtttcaaaaaaataaaaacaaaaacaaaccaaaaacctgtattttagctccaaatttgttgctgcaatgcaaattattagagagaatgcttttgccatgctataaatactcatgccctaccaaatttcatgtaggcagaacctcc

SEQ ID NO: 155240 - DNA, 574 bp, Homo sapiens
aaaagctagtatttgattgtgttagatcatcagcttctggttttcattagacaaacctgaaataccctattattaagattaaacaaaaaaatagttgttttcttattctgaaacctattattttgaggctgctctgaccagaggaagagaaatcagttttgcaaaacctgatggagagatacgtcaagaggagaagcaataacctcatcaatgctgcatttaggttgcttttgtaaatgagatcccttcctggatctgacaatgggaaggaaggataatttcgttctttggcattggcaatactttctttagtataaaaggactttcaaagtgcaaaatatagggcaaagaatactgtttgcctatgtaatgtcagcaaactggtgaggtgctgcagagaatctgcaataacatcgtactggaacctgagggttatgagatcttagatctccatgtcatttacgcttaccatggtattttctcaatgttaactctcagaataagcccttagcaagtggtgggtatttttccagtcataccagtttaacagggaaaaagagagtcagagtaacat

SEQ ID NO: 155241 - DNA, 341 bp, Homo sapiens
catagtaaccatctcaggtgctcttttggtcaggagcttcaccaataggctatctggagtacaaaatatagtagcctttaatttgcagagtaggtctctcaccaataggtttataggagatacaggagaaagtcagaatgaaggtacctcagtaagagcacctgtctgtttgggaatccaagagaaaaaggaataaatggaggctgatccaaagtaccaacaacttgtactaatcagttgccagatggaaagcaggaattttctgaggaaactgcagaataagtagcaccaatatctaccagaaaagccaaggatggatggggttcagtaaaagtccttga

SEQ ID NO: 155242 - DNA, 293 bp, Homo sapiens
ctctagagactccccgagtactagtgcctctgtgcttctgctcctggtaggccttgctatctgccctgtgccagcatccacatttaaccttgaaactagaaggtatgaactctgtttggataaggggctcaggtaggaagtgagctgcctcaggtcattgctatttgtattggcctttgagcagggatttctgacttggagggaaacatcaagtatctactatgtacaaggcacttgaggtgggcaccgcaggatatttagtgcccccttggtgcttcacatgttatacgttt

SEQ ID NO: 155243 - DNA, 109 bp, Homo sapiens
ctctttttataatgaggaataaattagttacttaaaaaaaactctgtaatggatattatgttataaagggaaatggtttataaggtattatcatgagtataaaacaggc

SEQ ID NO: 155244 - DNA, 371 bp, Homo sapiens
tgccccaagacaaagcaaaagcctggccagtgtacagtatttcctttctcagcttttcttgttctacaaattagaaatcttatagtaatcattgacacatctttctatttcagtccccttttatatctaaattagaatggataactttgcttaaaaatatctattcttaaaggaatattatttgaatacaaatatttatttatttatttttgagacggcgtcttgctctattggcaggctggagtgcagtggtgcgatctcagctcactgcaacccccgcctcccagattcaagcaattctcctgcctcagcctccctagtagctgagactacaggtgcacaccaccacgcctggctaatttttgtatttt

SEQ ID NO: 155245 - DNA, 372 bp, Homo sapiens
gtgggatgaaacgaaagctgagacacacacggtctgacaatttcaaagactctcttgcacaaacagaggtggagaaagtttaaatgaaagtcatatgaagaaagacctgggacagtactggcccacagatgtgttttgtttgccctttgcagtgtttgtgaaaaacactaagccaatagttaaaaattgtgagagttacatgaaaatccggatttccggctgctcttgaaaaactgatagatctggcaattccaggtctgcgttcagacgtgacaacagctgattagaattcacttgtgactatccccttaggacctggtggatgcatgtggacacacaccagcctgcttacgccgcttaggttactttccc

SEQ ID NO: 155246 - DNA, 178 bp, Homo sapiens
atctatcaatttcatttcaggatcataaaaggggaattacaatcataaaaggggaattgttagcaaaagggggcatttggtgtgacagagtcgagagtcactgctctagcaagcttcccctcctagccaccagattctcccagagaccagttcttcctgaaatgcaggatctggcttt

SEQ ID NO: 155247 - DNA, 325 bp, Homo sapiens
aaggaatgcctcatttgatgataccattgttacactctgtcatcatcaaatgtcccaacgtatacacaaaactttaatctgattctccttagggtcatgcaaagctaaaattatttataaaggcatttaaatgaattgtgccattaaaattaaatcagtgttatatgtgtgtctctacaggtttgtaactcattatttatggacctttggggttgaatttacagatgctgaatctgcagatgccagaggcccaaactgattttcctaggggccatcttatctcctaagtgatagctacatggttgtggacatgtctgcttatttc

SEQ ID NO: 155248 - DNA, 395 bp, Homo sapiens
gtgctgaaatagcaagccagttttcctcactttggagctgcattgtctatcatgtgaagatgttcataaccaccagtgtctgcttctagctctttcctatcctttgtttctggagtttacttgtgtgtgaggaaggcttttgtggggaccaaggtacatggagcagttgggaggtgaaagtttgtcactgggtcctacctgtgcagaacgtcagtcccagccgagaaagcaagggccagggcagtagttctcaaacttgtgttagcctcagtcacctggagagctggttgtgccatggcttccgatgcagcaagtctggagtgcgccccagaggtgtgcatttccaccgggtctcctggtggtcccgatgctgccagccccaggtgaatacaaac

SEQ ID NO: 155249 - DNA, 422 bp, Homo sapiens
tggatcttgtgaatgttaccttacatgttacctcacaaggcaaaagggactttgcagaggtgattaagctaaggatcttaaactacagagattatccaggattgcccgtgtgggcctggtgtaatcataagggtcctcttgagagggaggcagggagaggtgtcaaaggagacatgatgacagaacagagggcagagagagatctgaagatcctgtgctgctactttaaaaatggaggagggtgacacaggcaaaggaatgtagcaggaggcctctagaattggaaaaggcaaggaaatgaatcttgcctagagcctccagaaggaacacagcttgattttctttttttttcgagacagggtctcactctgaagtacggtggtgctatctcggttcactgaaacctcaacctcccaggctca

SEQ ID NO: 155250 - DNA, 1059 bp, Homo sapiens
aaatggaaaaaacgaccagcgtcacaggcctgtcccgtagcacgggcagtagctgaagaggccctgcagaccctgtgtaatgggtctaggtctcctctacctcttttttgtttgtatgtttgagacggagtctcgctgtgtctcccaggctggagtgcagtggcacgatcttggctcactgcaacctccaactcccaggttcaagcagttctgcctcagcctcccgagtagctggattacaggtgcccaccaccacgcccagccaattttttgtattttaatagagacggggtttcaccatcttggccaggctgttctcgaactcctgacctcatgatccacctgccttggcttcccaaagtgctgggattacaggcgtgagccaccgcgcctggcctcgtctacctcttttgatgcatcgtacacaagccattggtcggggggcgggtccacaagctggtatttgtcttaatatgctgttactaatacattgtttacttgggaagaaagcaccatagcatttatttgcagtccaaaggtggaagttgtgactccagcaacacaatcatgtgacagctttaatgctcatttatgaatttcatttgggccaaaagcatagttctgtgactcaagcacttaatgattaatagaactctagaggaacttaccaaaggggcaaagaatgaaggttgatggttgttacatctccagattctaaaattgatccatagttgtggttctgttcgttcctttcagtgctagaactctttccattagagatgactttcgtcttctgctttggagggcttggagatgtgaaatgttcaggagggtcttttccctgctgttggagcttctttttcttccctggttgctttttcatagtattctggctacaaataagtaagacatttctattttgttttgttacagagtggcttagaggaaaggttagatataatctctttgggctctgttgctgtttcaggatgctcgatgctttagatttattaatatgtagtgtgctgaacttagaagtccttcctcttgtctgccttg

SEQ ID NO: 155251 - DNA, 355 bp, Homo sapiens
gtcgaccctgcccccccaacttcaaaaatcagcacttcatccatctagctgctcaagataaatcaagtggcaagccctgccagatccacttactaaacactccacagctggcctcttctcgccactgccactgccacgacctatcccgtccccaccccatccatgccacctggaccactgaggctgcttcctccctggctggcttccactctgctggcatgcagttgattccatgtgggatgttaatcacatcacattccccggtcctgagatcacaacctcttgcagcagcctccgaggctttgtgtaaactccagtcgacgcggccgcgaatttagtagtagtaggcggccgc

SEQ ID NO: 155252 - DNA, 406 bp, Homo sapiens
ccaccaccaccaccactttccaccaagatgtcaggaggtaccatgctccagatgtttggttctaggacaatgggtggcctgaggagatggtgtgcaatcagaccatgcagaagatatttgtattagcacatttgtgaattgagagctgccaatacttttgtaaagtgtgagaaaacacaagcctttatcagcaactgagcaaaatgatggtgctaccttttctaatatgaccctatccagcaagttgtcactctttgctgcatagacaactccaaccaggcatggtagtgcacacctgcaatctcagcactttgggaggccaaggaggatggcccagaccagcctggacaacatagtgacagcccctctctacaaaaaattatttttaaataataataaaaatttt

SEQ ID NO: 155253 - DNA, 418 bp, Homo sapiens
gataaaacacctgggtataatttggtatctttcttggtcacccacatccattggattttaatttaaatttcaaggttcttgatatatggatgttgggaactggaagagaaccacaaggttttccgtcttttaattttttcctttttaatgtatcctggcaaatatagtttaagctacaaaacatttcccaaattcagggctaggctctgggtgtttggctttccaatgtctggttttcctgatttgccagtgacttaattcctccatgagaacatcccttgtatttcaaagagtccaagggagaggttgccgtgtgttccagcagttgtcctgccctgcttcaaaggacaggctggtggctcagatggtggatgtgacacccttcagcctgtgtgacgataacggctctgccactggc

SEQ ID NO: 155254 - DNA, 219 bp, Homo sapiens
ggcagagtgaccttccaaggcacagcccccaggcggttagttacacactctttgtctcaaggacttccctgtggcatgggtacccattagggaggaagcttgccttcgtttcagtctagaaatttctctgaaggcctgttttatcccccacggagtctacaatggtgcaacaatgcagatgatcacagtggacttttggcaaatgtttctgggtctaga

SEQ ID NO: 155255 - DNA, 370 bp, Homo sapiens
cattttccctggcttccattgttctgttcttttcttttccttttctttcctgttttcctctttttgtctttttcttctttgccttgtcttctactgtttcttttgttatgaacgtatttacgcaaagtgctgttatctgttgacccacattgttttgaaaaatgtcccccaccgcagctggccctaaggaaagaagctgtggtgctttctggttcctgggcacagggccaggccaggcctctatatatcaaagaacttccctatcctattatcccaccttatttgtttctgaaagcacaaaagcacaagtatacaaattacctaactctagtataatactgtcacaaaactggtgtgacagaattcgaat

SEQ ID NO: 155256 - DNA, 407 bp, Homo sapiens
taccaaaggatctcccagttcacctgggagttaacacaccagggttctagtccttttgctcgctgtgtggctttgggtaagtccttgcccctctctggaccttgaggtcccattcatacaaaaagcagttggactcaggcctgccagcccccatttttgtggctcttccccgcccctccccatcctttggctatgggatagtctcccaggcacctccaaaaggaagtgtctaaaacagagctctccacctcctctccaagcccagctccccactgccctcttcctgccctgtccctgtctccgctgccctttagatcaggcaggcaggcaggcctagagcatccgccctgagacactgcctgttggctgccttaagacgccccttccttctctgcccgcagcctccc

SEQ ID NO: 155257 - DNA, 486 bp, Homo sapiens
  misc_feature (49)..(49): n is a, c, g, or t
  misc_feature (54)..(54): n is a, c, g, or t
  misc_feature (56)..(56): n is a, c, g, or t
  misc_feature (61)..(61): n is a, c, g, or t
gcgcatagggtgtcatccttctttccttcaggaagcttattacacatcnccatncnttatnccacttggatctcctatagcaaagaaacccattcatgtgtatggaatcaatgtatatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcctaattactaacattcaaatctgattcatctttgagtttccttttggggtgggggctcttgtatccaatcagttactaaatcctcttcattcttcatacc

SEQ ID NO: 155258 - DNA, 440 bp, Homo sapiens
tgtcttcccaaatttccctggcaggctgggaggcgctctgtctgtggggaggaaatggggttcagaggagctgggggtccactctgggtcacactgcaagctgggggctgagctgggatgggaaacccttaggcagatgttggccccaggccacttgcaggcagtcgcctatgacagctgctgcctgacagatcacacagcagagcacagctgcccagggctgcagcagggactggggacccagagcccgcgggagagggtcttacctgcccaacccagggagggcttctctggggaggtgtccctcatgctgggcctttcgggatgacaagagaagtcagggtgggcgacgggaagggttttccaggaagaggcaatggcaggaagggagttccaggaggccgggacgtgggatgtgccggggaccagtgctgcccaag

SEQ ID NO: 155259 - DNA, 469 bp, Homo sapiens
acttatccgtggtcaaacggcgccaggtgtgataggatatctcgcaggaatatcttcatcgcgcgcaaactcaattgaagtctgattacatccatggcggatgctggggtgcaggatgtattgaccaggaggccatgcagtgagagatgcatatatgaaccaaagaaagcttggagtcgctgtattaatatcaggcaaagtaaaggacatttgccttgaataaaaaaggacattgcatcatgataaactggtgagttcaccaagaagatacaacagttctgagtgtgtatgcatggaaccccagagcctggaagtccataaggtcagaactgacagaaatgcaaagacaaatccccagttgcacttagggactccagctttcctcagtaactgatagaaaaagcagacaaagttagcaaggatgtagaaaatctgaacaccatcaacagccaagtgaacgtgcgcattc

SEQ ID NO: 155260 - DNA, 653 bp, Homo sapiens
ggatgctggagtttggcagagatgaagtatgaattatgaattgcatgggaacaagtgaggagcatcctaggtaactgcctggaacatccctgagttgtgtgtagcctgactctattggcaggtgttgtgcttgggtatttcagtatgccgagggagtcagaagcaaagcagacatcttaggctttacgttgtacatgattgaggaaggcagtcagcaagacacggtcagatctgtgatttgacttctcaaatctgtggcagagtaaaaggtgcataggaaaagaaaagaccgaaagtacagtgaggaagttatttcaaaagtccaggtaggaggtaatgtgagcccgatccaagaccatggcaatggggatgggaatagaaagaaagtagcaaatggatatatttcagggaaaaattctaacgggatacagcaattcacaggatgtggcatatttaaagaaggaaaaggaatacattaccagtaaggttttgagctgcatgacaaggaagatggtgatgccacttagcaggggacacagaaagaaattttctcttcttggcaagaagaatcacaatacacggagcttacaactgactattttaaggcatacttaaaagatcttcaggtgtctgaatgtcaccagagagccaca

SEQ ID NO: 155261 - DNA, 192 bp, Homo sapiens
aaaaaaaaaagtagaaggaaggaatggcagcactgctgctttgtaggttgttttccataataagaggaggacaagaaaagtgtaggaaagcaaagaaaatttatgaacttacagtaaaaaggagtaacagcataacttaaaagaatgaagaaatagattacgtgttagataaattttttcttaatttttttt

SEQ ID NO: 155262 - DNA, 574 bp, Homo sapiens
gtacatcagtgttcaagtttaaaacaaactgaacaactcaaacactgcaacaacaggatgtttaacagtttctttttaccagatataattacgcggttacgaggtgtttaccagtgcttaaaatgaaaaattgaggaaaccaaaattatagctcagtacttctcagccctttgatgaattatgtttgttatccagaagcctatccctatcaattagattacgcttttaaaaagttacaagaaatcaaaatattataattcttttagttcggcggacttcatgatgcccccttcaaataatggaagtaatgaaagtgcccaatcatcagcaaagtctttagacacctatttacgtcttgttttaaaaactagatattaaaccaagattatgtcgtttgtacaaatattttatacacacacaaaaccaacttgaaatacaccaaagtatcagcaaagattatctctgggtaattatgggttttgttttttttcactcgcttctaaattttttttttttttttgggggggaagagccttttttggaccttcagcctcggggtcccgagctcgattcg

SEQ ID NO: 155263 - DNA, 423 bp, Homo sapiens
acgaaggggtctagaggggctttcagcaacccaaacagtcttgtcagccctaactctggacctaaggaaataattatgaatcctcaagatccatttaaaagtgtcattactgtagataaacaaagacgagtggatgcttcttcctactccacctcactgcagagattccatccatcccagggtcactgaccactgactggatgaactaggattggtgtggcagagtggagttttcaggagccaagagactcctggattgtcatgctctgtactccttccccacgaaaggaatgtctagaactcctgctgaaagtagtcattgcctgcatttcctaggcagaatgtgttagctccctccccagaagaacctgggcgaagaaggtgttccaatctgcatttggaaagaatccctcccgcaaagaa

SEQ ID NO: 155264 - DNA, 239 bp, Homo sapiens
ccactgctgagtttcccaccccgagtcctggacctgattcaggatggagcctggagaaggacagacaccctctgccagccatgaagatcccaggcccacaagttgctggccctctgtagcctagatcttgactctctcctgctcattagggcatcttgtcactgtccactgtcttcatcttcatccaccctactccttgctgtctaaccacaagcgtcttctttatgttcttacatgca

SEQ ID NO: 155265 - DNA, 281 bp, Homo sapiens
ggtggcaggcaggtttagctagaggggcaagcagccttcatgatagaggtgtacttctgattcagctctgaagaagccagggttaacatcatccttgtgataatatttgaatagaaaatgatgcatccctttatttccagggcagctgcttagaaatctccctcatgaatgtttgggggcaacaccttacaacacaatttggaagagctattatctagggcctagtatgttggttacaggagctctccaatcattccttgaagagaacaccaccaccccat

SEQ ID NO: 155266 - DNA, 622 bp, Homo sapiens
taaatctttccattagaatttttatctgacattttgagtatacatacttttcatccgacgtttaggctttggtatcccatcacttaatgaaaatcttgcccatcttttggtaaatgatccaactatactcaacatcaaatacctcacaaaaaaaaaacagagggagcagaacctactatgcaatcattagatgccagagacaagttcagatgaataaaacagaatttatgtgttttctttcactctatcccttttgtaacttggttttacagtctaaggaactaaagaattctaacacctaatgcatttccaacatgagtacagagatgacttacaccatttctcttaaacagaaatcaaagtttttccacagtactaatgatgtcaagaatgaataaaatgtttaaaggttaggccaggcacggtggctcatgcctataatcccaggactttgggaggtagaggcgagcagatcacctgaggtcaggagtttgaaaccagcctgaccaacatggagaaaccctgtctctactaaatatacaaaattagccaggggtggtggtgcatgcctgtaatctcagctactcgggagactgaggcagaagaatcgcttgaacctggg

SEQ ID NO: 155267 - DNA, 605 bp, Homo sapiens
tacagagatgacttacaccatttctcttaaacagaaatcaaagtttttccacagtactaatgatgtcaagaatgaataaaatgtttaaaggttaggccaggcacggtggctcatgcctataatcccaggactttgggaggtagagggagcagaacctactatgcaatcattagatgccagagacaagttcagatgaataaaacagaatttatgtgttttctttcactctatcccttttgtaacttggttttacagtctaaggaactaaagaattctaacacctaatgcatttccaacatgagtacagagatgacttacaccatttctcttaaacagaaatcaaagtttttccacagtactaatgatgtcaagaatgaataaaatgtttaaaggttaggccaggcacggtggctcatgcctataatcccaggactttgggaggtagaggcgagcagatcacctgaggtcaggagtttgaaaccagcctgaccaacatggagaaaccctgtctctactaaatatacaaaattagccaggggtggtggtgcatgcctgtaatctcagctactcgggagactgaggcagaagaatcgcttgaacctggg

SEQ ID NO: 155268 - DNA, 528 bp, Homo sapiens
cgtgaagaacacacacacacatacacacacacacacacacactcagggtttctacttggtgcatacttatttttaatgcctattcatccacagcagctaaatgaacatatctctatagagcctatctaaaatatttagtttttaagccaccgtttaaacaatccaacatttaagtttttaagataatcatgcttacaagataaaccacttcaacaaaaaactaattttgcaggagctcagatctctctctcttacacatacacacacacacataaactttctttctcttttgctctctctctctcctgtaaactacagaactattatgttaaataggccatgcaaggtgcctgtttctcatgagaggcctcagtgtgcttcaatgtccccttattttttccgagtacaaccaaaggtgattatattcatcaggttgttatgctctgtaccatgtgacacactggcctggcatgacagacctgcccagcaagagtacttcatacaagaaagtactacttgaggaccaaa

SEQ ID NO: 155269 - DNA, 335 bp, Homo sapiens
tgaaaaatgtgacacaattagcaatgaagtttttaactgtgaaataaaagcacgattaacatcagtatctttttcacagtctttttcaatgaatcactttgtcttcttcaacacctttgtagctactgtaaaatttacatgactgtgaaattccatgcctttaaaattcatataactaaagtattgtaaactctattcatagcattgaataaaatggcactaaaatgagctgataatatggacattcatgtgtcctgattcagctaccgcgtctggcaggttcaagagccagaggcctgggttcaagctgtggtcatacctcttaaggactggga

SEQ ID NO: 155270 - DNA, 319 bp, Homo sapiens
aagcaatgtggccatgcacttttaacatccgaatccattatgcattaatagttcaacaaaggaagcacttttccccagactcacattccatgctaccacttccacagtcaaagcactgaggttaattcctaagaaaagctatctcttctcttctgcataccatcagcaatcataaccataatcataaaaagtctagacctcaaagaagcagaggtcttagataaacacatcaaggggctccaagtttcaattgcctaacaagggccatggaggcaatgtcgatgagtgaagtggttgacctttcctttatttcctttca

SEQ ID NO: 155271 - DNA, 383 bp, Homo sapiens
cagataaggaagatctgaaggaattgtctcgttttacaacgatctcactacaacagcctagagcaccccactgtgcaatgtgacagtccttgccataggaaagtctaatctaactcctttttggatgaactctggttctgtcttcggttgagatgagacaataacttcttactgggcattagggtgttgcggacgagtcccagtttgagacaagagagctgagtttaatttacaggctctgcctccaattttgtgaccttgtgtgaccttgggcaaggccctttcttgctttcctcgcctgtacattgagaaggtagaactagataacttctcaggcccttgcaaccccacagttctgtggctgaacgcgcccggaacgtccc

SEQ ID NO: 155272 - DNA, 365 bp, Homo sapiens
gatcccaaaccccattcattcttaaattcacctcctcttctgcagagaaagaggccaaacccctccatcttgacccaaaaggcagaaaccagctcttccagaggaccttccacagcagatggctgtcaatactagcttggatgggattcctccccggggatctttctccgagggcccctccagctctgagctctctccagggaacctccctcggcctaggaggggctttataagccctgacagcgctcatccacgtccgcagagcccaaccttaatgtgcctctccctagctgggtgaccccaagcaagtggctcaaccgctcaggacttcccggtacaaaaataaacaaataaagatgggactg

SEQ ID NO: 155273 - DNA, 333 bp, Homo sapiens
gtgtccatcccccttcgtgtgtccatccccctccatcttgacccaaaaggcagaaaccagctcttccagaggaccttccacagcagatggctgtcaatactagcttggatgggattcctccccggggatctttctccgagggcccctccagctctgagctctctccagggaacctccctcggcctaggaggggctttataagccctgacagcgctcatccacgtccgcagagcccaaccttaatgtgcctctccctagctgggtgaccccaagcaagtggctcaaccgctcaggacttcccggtacaaaaataaacaaataaagatgggactg

SEQ ID NO: 155274 - DNA, 536 bp, Homo sapiens
gcatcacttgatcatccctgaggggacagcaggtggattggttctatcctaaacctggcgaggccccggcctctagacaagcctccctgtgacaacaggtctaccagggcctggactcagcccctgtgccagagggcagcttggtgaaattcccagttgctgagcgcacgctggggagctgcctcgcagcacccagggcagacatgggtggatttgtgggtgcggaggagccctccttacctgcccaggagcccagggactctcacactgatgagtctgcgttccggggaaggttgcgtttctctggcagtgagcaacttgacaggtggtgtctgtggctccctagataggctggggacctcgggcccggatcagcccggctgcttcatccctgggagcacagacctgattgtggagcctggaagctccaagctccttgaacttcatccctgtggcctggacggggagcggaaaagagtcacatgaccagggttcctcctgcagggagcccccagacccaagggcctcagtccacc

SEQ ID NO: 155275 - DNA, 826 bp, Homo sapiens
cccttttcatgcaagtgtccaagaacaaaaactctgtgcccagtaaacaatagttcctcattccccaatcccctgtccctggttcagttttctattcaattttattacataagcacgtgtgtgtgtgtgtgtgtgtgtaccattaaccagtggtacagtgcaaaaaacttacataaatcttcattaaaattctaggtcagacatttactactgtgagaattcggttaagtaacatctttctgaacatttgtcttctcagctaaaatctaaggaggaggatgatgatgttaatagctaacattcactaggcacatgtccgtgcatttccctttctcaaaaaccctataaaataggttctagtataattttcactggtacatgaggaatcggaagcacagagatgtatcccaaggccacatttaacatctaccttagagagaaggtcactgtgaagaaagtgccaggtacagagcccatgctcaaaaatgagggttcccgttgcctttttcaggagtccttaccaggtgcggtttatatagtctgtgtacggagcatcctttgtgcagcaatgagtctagagtcattgcattttagtcttcaccacaacactagaaggtagatattttaaatgtagtttcaaaatgtgttaatttgtaattccacgatagttgaaatcaaagaaatcaaaccttacagggagaactcaaaattcacatgactaccgccctctaaactcagtccctgctccagagtaactactcttattgcactagtgtactgtatgtcttcccagacctttctatgaatagacactttgatccagaga

SEQ ID NO: 155276 - DNA, 413 bp, Homo sapiens
atcctggaattaagttgtttcttggaataatatgatacttcaaattggtatcttaaaatcatgaacgagactactagagcttatattttcactttcccaggactattgcaaaatactgatgatacaactgaaataagatcactgcctgaacttaactgtaatttatgataaaagtaggtcttttgaggacctctaggacaagtatgacacattttaaaatcacccagcctttcaaaattctgaatgatgtgaaagagttttgcatttaccatcagatttttctcacatattctactgttcctgatgacatgttaagagaatataaacattcttaggcgacactcttataaatagttccctggtacgaacagattgaaaagggtagaaaagtaaaataaacttttgtttgtttg

SEQ ID NO: 155277 - DNA, 675 bp, Homo sapiens
agagccagtacgacggccttgaggaggagctgtgcttgtgtgctggaggaacccaaggcggcctgtggtggagcctggtaggtgagctgtggggaggaaggcttgaggaaggtgggggagtgctattgttgagagttgcctggctgcgagggtgaatgaggagtgtggttttggaaacgccaaatggagatgccattcctaatacccatggggagagcacctgcagcagctgatcatgcctctgggcccagagacacctgaattttgagagtgtgctacacagaggtagcattcatgtgctcccatggactgagcctggggagaggaggtgaggtcccagcacaggcgctgggacaccccaaaacttagaggtggggaaggtgaggaacctgtcagtctgctcttgggtggcctgtggctaccatctcaacgaggagggaacgcgctgtgttgatgtggacgagtgcgcgccatctgctgagccctgtggtgaagggacatcgctgcgtgaactcgtcccggcagtattgcgatgagaatgcaagaggggttactattgtgatgagatcaggcaggatgtgtgtcgatgtcaaagtgagaggtattgatgacttgaaaattagttgtggcagtgagaatgaagaaaaatacttggatacagagtgttaggagcag

SEQ ID NO: 155278 - DNA, 727 bp, Homo sapiens
gttagtgtttcctgctgaggcagatgctacaggtttggcacatccctggagcaggtgccagtaaattctgtcttttgggttttaactcagcaggcattccccaggtaggtgccgcttaccatgggacactgtattagtgaccaaagtggggtgggttctccttcccagaggtttgccagctgtgaataaagttcaggtacagtggagcagtatggaattactgggcatatggttacattgggaggagaagaggttctatcccagcttcctgctggcaaagatgtggaagggtacagaggaggtggaattccaggaattgagggagcaaaaccatggcacagttcaaggaatgttggcttctctggctcaaaaggaatattagctgtgtggggaaatagggtggagataaggatggaaaagtggaaatcatagagaattcccattagtaaggaggattaggagccacccaggcttcccttggtttctttccccacatcacaagatccttctcattttgccactgcactgtaaccccaaaaccctctagagggagagttgaaatgttttatcttagctcagctgtggaagcaagctgtggcatctgcgtaaagacttcactttggttacctataggttggcagtcaaaccagtaagggttttcaaaggatgtggctgttcaggttgattgttgggaaagctggcagttgtgtttagatgtgtacacaca

SEQ ID NO: 155279 - DNA, 568 bp, Homo sapiens
gaggctgtctagaggatccctgctatcatcggcaccaactggaaaacagaggggtaatgtatcgctccccctgtagaataccaggtttcaaaacatatggttacgggaaacatctagattctactgataaatgtgatgcctggtgaagtttgacagccacaggtctaaacggacctgggagcagaagtgccaggtccacttagagcccaacactagcttttcaatagtggggcattaactgaaaataagggcacagctcattctctctacacccatgttggttccatcatacttcatatccctattcccagaagtactgctcatgtctcctaggagtttctcttcttcctcacagtaaaatccagcccccatcccacagcctgtaaagccttgtatctgcccttccactctcccagaggatccttcagtgccagatacagtggccctttgtatttttcaaactctccaagtgcttggtactctgctcagaaagcatttttttccaaatttgagcatggcacactccctcacttcctccagatctcagcttacagggcacctcatccca

SEQ ID NO: 155280 - DNA, 920 bp, Homo sapiens
gtttcaccatgttggtcaggctggtctcaaactcctgacctcaagtgattcgcctaccttggcctctcaaagtgcttggattacaggtgagagctataacacctggcctgctaggaaagttctttatttgagaaaaagctatgggatgttattctttctctcccgtcacatggggaagcatgtagtattgattgccacaggtagctatcttatagctctggatgaagaatgaggtggtttctgatgacatagctggatcaaccagttctgatgtcagcccttcctctggatttagtcctggctaatacacctttcaaactcacttactcatctgatctcctgttgtcccatttccttctccctctttgtctctcagcccgtccccttcagattgacattttatttgcagtttggttttctaatttatttttcccagtagatactaacttttcctctatctttttccacattttacacggaggctagcatctcaccattgtcacaatgactgccagttcccaggcctcaacctggaatctcagaagcaactctttttgtacagctgaggggcacctggaacatagaagttaagaagagatctggctgggatcaagaaacctcttttcactgcacctgaggctcagttgtgccctctgctgacactaggtcaggaggctggacagctccaactggaaacttggagcagggttttaagacctctgctttctcactttgaagaattggaatagaaaaatagaaaatacaaaaatgatgagtccttggaattgataggacacgtagacttgagagacttgaacatgttttttgtctgtttgattcccttctctattcccagtgtttcgagcagttctagtccatggtaagtgctcagtaaatatttgtgctgatgagcaagcaaa

SEQ ID NO: 155281 - DNA, 651 bp, Homo sapiens
tcccatgagtgttcacaggagatggtgccatgcatgcacagaagttcccaaaccagcatccaccatatcaaacccggaatctgtgtgagaaggcatgccttcatacttcaggcagtttacaagacagccttagctttcgttttctgcttgctacagagccttaaggtcagccagaagcgagtgactggaaacttcttcattcccatctctctcctggcatctcaccattgtcacaatgactgccagttcccaggcctcaacctggaatctcagaagcaactctttttgtacagctgaggggcacctggaacatagaagttaagaagagatctggctgggatcaagaaacctcttttcactgcacctgaggctcagttgtgccctctgctgacactaggtcaggaggctggacagctccaactggaaacttggagcagggttttaagacctctgctttctcactttgaagaattggaatagaaaaatagaaaatacaaaaatgatgagtccttggaattgataggacacgtagacttgagagacttgaacatgttttttgtctgtttgattcccttctctattcccagtgtttcgagcagttctagtccatggtaagtgctcagtaaatatttgtgctgatgagcaagcaaa

SEQ ID NO: 155282 - DNA, 353 bp, Homo sapiens
agattctctacttcaggtatgcaaaatccaacataacactatacgacctcaggaaaggccaaaagactccctttatgtcagttcatataatacatacaggcatgagaagatataaaagatgtgagatatggcaaggtttctcttcaaatagcctgctcagctacttattctctaattccaggtaccccctgcctttcttctccttttttcttctttctgattttactacatgcccaggcatgccacagccccagctcacattcctttccttatttaggaaaagactggctctctagtcctctgtagatgaccccttcctcctctcccctctctcccatcatgcgcccacctta

SEQ ID NO: 155283 - DNA, 240 bp, Homo sapiens
tgagatgcagcgacttgttggttttggctgcagcgttttcactgagcccactcatcagcctgcaagctacttgaaaggagagtgatgctttagtcattcctatatactcggtgtttagcacagtctttggctcatagaatgaggatcagtaaagaacggatagatgggccgggtgtggtggctcatgtttgtaatctcagcactttgggaggccgaggagggtggatcacctaacattag

SEQ ID NO: 155284 - DNA, 406 bp, Homo sapiens
tttctgtcatatctacctgagacatatttgaggcagttattaacaattttgccccattattttgtctgatttgaatattaagtattaaagggttcattgaccaaatgtccttgaatttgaaattttggggactctattatgagtgataaatttaactgcgagctatatggcaatttgttcctgagatcatttaaaattgtgtgagagcgtgtgtgtgtatttatatttgttcgtttatacttctttgtccatctttgccatatattttgggcataattgaagaataaacacttcttaaggaacaagttataattgtaaataggaattaactgttattttccttctattgtattgcaaagctaaatgatggtggcagataccactatgggatgaaagtaggctttgt

SEQ ID NO: 155285 - DNA, 425 bp, Homo sapiens
ccctgactgtaaataaatcccaaaaatctttagacatcagtcaatgccattacctccaaggccacagaggccaaaggcaagagaggaacaagaggaggacattttttaaagatcttgagatcagatcccaatttagcgtatccctatcaagtgcagaatctgaccccatgcaaacagaaacatctctcttctgctcctacgccccatgttcttgatgggttctatttttatttgcccctacatcatttccagtgagaagggattcccacagacagccataggtaaagggtcaaagagttgattccacccgggacaagggaggctacgatgacttagaccatcagccaattccattcatcagaagactgatgggctaccacacgccctctgcagtttaatgttctaatggaggaattagggggcca

SEQ ID NO: 155286 - DNA, 540 bp, Homo sapiens
ccatggccctacgcatcctgggccaggtctcttgtggtgcttcacgctctcgacctgtgagtggtgcctgctagagctgcccagatcccttttccctaccccttctgaccctggacccagagtggtggttgcgatctgctaccgtgacgtcagccctcattcgttcgttccacaaactccacagctctggtccattagaggaaggaggtcccagaatagctgggaaattacgagaacagcctcactgcacgagttggtgaatgctgtgatggcgattgtatgatggacggtgatgttgaaaccagactggtggaatgaccgccccatccggagaggtgagggtaaactttcgggatgctctgagtccagagatgggtttgaaagatgcaaagttaaccaagcagccaaggtgggagccaggctgttgcctgaatggagacaagcagcgagagtcaaaacccagagtctggccatacttagtatatgctatactaagaaatgtggatttttctccgttggccattggactgcttttgaaga

SEQ ID NO: 155287 - DNA, 518 bp, Homo sapiens
gcggcgcctttttttgtagactaatttgagtcagcatgcacatttgtcacatacttgtattttgaaaaattacacccaatttacataaaaatgttaatgccgcaataatgtaatcattttaaacgtctttaaggaacttttctttttttggcaaacgaagtcagaacaatgcaaattgattacagaccgtggtttttggtttgactttctggagagaaattacacacacacacatttatgcaaatctatgtgtatatgatggtgggcgcagtggctcacatctgtaatcccagcactttgggaggccaaggcaggtggattgcttgaggctacgagttcaacagcagcctggccaacatggcaaaaccccgtttctactaaaaagacaaaagaattagctgagcatggtagcgtgcacctgtagtcccagctacttgggaggctgaggcaggagaatcacttgaacccgggaggcggaggttgcagtgagccaagattgcaccaatgcactccagcct

SEQ ID NO: 155288 - DNA, 498 bp, Homo sapiens
aacgatggtcctcagctgaaacaaacctaaagtcacctgtcatttgttttaatggttaagggtcaggaattgaaagttagacgtaggttttagtttcagctgtgcttctgtgtgattttagttacttaatttctataagcttcagttttcttatgtgtaaaataagtatccattcattcatttgttcattcatccattcaataaatagtaagtacttcccatgtgccaggcctgctcttggtgctgggaagtgagcaacagggaaagcagagaaaaatctccgctgtcatggagcttcaattcatggggaaatggaatgtaaattacaagaagttaaacattttgtgtatcttccacatgtgaatatatatgagatgatgacaattgctacagacaaaatgacacagcattggggtagagacaagattggaatgcgattactatttcaaggggggtagacaggaaaggctactgtaaataggtcatatgtaagctgag

SEQ ID NO: 155289 - DNA, 323 bp, Homo sapiens
ctcagatgaacaccgatcactggatcaggacccactccaatctagtatgacctcatcttaactaattacatcagccaaagaccatctccaagtatggccacacacacagctaccaaggttaggacttgaacatactattttgggggacacatttcaacccacaacacagtcgtcccttaaccttgttcctataagaacaaagagtgcagaacttaaatcattcacttgttaatgtaattattacgttcaatgacaggccaggacacaggctttcccaaggccttctttcttcacagatttccatgcaaaaaaaaaaaaaaaag

SEQ ID NO: 155290 - DNA, 218 bp, Homo sapiens
gcctccagcctcctcccctctacatcacattgctcatccccaccttgacctctgctatgaacaaatggagctttctttttttttagagacagggtctcactctgttgcccaggtggagtacagtggtttgattgtagctcactgcagcctcgaactcctggcctcaatcgatcctcttgcctcagcctctcaagtagctagtagtacaagcacgtgtc

SEQ ID NO: 155291 - DNA, 509 bp, Homo sapiens
aagaggtcagctttatctgctcagcttcatcagctcattgaaggatggggaaggcccaaggagccctgaaggagagatgctcctcagccctgctgcgtgagccctggccttgcgtgctccagccctgcgcagatgcctgcggagtcctggctgcagcctgcttgtctgcgtgagcaccccttaaatgctatgtgtgtggagctctctctaatggctgtggacccttctgccctgaatgagcatgcagacagcacccccacactccttgacctcacttatggcctaaggaggtgctcatcccaccctggttctccccatggcctgacgcatgcagtgaatgccagaggccgcttgtgtgccttctgcctaccctttggactgccctctggggtgggcggcaaattaacactctgattcttctgtctgaacacccaccagtcaaaaggagaaggcagagcccctgaacagcggaagacagagcccacccagctgaagaccaagcacctgag

SEQ ID NO: 155292 - DNA, 383 bp, Homo sapiens
tactgtcccgatagccccctcctttatccgatacccattctgcatcctttggtcactgtcccagcacatggccaggggcaggagggccctctagttgtgctggaaaagtgaatgaaggagtttcccatctgtgcaacaatcagcttggccttgatggcccttgagcttccttctaacattctcccataacatctctccagacccgtctttctggccacaccaccatgctttttcccccagcctgtttctcttcattacacagtaagtgagttggaaatagttaaattaatcattctgccccatggtgcccaaccaagaggactccatctagacccaacccatagactagcatatgttccagaaatctcggacttggagctgca

SEQ ID NO: 155293 - DNA, 232 bp, Homo sapiens
atacaccatggtccccaaagcatactaactcctctggcgtgttatgagaagaacacgtgttctgacctgggtgagaaagtggctgcacagtgtgtactgcagtacagtattgacttcttgtcccccaatacctatcctcccccctttcctttaataacggaacccctatattttagccaggcacctgattgacttgaatgaggactacatttcccagcctcccttgcagcta

SEQ ID NO: 155294 - DNA, 261 bp, Homo sapiens
cgcccacatataagtgaggacacacggtgttttaactttctgtccccaagagtgtcttattcttctctctcaaggcctgtgatctgattcctggtccaaaagaggataaaggtgacaaattggtgggagcagataaaagcaggtgtggtgagtggcagtgagagggcaaagggtaagcacccaatgccgggtagggggaggaccttagccccaccagctcctgagccccaaggctttcacaggacggctcagaggaagggt

SEQ ID NO: 155295 - DNA, 458 bp, Homo sapiens
agaaatatttctggaagagctatgcaactggaatgcttggagagccacccgcatggcaataactcgatctgtcctcattttttagaacagacataaacccgggtttaaaaaaggactcatggctccaaagcagccaaataaataaataaacacaaagaaatctctcagtgacttatggaagccattaatgagaaagttatgtacataataagaacttgatttcctttctctctctctctctgtatttcctgaatctgaacattggcctgccttgctagactggggaagttctcctggataatatcctgcagagtgttttccaacttggttccattctccccatcactttcaggtacaccaatcaggcgtagatctggtctttgcacatagtcccatatttcttcgaggctttgctcatttctttttattctttttttctctaaacttcccttctcgct

SEQ ID NO: 155296 - DNA, 433 bp, Homo sapiens
cctgcctcagcctcccgagtatctgggattacaggcacctgccactgcacctggctaatttttgtatttttagtagagatggagttttgccatgttggccaggttggtctcaaactcctgacctcaagtaatctgcccacctcggcctcccaaagtgccgtgattacaggtgtgagccaccgcgcctggccatgaaacctcttaacaatgggaaaacatacccaactctaaatctaacctcgtgttctcctggagcgcaaaatcaggttgcagagaatcaaagtatacatacagcacagttaaggcacgatttgcggcactgaagggaatggttattgaagcgtcaggagacttgaatgagacatgagtcctctgagaagaagcaggtgtctggaggctgaagctgggtggggaggaagagaggatggtggga

SEQ ID NO: 155297 - DNA, 278 bp, Homo sapiens
caggaagcgcttgctgacacagcgctgatggagccgccggcagaagacgggaactctcatagtgtaggaacagctttgaagttctacgttttaaattcaagaagccaatttgctaacattacccatcatttagttccatctcaatttaacagatggtaaaaccaacaagcagatattaattttttcagtaatgacaattttatgactaaaccttacattgcatgtttacctagatatgattagagatcaacttctgaagtgaacatatcacaacccct

SEQ ID NO: 155298 - DNA, 560 bp, Homo sapiens
ccatttcctcagcttccttctcattatgaaaagagcattatctaacattgaacttgtcctgggcaactgagagtaggagagactcacaaatgccccctgccttcagttttacgcccaagggagagatcccaggtaatgcttgcgtcacaatcagcacacttctcagtggggcaggccactaggccaactaaaacgtggtcccgatatctctgcaaggaccccttgtatctcggagtggtgggagcagagaggtgagccggcagatgggagggcaagacttaacctcagatctgtaaaagtaacaagtcaacaataccttaatcttcactgtaagctactatctactgctatctactgcacataatatttatagtacatctgttcctctttagcttatgaaaaaagattacagagtatctacttaaatggaagaaaaatctacattttaatttatggcaccagaaacaatgtcagttttctttgtcaaaaatagtcagcagagggagctcaacactgctgctgttcgaaatggctttacttatgcacttgtctcatcccag

SEQ ID NO: 155299 - DNA, 284 bp, Homo sapiens
atacttgtctatggatccacaatgcctagctaaataggtagcccacagaacatcctcacatttgcctcaataaatggttgctgaattgacttgagtcaaaggaagcactgaaggccaagaagctgaacgactggccaatgatcatacacagctagaacaagaactcactacaccagcagtcctctctctcctcttccacaccaactccctatattacaaaacatgatcctaatggctcattattttattgtctttcaaaaccaattgttcttcctagaacactg

SEQ ID NO: 155300 - DNA, 235 bp, Homo sapiens
cccttcccaagcttggagccagaaacagccacacagtgaggagaggactgagtggggcgcgtactgagcacggataggaggggaggaagagcgaagacttaggacttggggtcaggccacatcaaggcagggacagaaaatagaccagacgacactgcaacccaccaggggagggggaaacagagcacacagtaaaactgtcacccgctaacaaagccacacgcggagtgggggc

SEQ ID NO: 155301 - DNA, 405 bp, Homo sapiens
cagcttcctctttctttaaccctttctccatgtctctgtctccctcccagcagttctcagccctggctgcacattccagttaccagaggagctccggtaaatataatgcccagactccactccccaaattctgattaaattggcctgagacatgggaatttgtgttttgttaaaaagcacctcagataattctaatgtgcgatcaaggttaagaaggcccctcggccgggcacagtggctcatgcctatgatcccagcactttgggaggccgaggtgggcagatcatctgaagtcaggaggtcgagaccagcctggccaacgtggagaaaccctgtctctactaaaaatacaaaatcagccgggcgtggtggtgcatgcctgtaatcccagctactcaagaggct

SEQ ID NO: 155302 - DNA, 417 bp, Homo sapiens
catgtcattggccttttctcacagtgaacgttggtgctgttaaaagactttgagcagaaagatatgatcagacatttttataaacatcatgtggctgttggggtaagaactggctgtcaagggacatgactagaagcagagagtccagtggggacgcccctgcagtactgcaggcaggaacccacgctggcctggcccatggttgtggtagcagaggtgctgagaaaagcagctggattctggatatgacatgaaggtgtagccaacaagatgcacagcaacactggatgtggaggatgaaagaaaagaaggagtcaggaatgactctgaggtttttggaattagcagcaagacggattaagttgccgtagctgagacagcaaaggattgcaggagaagcagtttaggttggggaga

SEQ ID NO: 155303 - DNA, 243 bp, Homo sapiens
ggcaggaaaaccaaatgtctggcctaatgagttaggttgattgatggacagtttcaactgattggttacttgacatgaggtaggctaaatgcagatagtctatctctcggcagtcatgctagaagctgtggctagagattttcagggtacaatgcagatccacaattatttaggcaattttttttaagtttacatttttatttctcctccatttgaatttcttctctgtttcttagtactcct

SEQ ID NO: 155304 - DNA, 158 bp, Homo sapiens
cttcatagataatctcccattgtacattcaagtttataagttacctgcattcaattctaggaacctgcataaaaagccaacctagttttatttttccttagtgatgattttaagcatcaaagggtttcccaagtaaaaatgagtacagcaaaaagaat

SEQ ID NO: 155305 - DNA, 387 bp, Homo sapiens
ctcgtcggagctgtactagctggatcaggcgcacgatctcactcactgcaacctctgcctcctgggttccagtgattgttgtgccctagcttccctagtagctgggattatgcgtgtgcaccaccacacctggctagtttttgtatttttagtagagacagggtttcaccactattggccaggctgatactgaactcctggacctcaagatgatactgcaccgcctccgggctcccagaagtgtgggttacatcacagaattttattttctcacagttctggaggttggaagtccaagatcaagctgctggcaggtttgatctttcctcttgcctccttggcttgcagatggtcacctttctttctcattgtatcttcatttggcct

SEQ ID NO: 155306 - DNA, 226 bp, Homo sapiens
ttagcaggtttgtgatgttcataccttcactggcaattcacaagcaatctgatgtctagtgatcacagatcaaaatggataggaatcaatgcatggcacaacagaattaaaataatgtttttcaattgtgaggcacttagaagaaatggattttaatatctatcaattccacatgtaaatcaaatgaatcctgaaactagcttctccaaatcgaattcaaaggaaa

SEQ ID NO: 155307 - DNA, 292 bp, Homo sapiens
aaaatgaaagaaatgtgcaaaataaagcagtttaaatggaaacagaaaagcaaagccatgacatgaggaggaggaggaacaaaatatgtgaaccacaaggaccaatctggttataatgattgagtgtgaaatttcacttcctggcagccagactcagagcctttgcagacttaaagtgacccgtgtattctctcttgagctctgggtgaagtaccaaaggagagaaaatgaattccttttcttttccttgacccgggtcttgccttggaaccaatgtttttcctcatatctg

SEQ ID NO: 155308 - DNA, 694 bp, Homo sapiens
acaaagaaacaaaaaccggcacatgcggttactgtgggctccagttcagacagcaccaccactagagcgtgtggcacgccgggggtcccgcagcatcctgtgagcatttccgcggggaagctgagctggttctgtgcgaagggtattcctggtgctgaataaagggtgttgctgtcaaggctgacaatttatatctgtgtgaggctggattttctttgcctactccaaccaaagcgacacatcacagcagactggatgcagaagcgtgcgtgggaatgcagctgttttccatggaaccagacgctacagagactgcaacgtgtaaaacactgccattcttttcattcctttgaataatttttttaaaatttgctatttaacacgtaatagttttttattttaaaatgaattaatactttttcgttttgagatggtgtttcgctctgttgcccaggctggagtgcaatgacgcaatctcagctcactgcaacctccacctcccagtttcaagtgattctcctgcctcagcctcccaagtagctgggattacaggcatgcgccaccatgcccgactaattttgtattttcagtagagacagggtttcatcatgttggtcaggctggtctcaaactcctgacctcaggtgatccacctgcctcggcatcccaaagtgctgggattacaggcatgagc

SEQ ID NO: 155309 - DNA, 388 bp, Homo sapiens
tcctcctgccttggcctcccaaagtactgggattataggcatgacccaccacacctggcctgactggtgcattttcttgtatgttaactatacctcaatttttaaaaatgtttttcgttttgagatggtgtttcgctctgttgcccaggctggagtgcaatgacgcaatctcagctcactgcaacctccacctcccagtttcaagtgattctcctgcctcagcctcccaagtagctgggattacaggcatgcgccaccatgcccgactaattttgtattttcagtagagacagggtttcatcatgttggtcaggctggtctcaaactcctgacctcaggtgatccacctgcctcggcatcccaaagtgctgggattacaggcatgagc

SEQ ID NO: 155310 - DNA, 396 bp, Homo sapiens
ctacgtgcaagtctcattgcagcttgagcctaggagatccaagctgcagtgagctgtgattgcacttctgtactccagcctgggtaacatggtgggattacaggcgcgagccaccgtgcccggccttatgtggtctttctggttggtaaatattctaacacacacaaattaatcattagatcaaaagaattgtgttttggtacgtagttaaggtgctcttttcttttaaatatacactccttgctgttcttcctgttccctttgcagagcaaaagtatcggaaaaaaacaagtgcaagcacttccttctaatattggtttagttgtggtcaaaaacaggaattatgagtcatgaacaccaaattgacaggaatgagctatgcgaattacatcctaa

SEQ ID NO: 155311 - DNA, 328 bp, Homo sapiens
gaagtacgtacttcccttctgttgctgatattgtcatgagcagttccaccctcagtgtttacctctatgctttgaaatcttctctcaaacgcatattcattcctattttttgtaccctttgggattcctcaatctcatatacatctttccatttctgacctaatcccagcactttgggaggctgagccgagcatagtggggtgtgcctatagtcccagctactcaggaggctgaggtgggaagatcacctgagcccgggagctggaggtttcagtgagctcagatgtgccactgcattccagcctgggctacagagcgaggccctgtc

SEQ ID NO: 155312 - DNA, 363 bp, Homo sapiens
tatacggccggtccgtgtgtcgagtagcatgtcattgctctactcagaaccttccgctggcttttcatcaccctcagaagaaactccatgtccttaccgtggccggcacagcccacacggctggatccaggttacctctcagacctcatcttctgctatgcttccctgcagggttctgcttgttagccaccctgatctctgccagtgtctcagcagtgcctagtgtgatcctgtaacagagcctttgccttggatattccttctctcaggagctctcctctccctcatagccacataatttgcctctttacttttcaggcctgtgctcaagttttcccacattagaaaagtcttctccatctc

SEQ ID NO: 155313 - DNA, 534 bp, Homo sapiens
  misc_feature (278)..(278): n is a, c, g, or t
agtgaagtcttctccagaactcagaagggccataaatagagagacaaagggcaggaggtgggagttattcaccagcgtggaggaagcaggataagcccagaggaatggcctctggaattatacaaagaatttggaggtgactgggggtggccctgggaacaaagtgaaactgtcagaactcagataacagtccacgttcctgagattggattgtagcagcccttctggaaaaggagcacttcttgggactttatacaaatccagctccatccaaaatngctgcaaaaaaaaaaaaaccacaaacattatttggtcctttttaatggctaagtcatattccagggtgtagagataccacattttatttatccactcacgggtggaggggtgggttccacatcttggcaatggtgactggtacggccatcaagtgtctttcgggtataacgacttcttttccttggggtagatacccaggagtgggattgctagatcaaatggttcttaacattttctctctggatctattgctgg

SEQ ID NO: 155314 - DNA, 426 bp, Homo sapiens
ctcggagtcagtatgaaagagaacaggccttccaataagtctttactggatgagtgaatgaatgaaatggccacccggggcattgctaaattaagtaccttgagcttagtcatcctaaccatagtccccccaggcattatctgtgtggccataagccattttcttagccactctcttcttcagtaaaggcaagtagagtgtaatgaagaatactgtgagaggacaattaccttagaaggcattatcagactaatgttttactgagtgcatagagtacatatctataggttaatatgcctttactatgcaatgcatccagaaatttcaaagtcaagaagattctaggaggctgaattccacctttagaaatctcagctatgaaagctctgggtttcaacttgatataactcttcactggccagaaaa

SEQ ID NO: 155315 - DNA, 669 bp, Homo sapiens
gcatagactgtgccagaagaaactgacctaaaagaaacaagcagatcaattctgcattattctcacctaaaggctagccacatgatgggctttgaagctaatttatatcttcagacctttaaaaagaaaaaaatccaacctgggaaatagtcccaaaggaattgatgcctaagtcttcctgggaatcaactaataaaaagctggctcagattaaattaaaaaatgggccccaactgcattgtcttctggttatcaaacatcttctaggtttagaaacagaagaccagtggctggtcactagctttcacttgtggaatgaacacaactatccgggccatttatacccaatagaagagttaagttgagatgctgaatgaatatggggtccctgactttaagcttcatacctagaaccaccacattttgcaatcagcagaggcccaagaaataactttttcccataaaaatctccaagctgacttcaaattgtcttttgttcttatgagtttctacatttccatggagatgaataagacagcaagctaaatatgggcgtatagaaaaaagactaacatattgatctcatatttaacttgagtgcctctttcatactcatcaaaaactgtgcaaaagaccaacaatacaaattgaggcacctaagtctcacag

SEQ ID NO: 155316 - DNA, 673 bp, Homo sapiens
ctctggatgcaagtgtcttacccaagttcattcatcaataatttttgagttataccaagcaatttgcctgcagagattcaatgttgcttaaattaccatgttgcctcaattcttaggaagacttctttttaattgagaggtcttcttgctcctttatgtcagaaggaatggtcacattgctgactttttcttgtttatggactgatgactcatttatgagttatctaaacgtcttgttccttctttctctcttctgccgtctctatcatgggactattttctttctgctagcacttctactagagattgtgaaagggtggtgacagtgaattaactccttgttagcagccttgtctcttgagaggaggctcacccactgctgctgactgataagatgatgacaatctctgcttcctaaaaaatcttctctactattaagttggtgcataagtcattgcagtttttgccattactttgccttccagattgcctcttgcttctctctgctctacttgctccttctctgctggatcctcttcctgggtaaacccttaaatgtgttacattctttaggatctgtccttgtctgtctttgattctgcctgctcttctcggtgatcgcagacactcttgtgtcctcagttaccatctatctgacacttgcatcctaaat

SEQ ID NO: 155317 - DNA, 328 bp, Homo sapiens
gaattcaaattaggacatcactttttgtagatagaactcatgctagctttgtttttcattgttaagctcctccagtaagaagtaaaacaacagcttatccaagcagcttaatgagcattgtgggttttatctttgcaaagattagagcaaggacgttcaagcttaatagcctcaataacagttcctaacttttttctatctgagatcctgaaacaggaaagatgagattttttaaagagctagtatgctatatgtaaagaaaaaattaacttgttacttatatataattataagtacttattgggaggaggctatgaagaggtgattt

SEQ ID NO: 155318 - DNA, 325 bp, Homo sapiens
ccaagactccagggaggaacaagaccaagtccctgtcccatggagcacatatactgtattaatagttcaatataaggactagattgcttttctttcctccctcctccctctctcctttgtattcctcactttctttttttcttttttctttctttcttttgtttttgttttttttttagatggcgtctcgctgtgtcacccaggctggagtgaagtggcgtagtcttggcttactgcaacctctgcctcctgggttcctatttttagtagagatggggttttatcatgttggccaggatggtctcgatctcctgaccctgtgagc

SEQ ID NO: 155319 - DNA, 608 bp, Homo sapiens
aaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggtggggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagag

SEQ ID NO: 155320 - DNA, 396 bp, Homo sapiens
actctctgaccgccccacatagccccttttccagaaccttcgggatatcctgccttcccccaccaggtggggccctgaaggactgacgtgggggacgtcacgaaaggaccaccttgtaccaggcacccgctttgtacggcgggaaaaccagcgagtccagaagcctgagtctcttctgcaaatccactccccctgctgagtcctgggatctcagtcaaggggcgaattcctgatgccccctgccaccctcttccctctccaaaccctgaaatctgtccaaatggggggtgtctggaggcgtggcttggaggcagtttaagcaacagctaaaacggttgccaattactttttaaaaccattaatttaattctccccgaaagtgaaggggaagatggg

SEQ ID NO: 155321 - DNA, 470 bp, Homo sapiens
tcaaggagacactgctgagaaagctgttttaagtgaaatgtctttgacttgtggatggatcttaaaatattattttgtgtaacagcacaacttttctgtggggcaagggctcggttactagccaaaatgtatattaatagatttttaaaaatacaatgtaagcttcatggagacaggtcccttatctgtcttgttcatcaatgcactacttattacagttcctgacacatggtaatagtaatcagtaataactaatatttgagtaacaataaagacataagtgctttatgcccatttaactcacttaatatttacatcaccccagaaatgtttggtgaatgaattagtactttttacaggatgataattagtcagttcctcaataatgtaacatatgggttcctaaaaaccaccaaactatgtaaaattgtgcaattaacaccatagaactcataggaaaaatgaggtta

SEQ ID NO: 155322 - DNA, 234 bp, Homo sapiens
tcaaacccaggtctgcctgtaagcaaaaccctttgtcctttccatagcatgagggcttaaatgacttgatgtatgttcctcgtgaaggaaataccatactttaaaaatgaaatcatatttctagtattttttgatgtctgtaaaggtaataagcattataaatctttttgagaaaatgcttatttgctgtatgcatatacttactctcttttgcttccccccgcccacgacccc

SEQ ID NO: 155323 - DNA, 644 bp, Homo sapiens
caattccctaggggtacatgggccaaaaagagagaccgactcagccaagaaccagaaatatcctcaccgcagcaaacaagctagtgatggaaaagaggaaaattttcccttcaaggtctggacatttctcaaagacagcccactcagcttatataagccgcatgcaccactaaaggaacacaaccaaggccccatgaatctagaacaatcttgccaattacgtgttaattgaaagttatgtagaggccatccacatgcccttggggaaacttgacactgtacttattgaattgtctgttctggatcactgacctgggcaaaggggctcaggcaacactcaaaggacagtggcaaagtcattccacattccatgggtatcagttcagagtttccacccttttttgaacctttcctccaaataaataggcagtgatggtgtttagggacattctgggcttccttgtattcattagttcatgttttcatatatttatgtacttgtaaattgacaaatcttgtcttgaatatacatttgctaagtatcacctctgtttcaggttaatgccaggtgctgggaacatcaaagtgggttagatacagtggggtgctggtaagtgatggccaactggcttgctatgtgtcgg

SEQ ID NO: 155324 - DNA, 707 bp, Homo sapiens
gacagaggagactgtgcaacagcataaataactgtgaccaatcctggggactacatggctgaaaattgggttggagaggggtggaatggaagagaggactctagaaagataaatagaatctgagccatgaaagactttgaatggtcagagctgggctataaggaataatctggaaacagtgcaagctagattttagtgaggagagaattatgtccgaaggatataatgaagcttaaactaaggagaaggacctagaaactgaatacagaggaagagattatggaagtataatagaattgcccagtgggaggaggaatcattcttgatggtaaaggaaaggatgttgatgcctttagaaggaatacagctgtccaaagcactggctctcaaacttctttaggcttcggagtcacctagagggtgtgagaaaacggattacttggccccatcccccgaatttctgattgaggtacacagacaagtggagggagaacaagtcaacaaggaggtttactgagtgttagagagctcagaggagactgacagtgggtagctcttctctgtagggaggtcatcccgttgagtgttcagctctcagcagaggggaggccctggagagtgtggctcctctctgtacctggtcctcccaacctctgctcagctctggctgagactggggcttttatgggcctcagagtggaggaagt

SEQ ID NO: 155325 - DNA, 517 bp, Homo sapiens
gacagaggagactgtgcaacagcataaataactgtgaccaatcctggggactacatggctgaaaattgggttggagaggggtggaatggaagagaggactctagaaagataaatagaatctgagccatgaaagactttgaatggtcagagctgggctataaggaataatctggaaacagtgcaagctagattttagtgaggagagaattatgtccgaaggatataatgaagcttaaactaaggagaaggacctagaaactgaatacagaggaagagattatggaagtataatagaattgcccagtgggaggaggaatcattcttgatggtaaaggaaaggatgttgatgcctttagaaggaatacagctgtccaaagcactggctctcaaacttctttaggcttcggagtcacctagagggtgtgagaaaacggattacttggccccatcccccgaatttctgattgagtagatttagggtagagcagataatttgcatttctaactagttccccgg

SEQ ID NO: 155326 - DNA, 709 bp, Homo sapiens
acaaacaaacaaaaccacacacacaaaaaaacaaaactcccatgtcttgatcttaatgattgtgagcaaggatggtaaaaagctctgctggctgacccctaagaccttgaatggtaagctacaatacagatatcacagtcccttacagattgttcgaaaactcgttggatcataattaacattgttagaactctcatacattacatctgatcctaaaacaatactatgtgataggtagtattgcccaagttacagtgatgaggttgaggtttaaaggttacatgacttgtttagggtcataatactgaatctgaacccagatctgccttgaatatattattcttcccaagttaccacacattgaagaagacagtgttcatccttttcctacacccactgcttagaaattttgtcgtgggctgggcgcagtagcttcacacctgtatcccagcactttgagaggccgaggtgggcagatcacatggtcagaggtttgagaccagcctggccaatatgttgaaactttgactctactaaaaatacaaaaattggctggacgtggtggcatgcgcctgtggtcccagctacttgggaggctgaaccagaagaatcgcttgaacccgggaggcagaggttgcagtgagctgagatcatgccgctgtgctccagcctgggcaacacagcgagtctctgtcttccaaaagaaaaa

SEQ ID NO: 155327 - DNA, 327 bp, Homo sapiens
gcttcccctgtggttagattcaagggcctctgtccccaccccatctgtgctgaagatcccttattcacacaatagagctgccctgcctgggggtggaaaaatgtgaggctgggcctgagaacttgtgggaaagtggaaaccgtgttttacccaagcaagtcccagcagtgaggttggataggcttaacacccagtcctgtgctcgtagtgtacgcctgagcctgtggaactctgtgcccttctgggtgcacccctgagcctgtggaactctgtgcccttctgggtgtacccctgagcctgtggaactctgtgcccttctgggtgcac

SEQ ID NO: 155328 - DNA, 498 bp, Homo sapiens
tgctgggattataggcatgagccatggcacccagcgaaaaatatgttttgataaaattggataacattttgataaaatttgccaaaatgcttaccaaaaatgacttatcaagtcatgctgtagctaacagcaaatgagaatgccaatttattcataaactcattagcatttggttttctgaatctccttatactttgccaacctgatatgcaacaaaagttagctaattgttttaattatggttcttgaaattgttagtaatactgagcacctttcctatgcatattggccatttgtattttttcttctatcataggcttgtttgtattatttgcacatttttccttttttgtttttcgtttctttctttgttttgagatagtcttgctctgctgctcatgctggggtgcagtggtgagctcacagctcaccacagcctcgaactcctaggctcatgcaatcctcccacctcaggttagcgctggcctacagcacatg

SEQ ID NO: 155329 - DNA, 324 bp, Homo sapiens
tgtgacacctaatgggtatagggtttcctttgggggtgataaaatgttctaaaaattaaattgagataatagttgtacaactctgtcgataaattaaaaactatcataaagcttttaaatggtgaattgtatggcaggtaaactatatctcaataaaactatttttaaaaaagaacatggaggctcagacccgagggaaatggagcaggaggaatgtcctgtgatttctagtaaaatgttcaactataccacacagatttgctctgttgtccaggctggagtacagtggggcgattacggctcactggagcctcaacctcccaa

SEQ ID NO: 155330 - DNA, 169 bp, Homo sapiens
actgcaaccgccctgaccctcctctcggccatagcccctctctccatctgctctgccctaccctaccctagacattaggtcctgttccccatggcttcttttccggccccagaggtcctggctcccttccccctccctccttccctgcccctctggtcagtccctgcct

SEQ ID NO: 155331 - DNA, 441 bp, Homo sapiens
tgtactgttaccccattttacaggtaaggaattttccccaagtctcaaggctagtaagtgcaggcttatcattcaaactgctcactcccaatctcctgttctctctactctgcactaaccacacttctccctgaatgttcacgtgtatattacaagaatgaacagaatcaggctaggcatggtgactcacacctgtaatcccagcactttgggaggctgaggcaggagaattgcttgaaccccagaggcagaggttgcagtaagcggagatcatgccactgcactccagcctgagcgacaggcgcgactccatctcaaaaaaaaaagggtttttcttctatgggtgataaaattatttaaatactttaattggccacttgtaatttagtaaaatatgttaatacttacatttaagtacaaatgaattctaagtaatcagta

SEQ ID NO: 155332 - DNA, 415 bp, Homo sapiens
cgccaccacacctgactgttttgtagagagagggttttgccatgttgcccagggtggtctcgaactcctgggctcaagcaatcctcctacctcagcttcacaaagtgctgagattacaagcacgagccaccacgactggccctaatgcctatatttttatgggtgaaaatattataataactagatagtctgaaaatgatacccatatggggttgaaagactctgaagacgctcactgacatccacaagggggcagtatgtcacactgaagaagctgcagtgtgtgtcacccaaaatcagtttcattccagtcatttgaccccgtgtcaagttgacttccctttacaccagcttctctgtacttatgtattcagtacaacaaaggggatttttaaaaactgtgttcttgatcttc

SEQ ID NO: 155333 - DNA, 190 bp, Homo sapiens
tttaacaacaacaacaacaaaaacaacaacaaaaaagcagcctcaaagtgaaatgtactgccactatggctttttatcaaactccacctctgaatgttgatttcagtcctgaccgatctcttctgaatctcactcactgaatgtgctttctctcacctgtgaagtgcctgctaccacaatgtctgcctaa

SEQ ID NO: 155334 - DNA, 292 bp, Homo sapiens
cggggccaggctctggagggaggggctttggttcttttgtccgtgttcacgtctgagcgtggccttggtgcgggtcctgtggatggtcaacagttggtcgggacccagccacagcctggggggaggggaccaaggacactaccgggatcgtttaggggtgtaccacttcctgagatggaggcccagggagggaaggagacacctcaggtggcaggggctcctggggcgtgtggagtgccagatcattctgagggtggagaattcatcagctcggtgagcacccagcagggct

SEQ ID NO: 155335 - DNA, 228 bp, Homo sapiens
tccaaaataatcaactgccaccttttcagcaaaatcttccctgggtactacctaaaatttcaaattccttcccaccaattcttatctccccctttcctgcttattactgtctacatactatgttttgcttatttaatctgtctccctttctagaatgtaattgccacaagagtaggaaatcttttattggcttatcctcagaatctgcaacagtgtgtagcatatagt

SEQ ID NO: 155336 - DNA, 477 bp, Homo sapiens
agccaatcatgtctccatctctataggtctgtcttttctggatactgcatacaaaagggacaatacaacatgtctggcttctttcatttaacatgttttgaaactgacccatttgtagcatgcatcagtattttattcattttattggtgaataatatttatttatccatttacaagttggtggacacttgagtggtttccactttttagttttaatgaataatgatgttatgaacatacaagtctttgaatgttttggacccagctttcatttctcctgggtgtatatttaccactggaattgcagggtcatatggtaaatttatgtttaacttcttatgaaactgtcaaagtattttccaaagtggctatgccattttacattcctaccagcaatgtatgagggttcttgtttctctatatcctcaccaccatttattattgtctgcttttctgattaaggtcattcagtaagtg

SEQ ID NO: 155337 - DNA, 754 bp, Homo sapiens
gtttcaacatacacgcagcaaaaacttacagaactgcaagaaatccgcaattatatttgaatatttccgttaaaaaggccaacgagactacagaaaaattgatgaaagatgtgaagaatttcttcacagaagggaaaacacatggctagtaaacatttctttaaaaaggtaagagagtgttaaaaatttggaaaatgcaaatgaaagccacaatgagacaccattctacacctacacaattggcacacatttaaaagtcgggcagtatccagtgtaggagaggttgttgctcagcagaaatgtgtatacagtgctggtgggagaacagtatggaaacatctactaaaattaaagaagcacatacaccaaaaccgagtaattcacataccattgtataccctgtttctacaatggaccaggagacatatatatccatgaatgcaacagtcagtgaaaaaaaagaagaagaagaaaaaaaaagaaaaccattgaaaacaacccaaatttcctttgttgggacaataaatcaataaactatagcatatttctataatgaaagactgtacaggagtaagactgaactacttctcagatcaatgtgcataaatgtcccaaatataatgagagagaaaaagcaagttgcaaaaaatacacataatacattgccatttatatagtgtcccaaagcatgtaaaattaaataataaattatcacactatacattctcatgtagcaagaccatataagcaaaaa

SEQ ID NO: 155338 - DNA, 598 bp, Homo sapiens
aagaggacccgggttcccttgtctccaatagcgagcttctggttactcatatctgagtttcctaacagggattccagtcttctcatccctcctctattcctaaccgggagttctcgaaccaggaggccatcaaacgtcccaaggattcctctaaacaaacaaatcaccgtttcaccatttcagcttcttcccctccagccaccttcccatcaccctccccaaccatctccaccccagccagggccaacaccattctgactgttgctttgcctgcctctactttacccctggtctttgactccctgatagaaaaagctgaggcccaaggcctctgggctgactgctcttttggcataagtcctccacacccttcccccacaggtatccccaacagggtgtggagaggccgctcttttaccttgaagttctactttgttctactcttgttcctctgctgagacctggttagccttcctggggcctgactctcccattctccagcaccagccctgacctgacctctcctcctccaaaccctgcatggggccctgcaaccaagcacagctgtgtctggtctttgtccagacatcaaatggtc

SEQ ID NO: 155339 - DNA, 308 bp, Homo sapiens
gcccactcccacaagaaagcgccagggtttttccaaggccaatgtgatatttatggcagtgcttatgtatttcttaaactttaacgtgttaaactgcactacaacttttgttagattcctgtcttactgacaaaggttttgagtgtggtgcccctcaccctaccttccaccaaaagccctatcatttctatcatgtgatttacacaacagtgatttttaagcagcacatgctgcgttacagaactgaccctatttcaatagctacatacacaactaacttgtttcattaagctgttagcaccaaagtg

SEQ ID NO: 155340 - DNA, 631 bp, Homo sapiens
tcagcctgaccagacaccagcctcctgtcatgagcggtgctccatctccaccacggtgccccctacaggcaggccccccacacctgagcagagtccacttccagaacagtgctccctctgcagatgacacactctatccaaacccagtaccccaaaatccccaagcagggacagcaaaggcaacgttcagccctgcaggtgccacaaattccagccctgccccacagtacagcctctgaattcaggctctcggctctgcttttaagagttttggagcagtggtttctgcgctcaccctgcctcctcccggaaggaaccctcactcggcagaccttgcactcccgcctcccctcaccagaacatctgctgggcactgagacggacaccatggtcagcctggtgcttgatgaacaaggatgtttccagacctgtgcagctgagggttcgagggtccacacctgaagtctcattaggagccagcagggttaaaggggctgagcgagtgagaggcagactcgccagaggggagggccctgcacacgggaaggagagtggaacagggcccccagatgaggactcaatgaagacgtgggaagcggggtgaggaaagcaagccccacccctccccatg

SEQ ID NO: 155341 - DNA, 445 bp, Homo sapiens
gggagagatgcaaaagccccaagggagaccaggcacgagcttccagctctcctctgcaggtagagagagtcccgcggacagtgctcagttctccctgcaacagcgtgtggtaacgcttacggagcagtggcggcccgggttgtggggaggacatggcgcacccgtgtggctgaactgaggtctgctgactccagcccctccagaggtcgtgctgatactgtatgacccaaagcccccactctaggtcacagcgtcaacatggactctctagagtggcctggggccccaggtaaacaaaggcgctcttatctggcagcacatttcaagaacatagagattctcctggagctggtcaagggccattttctctctttggaatgtgcagatttgaacagcccaggcttgccaagtcactccttcacacataaacatctcccttcagaag

SEQ ID NO: 155342 - DNA, 600 bp, Homo sapiens
aatcccagcactttgggaagccaaggcaggcggatcgcagggtcaggagtttgagaccagcctggccaacatggtgaaaccctgtatctactaaaattacaaaaattagctgggtatggtggtgggcgcctgtaatcccagctactcaggaggctgaggcaggagaattgcttgaacccaggaggtggaggttgcaagatcgtggcactggactccagcctgggcaacagagcagaactctgtctaaacagacagacaaaaaacgcactaagaaaaacattcagcgtgcaagtgacatctcagaggcctaacagatgtgttgctttggaagcagcaaggtgcattcatgtgtgttagatcgtagcccaggtccctccatcaaaatagctcacagctactgcagcccctggcactcacttctttgtacttttccatgagaacaccagcttacctatgcccacacatctgtggccagggtctgccacctgccctggacaacgtaccttttcccggaagcttctgttcctgactgcaccagccaggcgagcgctggccgccctgcacaccctcggagtgccgtccagctggagcagcgcccag

SEQ ID NO: 155343 - DNA, 283 bp, Homo sapiens
gcttttgcaaatcctgcaaactttgatctcctaaaaatggaaataataccaaccttattgtgaaaatgatcaggcaccagttagtaccataaacactatcattaataattacctcaaaattactattacagtgagccaagtcacagagtaacacacttttagatgcaggctgaacacagctagtcttgcttcagtgtgcttgctaaatgagacaattttatcactttttcaggtagatgagttctgaggctcagctgatggagtacagtgcaaataacagcca

SEQ ID NO: 155344 - DNA, 766 bp, Homo sapiens
ataagaaaagcttcattttcagcacctactagcaataagcacttaatatactttgctaatcctcataactctgtaggatcccctctctgaaagagcgcaaattctaaaaaggaagttaagacatgcacctaaagtgttattttaacaacaaatacaagggatgctttgtgaaagaggtagtcttgattgctgggtgaaatgtcagcaggaagaaatatggaagtatacagcaagcagaaacagagggcatgcctcatggtctcaaaccagtccagcaagcagggactatagagtgaggtagcaggaaataaggctggcaagtgctaaggacagagttaagtgggaagagtaataaaatttatattttagaaaaagatgatacccagggggagtgtcacctcttgtgggaagccgcattacacaccctcttctgtgctcccacagcatgctgaaacctctctgacaccgttctccgtggcattgcattgtctcatgtctgattttgtggaaaggcaacagggctctggagtgtgatagacctggctcaaaacctaacttcacccacactagctatgagacctcaggcaagctctgtgctaaatcaagctttcatttctgcatctgtgaaatggatgagatgatctcaaatgagatagtgtattaaatttgtcatgtagtgtgcctgccatgtaagaggcattctaagatttttaggccccttggtccctagttctgagcttcttgaggtcagaggtctgtcatatgc

SEQ ID NO: 155345 - DNA, 382 bp, Homo sapiens
acaaacaaacaaaaaaacaaaaaacaacaaaaaaaccaaaaacctgtgttttttctttgctttaattcaaatttatattcatgccttttggggaatattcattcaataagggagccattacatggttttctacataacaaaacaaacaagtaaaaagcaaacactcaacaataaaactgtactgtacagtaagcaatacccgtttttgtgatgctagctatttactaacttctttggtacaatttagtttctgggaatatattgcagttttcttttttggttcacaagtaatgatcacgtattaaaaatgattaatgttgattaagcaaaagtaagcacttccttcatttccttttttttctatattttgccagttttatta

SEQ ID NO: 155346 - DNA, 196 bp, Homo sapiens
tatcacatgatagcatgcatctatgccaggtttaatgccatcgagcatgaatattcattattataaaccagctggttcttagagtggttgggcaggcctttgcataaagaaagaggaaacaggaaagtagaggaaattgcaagatttgtttgttttgcttcatttaatggaatgaaattgctgtcaaggggttttg

SEQ ID NO: 155347 - DNA, 1025 bp, Homo sapiens
ccatgtgggcatcactggaggaaagtcaagaaccgctgggtgcagtggctcacgcctgtaatcccagcactttgggaggcgaggtgggtggatcacctgagatcatgagttcaagaccagcctggccaacatggtgaaaccccgtctctaccaaaaatacaaaaatcagctgggcgtggtggtgcatgcctgtaatctcagccttccaaagtgctgggattataggcatgagccacctcacctggcctgctttctgtctctccgaagatccagagctgtgttcattccagctggccctgtgacctcatgcaaattattgcccttccattactcctctgtatgagagggaataatcctaccctccttgtagggggttgtttgaatttcactaatggatgcaaagtgtctgacgcacccgaggagctgggcacgtgggaggctggtacgcagggcacaggacataacacagatgcccaggtacggttggcacaggcctagcaaacattttaaagcactcactctgtgccagcttcttagattaagcatcttacatgcattacctactttaatcctcggtgaatgtgagtatcagtttcattttataactgaagaaacgggcactgagacgggaagtcacttttacaggctcacatagatgatagttgatagggctgggagtccatctgagagcctgtcctccctaaacatcatcctgtccccttcctgatgtgaatcaccaagcaagggacaacacaattcatagatccaggacaaggtttatggcacatacttctaaggggtgggacctggtatcatggacacggcattcaagagatagtacatggtatagagtctgtcacaaaacagacatcacatggtgcatgaagcatgacccaggggtaagaggcatgggatgccgctaaagggagacacacaggacaaagcaagaggaacgcagggcctgctacgtggcacagtcacagggtatgtgacactgggcatgacaaactctatgatgcagagac

SEQ ID NO: 155348 - DNA, 718 bp, Homo sapiens
tttcccctctagtcttcattatattgcccttctgcttgttttgtgtttagttttatctttttctagctacttatgatggaagcttaaattattagtttgagatcttcttttctaatataaacacttaaagctatatatgtccctctaagtactgctttagctgtatcccatatattttaataagttgtgtttttgtttttatatagttcgaagtattttctaatttcctttgtgatttcttcttgaccaataggttatttaaaagtatgttgttagtttccttatatttgagaattttctaaatttttttctattgtagattattgtttaattcttctgttatctggggatatatttcccatgattctagctcttttaaattgattgagattgttttgtggactaccatatgaaccctccttgagaatgttgaaaagagtaagtattctgtcgtccttgggtaaagtactcaagaaagatcagtcacgtcaaggtgattgatagtgttttgcaagtattctatgttcctgatgattttttaaatctagttgttctatcagttattgagagtggaatattgaagtctccaactattatttttcagttttatatttctttcaattctgtcatttttgctttatgtattttggggatctgttgttaggtgtatatacatttacaattatgcttttcttagaaattgaccattttatcatat

SEQ ID NO: 155349 - DNA, 217 bp, Homo sapiens
gatccctacaacctctatctgtatcccatgctactctactccatgttttgaccacaaaagctttctttcgcttgcctgaaactatcatgctttttcagacttttgtgtatgctctctcctcactcctttaaataacagatgaagcctattcttcacatttttagcatagtccttactttttctgggaaactaagttagttatttctattatatacag

SEQ ID NO: 155350 - DNA, 482 bp, Homo sapiens
tgttacctttcaaggctgtgtgacccctctgacaaggcacaggtcattggaaccacagaatggtggtttgttttgttttgttgagacagagtctcactctgtcgcccaggctggagtgcagtggcaggatctcgagtcactgcaacctccgcctcctgggttcaagtgattctcatccctcagcctcccaaggagctaggattacaggtgtgcaccgccacacccagctaatttttgtatttttagtagagacggggtttcaccacgttggccaggctggtctcaaactcctcacctcaggtgatccaccgcctgggcctcccaaagtgtcaggattacaggcgtgaaccacagcgcccagcaatatgctatgtttttttgttttatccctagctgttaagtttcctatctttaagtctatgcctcagagagaaagacgaaatataatccaggcaggatttctgacttgcgggggcacctgc

SEQ ID NO: 155351 - DNA, 245 bp, Homo sapiens
ccgaggcaacggaatccacagagagaaagcactgctttaggttatttagcgagctgatggcagaggtggaacagaacctgcctctctgcccagccagggattccataaggtggtgcaaatcaggagaaatagatgacactatttgtggagttcttatgaggtccaggcactacctcagatcttcacatgaactaattcatttaatcctcacaagagccagtgaggaaggggcaattattatcccc

SEQ ID NO: 155352 - DNA, 428 bp, Homo sapiens
tgttgaaagacaaaaacaacccaccaacctagaattatttctgttgttgttgttgtagaactggggctctggctatgttgcccaggctggtcataaactcctggcctcaagtgatcctcctgcctcggcctcccaaagtgctgggattacaggtgagctattgtacccagcccaacatagaattctatttccagttaaattatccttccaaaatgaaggataaataaagactttcttagacaaaaactgagggaattcacatccagctgacttgctctgtaagaaatgttattgagagagggaaaatgataagtaggaaactcagttcttctttttttttttttagttttgttctttcacccaggctggaattaagtggcacaatctcggctcactgcaacctctgccccccaggttcaagccatttt

SEQ ID NO: 155353 - DNA, 268 bp, Homo sapiens
tagctgggattataggcatgtgccaccatgcctggctgattctggatttttagtaaagacgaagtttcttcatgttggtcaggctggtctcgaactcctgacctcaggtgatccgcccgcctcggcctcccaaagtgctgggattacaggcatgagccaccgtgcctggccagctgtttatatatatcttatctcccctctgcagagggttcatctctgagggaagcactaggaaggaatcatagggtctcaggctgggcactaagcc

SEQ ID NO: 155354 - DNA, 167 bp, Homo sapiens
cgccagccagccaactgtgaccacggaaaactctgaagatgataaagaagaggggacgttccacagacagtgaagtcaccgcagtctccagccaaaaacggctccaagcctgtccacagcaaccagcaccctcagtccccagctgtgccgcccacctacccctccgg

SEQ ID NO: 155355 - DNA, 231 bp, Homo sapiens
ggaccattattaaaataataattacaatgacggtaataataatagcagcagctaacacttcatgagtgcttcctatatgccaggcacaattctgaactcctcacatattaagtgttaagcctgctagtgaccctatggtgtaggaatgattatttcccccattttagataaactgaggcatggagagctcagtaacctgcataagatctcatatctagagagaggcagaga

SEQ ID NO: 155356 - DNA, 299 bp, Homo sapiens
caccctgacaggcccgccctcagagctgtcggtgccggtgggggtgtctggccactgcctgtgttttctgggagccccaaggccaaggctgtggcatgcctgttgctgccccaggtgccccacagggttttgtggcgggacaagcactgagctcacggtgggttctggtcccacctccagccacagctcccagtgtggcttgggcactcctcagcctcgccgggccccaggcttcctggtggtggggttgggtgctgaccatctccatgggtgccactgtctggatcccccagccattt

SEQ ID NO: 155357 - DNA, 269 bp, Homo sapiens
tcctcacagtggtcaggtaaggaaggggggtggtatagagtggacccagaatcatttctggaaggggtgacctgggtagtaataggcgtctgctggtctgaggaactggatggcagtggataagctgggcttgttggtgtgagcctgtagtcctagctaattgggaggctaaggcaggcggatcgtgtgagcccacgagtttgaggctacagtgagctatgatagcaccactgcactccagcctgggcaacagagcacgaccctatctc

SEQ ID NO: 155358 - DNA, 393 bp, Homo sapiens
aagtaggctcagctggaaagtatacaacgtctttagaagccccatgctgggtggagggaggagtaagaaatcaagagcaggttgaaatacggaagaataacagctgcaagtgctgaccccagcctggacaaccaaggtgcaatacttgtgggacttagtgagcttagcacagtttagtttagatctagtctggcttagtgataagggattccatgcagaggtacaattcagaacaggattggtgtcctcttcagcaattttggaatctatctcactgtggcaagacttccaacagtgagatcaagtcccagaggagacactgaggacgtaggcaaggctaccagaaactacaggataggctgggtgcggtggctcacgcctgtaatcccagca

SEQ ID NO: 155359 - DNA, 495 bp, Homo sapiens
  misc_feature (17)..(17): n is a, c, g, or t
  misc_feature (19)..(19): n is a, c, g, or t
  misc_feature (22)..(22): n is a, c, g, or t
  misc_feature (28)..(28): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (45)..(45): n is a, c, g, or t
  misc_feature (49)..(49): n is a, c, g, or t
  misc_feature (58)..(58): n is a, c, g, or t
  misc_feature (91)..(91): n is a, c, g, or t
  misc_feature (115)..(115): n is a, c, g, or t
tcggaccggaaatcgtngncgnggtggncaatctcngnancgtcncttncctcctgcnccatctacggcaggtagctgagccgtggccagnggctgactggttcctgcggttcanatctctgcaaacgtctccttccctcctgccccatctacggcaggtagctgagccgtggcccaggctgtgggattttcggaggaggccttccattttcatctgtcctgttatcaaaccaactgcattacttagtgtctgcttggaagtatctgtccttcgcagtcagcttactcttttggccaaaaggaagctctgctcctagatatggataaggaatttgacagatctccagccctgcccccttaggagaaggccagcccctctgcttcttcccctgtgagtggacgtccttggatgcattagctcaggcgaacttggaagattctgtgggttttgtgtggcctattttgagtctcattgtttggctttaatcagaaaaa

SEQ ID NO: 155360 - DNA, 564 bp, Homo sapiens
aacccgggaggcagaggttgcggtgggctgagatcacaccattgcactccagcctgggcagcaagaacaaaactccatttcaaacaaacaaacaaaataatctgttaagacagtaagaaagaaaggcaaggcagtcctctggttgattgccactcattggcgatatatatattgcactctgtaggggtcatgcacagtgctagtgttagaatttacaaaaataagtagagatagatgtatagatcaatggaataggattcagagtccaaaaattaggtctcacatatatgatcaattaaattttgacaagagtgccaagacaattcaataaaaaaaggcttcttcaacaaattatgctggaacaactggatatccacatatacctaaaactaaatgggatccctattttataccatagacaaaaattaattcaaaagagatcaaagacctaaatgtaagagctaaaaccatgtagaattcttaggaaaaagcaggcataactctttatgaccttggattaggcaatgatttcttagatatgacaccaagagcaccagtaaatat

SEQ ID NO: 155361 - DNA, 301 bp, Homo sapiens
tgacagcagcaataactgatgtttactgagcatttactatatgccaggtaccattcagaaccctttacgtgtattaactcttaatctatacagcaaatcttgtgaattactattactgttcctgttttttttttctttttttttttttcttgagacagagtctcactgtgtcaccaggctggagtgcagtggtgcgatcttggctcactgcaacctctgcctctgggttcaagtgattttactacctcagcctccagagtagctggtaccacaggggtgtggcacacccagcgactttttt

SEQ ID NO: 155362 - DNA, 154 bp, Homo sapiens
gagaatcgcttgaacccaggaggtagaggttgcggtgagccgagatcgcgccactggacttcagcaagactctgtcacgaagaaaagaaaagccagctggggcctgtttggggctcatgcctctaatcctagcactttgtgagactgaggtgag

SEQ ID NO: 155363 - DNA, 689 bp, Homo sapiens
tgcatcttttgagtaagatcatctggcagtagaagctgttctccaggtacatttctctagctcatgtacaaaaacatcctgaaggactttgtcaggtgccttgctaaaagccagatgcgttcggcacttccttggtctgaggttaattgcacacctacaggcactgggctcatgctttcaagtattttgtcctcactttagggtgagtgaaagatccccattataggagcacttgggagagatcatataaaagctgactcttgagtacatgcagtaatggggtagatgtgtgtggtgtgtcttcattcctgcaagggtgcttgttagggagtgtttccaggaggaacaagtctgaaaccaatcatgaaataaatggtaggtgtgaactggaaaactaattcaaaagagagatcgtgatatcagtgtggttgatacaccttggcaatatggaaggctctaatttgcccatatttgaaataataattcagctttttgtaatacaaaataacaaaggattgagaatcatggtgtctaatgtataaaagacccaggaaacataaatatatcaactgcataaatgtaaaatgcatgtgacccaagaaggccccaaagtggcagacaacattgtacccattttcccttccaaaatgtgagcggcgggcctgctgctttcaaggctgtcacacagg

SEQ ID NO: 155364 - DNA, 512 bp, Homo sapiens
tcactcaatatcccataagtcaggaaattctgttggttctaccttcaaattatacccagaatctgacctcttttcaccaactacattgttactaccctgtcagaatcactgtcatctttcacctggaacacagcagttatattcaaactggtctctctccttctacgcttaccctactactccaccctcaagtctattcttaacacagcagtcagaatgatgctcttaaatttaagtcagatcatgtcattccagtcctgatgggaggaaaatgtgatgctgttgcttcttctggccatatggtgtatgagcctgttgtgattgcaatgcaagtagtcctgggttactttttgctgggatgattgggaaacatgggaaattatggatagttatacatataatgtatgatacatttcagcctgctgagagtaaagggagtagtttaactgccgtttgccacaggagctctgtaatttattgtatggtgtgaatcaacaactaattttatcgtt

SEQ ID NO: 155365 - DNA, 558 bp, Homo sapiens
tgcacgtacattatctcacttaattccctccacaagcctgtgaggcacacacttcagtacattttgtagatgaagagactgaggcacagagaggttaagcgatttacccaagtttgcacaagttaacacatggtgatgctggaattcaaatccacagtttgatttcagagtctgtgatcttatctccctgcatagggcatgcactaaatgaaggtacaaacgacgtagctatgtatgggaaaacaaaggcacaattacttttcactgaggggatcagtaaaggcttcatggaggaagaagtgctggtcccttctattaccttttgacctaatctctccagatgcctggaaaggatgacaaatagcacatagccacaaaacttgaacagagtaaattcacattgttacatgatactgttaagttagaaatacattcattttgctagtttagaaaaaaaatttttttttttttttgagacagagtcttgctctgttgcccaggctagagtgcagtggtccagtctcggctcactgcaacctccacctcccgggttcaggt

SEQ ID NO: 155366 - DNA, 353 bp, Homo sapiens
acctggggcctggcaaccccagcactggcttggtggcaccaggaactcactggatggagtctgggtgcccttccccggccccaaatgcacagagtgggtactacctggtcaggaaaacctcccttcttcctggttttcacctgaggtgcctgcccagggtttagggtggtggggaacagtcccagaggaaggaggatacttgattctgaagacttctgaagagacagactcagtgggcacccacatacagaaacccagtccctgaagccctttttatctctgcttgtctgatgtcctaggcaggctcctggctttgtttagttgggccctgaagtgccttggaaactgtgtct

SEQ ID NO: 155367 - DNA, 191 bp, Homo sapiens
cccaaagtgctggggttacaggcttgagcctccatgcctggctctcctctctcctactcagcccatgtggtttacctgagtctatctgaaccctggtcagattatgggacccagaccttgccagtcagaacatgtgagtgcgccctggacacggagactgattcagaggacggagagccaagccaggacac

SEQ ID NO: 155368 - DNA, 319 bp, Homo sapiens
acaccggcccggtatgtatactgtgggggacttggaggactcccaggggctgaggttttctgtgttcctgatcttctctgactgttttactttattcaatgatttaatttcaaatgaactttggaaaagtaagacgtggtcatgactcataattacaaagtgagaaaggtggtgacttcagtgaacattcagtctccctcctacctctgacctccaggcactacgcagttctactggccaggggcaaacactcctgccaatggccatgcatcttcccacagagatttgctgcatttacaaacatgtgtgccacgctttt

SEQ ID NO: 155369 - DNA, 342 bp, Homo sapiens
tatacccaaaaatactcaaaacataaaaagtttggtccataaataaagcaggagaacaactccaatttctattctctgttaacagaaggtttctgtctaacttgttcttttccttatgaagctgtagaaatgagtctggcttgaagaattctatttttaaaaactcttcctatttacatatgctttacttctcaaaagaatgtcaccttcctattaatgcaacacttaacaaaggcaatgtcagaaatgtaccgtggtgggggctttgtttctcatttgccattttttgattggaatctgtgataattcatgtgtcctcattgtgagacaactaaaaattat

SEQ ID NO: 155370 - DNA, 435 bp, Homo sapiens
aaagggcctgggttgtatgagcctcggggtaaaatcggctcctctgagcctggcttgaagcatttgttgcctggcgctgtgatagtgataccagcggcaccctgtggcctccaacatggcccagatttcagtgagccctcggccctcttcttctctgagtcccccacacttcagggcacgggctcaggaggacagcagacaggctgcatctgctccatgagccacaccttccatggatgatttgtggagctactgtcactaatgacccagtggcgtaaaacaacaggaattgcttccctcacagttccagaggccagggtctgaaatcaaggtgttggcagagtcctggtccctccgaaggctctagggcagtggtccccagtcttcttggcaccaggaactggtttcgtggaagacaatgttttccacaaacag

SEQ ID NO: 155371 - DNA, 450 bp, Homo sapiens
ccaggtagacctaacctgactagaaaagctattacctaaaacaatttcacagcaccaaatctccacctccgtcatcacctcaacccaaaaaggcataattaaactttacttcctctctttcttcttcccactcatcctaaccctactcctaatcacataacctattcccccgaacaacgcactacacgttaggtctacctggccaggtagacctaacctgatttccctattgcaaattctaaccatattctcagcctctgtattgaactcccctgctattgcactatttgttccctagcactgagagccttctaagacgctacacaatgtatttatttactatgcttactgagtctctctgtccctaccactccatataagctacacagaaataggggtgtctgttttgttcactattgaatagttaggtctacctgggggtaccgagct

SEQ ID NO: 155372 - DNA, 400 bp, Homo sapiens
ggtgcagtctccatgtgaaatgcccatttcagatccagaaacccccaaaatgtcccaacgtattggaaaggagttctgttaactcaatcctcgggaagataccaaaaggacttttttgctttttgagtcagggtcttgctctgtcgcccaggctggagtgcagtagcacaatcatagttcactgtggcctcaaactcctgggttcaagtgaccctcccgcctcatcctcccaacagagtaaaagaggattactgattcctttaatgttacacaattccagacttagataaatccagtcttacattctgtctatgctttcatctgggcttgacaaatactagagtgaaaacacacacaccccacaaatgctaattctagaaatattttgttatccactttt

SEQ ID NO: 155373 - DNA, 500 bp, Homo sapiens
tttttcccctaagaatgtacgcctggactcctcagagcctcagtttccccaattctctgtctcttcagggtcctttcttttagacctacttgttcctgccccttctccattccctcttctttttaaaaaaaattttaattaaaaaaccaaatacagacggggtcatcttggccaggctggtcttgaactcctgacctcaggcgattcacctgccttggcctcctgaagtgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaacca

SEQ ID NO: 155374 - DNA, 479 bp, Homo sapiens
aacacggtctcagctcactgtaacctctgcctccttggtgcaagcgattctcctgcctcagcctcccaagtagctgggaccacaggtgcccgccaccacacccagctaattttttgtatttttagtagagagggggtttcaccatcttggccaggctggtcttgaactcctgacctcaggcgattcacctgccttggcctcctgaagtgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaacca

SEQ ID NO: 155375 - DNA, 470 bp, Homo sapiens
ggcttaggcataggcatttgtcatattatagctaatgtatattaatatatattttcctaaatttacaaagtaataatgagaaaacaaataaaatacaaaatttaggatttcttttactttgtcgattttgatttaacagaatctcattctaaagattatgaagactgaccatatcggtaataaatgaacactgatgtattttaatttaaaagacatttggaggttcttacaaatttttttcacttacatttaatcttctaatttttttcacttacatttaatcttctaaattatctttaatttttatgttgtggctctttccttttcaagcttcaattctttctcttaccacctttcttattcttccatgcctgggtcatagaactaaatttacctgttccacaaatgtcattatcagtatgtattttattttaagcaagtccatctcctcagaggattcccttgtatcc

SEQ ID NO: 155376 - DNA, 420 bp, Homo sapiens
attcaacctagtactctaagtcctagccagagcaataaggcaagataaagaaataaagacatccaaataggaatagaagaagtcaagctatcttttttccactggtaatatgatcctatacctagaaaacccttaagactctgccaaaaaactcctagaattcataaatgactttagtaaagtttcagaatataaaataggggtacaaaaattagtagcatttctatacaccaataatgttcaaggtgagagtcaaataaacaacacaactcagggctgggtgcggtggctcacgcctgtaatcccagcactttgggaggctgaggcaggagaattgcttgaatccggaggcagaggttgtggtgagccaagatggcgccactgctctccagcctgtgtgacagagcaagactctgtctc

SEQ ID NO: 155377 - DNA, 252 bp, Homo sapiens
ctaggattacaggcgtgaaccactgcacccggctgtacaagtaacctttatatataaccagtttatgaaagacttaggatataaatagaaccagtttataagggattccttctgattatgaatgaattaaccaatttatgattgacatctataggaagagggataaccaagttaaaataggaagagagagagaatgtgtattcttaactttttatttgaaataacatcctatctgtggaaaagttgtaagaa

SEQ ID NO: 155378 - DNA, 289 bp, Homo sapiens
gggctttagtcgatactagcccaagtatctgcaggtttaatttcagaataaaaagccactgtaacagttcatagctggcccaagctggccgtaacaacactggcacctaggaatacctgagggtattttaaggtgcaggcacttggttcccacccacccagatccagtggctttttattctgaaattaaacctgcagatacttgggctagtatcgactaaagcccattttcatctgaaggaagccatccagctactaacattatattgtgtactgagtattgtataaag

SEQ ID NO: 155379 - DNA, 363 bp, Homo sapiens
ctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatac

SEQ ID NO: 155380 - DNA, 547 bp, Homo sapiens
tagagatgggggtcttgctttgtttcacaggctggtcttggactcttggcctcaagtgatcctcctgccatggcctcccaaactactgggattactgccaagagccaccatgcccagccccctaaatttataatataaactcagaatgtaaacaataatcttatttgtccctctgcacaaattgtataaaatgctagtttacttttcatcttctatttcaaatcacagaatatttctgcccatgtttcatgtttcaaaagatctcacatagcctaggctactcacacctgttagcccagaactttcagaggttgaggcagaaggattacttgagcccaggaattcgagaccagcctgggcaacataatgagatcctgtctctataaaaaatacaaaattagccagacacggtggcacacacctgtagtcccagctactcaggactgaggtgggaagactgcctgaacccaggaggtcgaggcagcagtgagccaaaattgcaccactgcaccccagcctgcgcaacagagcaagatcctgtctcaaa

SEQ ID NO: 155381 - DNA, 465 bp, Homo sapiens
  misc_feature (78)..(78): n is a, c, g, or t
tgactctcttttcggactcagcccgcctgcacccaggtgaaataaacagccatgttgctcacacaaagcctgtttggnggtctcttcacacggacgcgcatgaaacacacgactgcacttcaggctgggcgacagagctagattccatctcaaaaaaaataaaataaaaaggagtcacctcccccgagaggcctctggaccaccccatctgagcaggccactcttccttctctatcttaccgtcttgtttctgtcccagtagttagggctacctccagtaatcctatttgtccctttactgtttagtgcgtctcgcttgactagaagctccatgaaagcaagagaccctacctgcctccttcgccactagaccttctgatgctctttccccacccttggaggaggaggaaaggaagaaaatgggccctgagcgatcaccacataccaggccctgggggtctagtg

SEQ ID NO: 155382 - DNA, 230 bp, Homo sapiens
gcagtttaatgttctgactgaagtacagagacaacaatacaatttgattttgttttttaatttaaagctgcctaaacctcaaagttcagtgttacttgctctacattttcctcaggctgatattaaagggactttcctctattcagagagcatggatgagagaatgtttaaaaaaaaaaaaaaagaaagaaaagaaaagaaaaaaaccctgaagagtctggattaagaat

SEQ ID NO: 155383 - DNA, 379 bp, Homo sapiens
ccactgcaagatgtgcagatttctagttgggggtgcaggttgtaagacgcactttctggaatagaccggacagttggctatggagaaggaagaaacgttcttgcacaacctagagaggggctccccctgaggatcagaggcagtgagtggggcgctggaagggtggagtctaagacaccaggcgggacccattaggggacaccttcccctctgagccctcaggtactaggtgcccagaacacataagccaatttcagcatcattctaagagaaatattattagaaaggtgttccccaatatcatccaactcactcaaagctaaacagaagtgggtctggatttcttgcagctttcttttgttgtgatgcactgcacctg

SEQ ID NO: 155384 - DNA, 259 bp, Homo sapiens
catggaagccatttctgtagaataggctagtgtccagttttgtccagttttccttttggagcagtgtctcaggcacagaaatagtctgggcttggtggaccccaccccaaagtgtcacttcttttcctctggccttgctctccatgcccgcctttctcttctgatgttttaatgataccctccctgctcggtgatttgtgttcaggaagctaggcagtgattacttttgtttctgctttgtgaacttcctcccccactt

SEQ ID NO: 155385 - DNA, 432 bp, Homo sapiens
cttataggcttaattaaagtatatgcaaggaaaacatttgtggcaccataataatgtcttgctgtaattttacagcaatttccattcctttttcttgcctccacaaagtttcacagcagtaggatacaatttttgcaacactgaggcggtactaggtaggccttagtgactgggaaaagtgaacccgtctttccgaagggcgagtttgtttgcctactgtcagtgggaggagtgtaaatgaagacctttatccaaagccagcgtctatgaacaaggacagtatgtttggagcctggtcagtgatgagagtgataacgtacatgctctctattcactaagtctttaattgcgctctgttcagacactaaatattggctgtggtcattgcctgcccagtatgcgaaccataagctggggtggaggcgttgagtg

SEQ ID NO: 155386 - DNA, 344 bp, Homo sapiens
cctgagtagctgggattacaggcgtgcaccaccacgcccagctaatttttgcatttttagtagagacagggtttcaccatgttggccaggctggtttcaaactcctgacctcatgatccacccgccttgacataccaaagttctgggattacagccctgagtcaccatgctcggcctctttttttgttgttgttgtttttttaactttgtcttgcctcccctgggagctgaatgattatatagatatacatacacatacacctgctgagaagggagaagtgagggcgaataggaacttgactgggctccctcaccttgagcaatcttctcctcactgctaaaca

SEQ ID NO: 155387 - DNA, 543 bp, Homo sapiens
agaggaaacagttcctaactaatttcatgaggctggcataatcttgataacaagtctgataggtaaagtatgaaaggaaaattgcaggtcactcaattatcactcaaatatctacatgaaaaattctaaacaaaattttagcaaacaaaatccaacaatttgtaaaagtgataatacaccacgaccaaggtggttcaagtcaggaattcaacgttgattttggcgttaaaaaatcaatcatcaggcccagtgaggtggctcactcctgtaatcccagactttctggaggctgaaggaggaaagatccttcaggccagaagtttgagtctgcactgagctgtgactgcatcaccgcactctagcctgggtgccagtttgagaccctgtctccaagaaaaaaaaattaatcagtgtaattcaccacagattaagagttcaaaagagaaaaatcacatgatcatctgaatagaggaaaaagcttttgataaagttcaacatccattcataataaggactctcagcaacttagaagtataaaaacac

SEQ ID NO: 155388 - DNA, 468 bp, Homo sapiens
ccagacaggaaaactgagatggtgtgagcagaaagggctggaaggagttggctttttccaagaaattacagcggaatcttcttccaagaggctgggggcctctgcagacatgatctcattacttaccccccaaatcccccagcttccctacggaccaaggaccaggggtctctgcccagtcctagctccaaggaaactcacacttggcagattttcctaattggagctggccttgaagtttgctcactgataatcaccagaaagtcaccccaacaatgggtgatgccagagtgtcctcaagcttcaagggtccgtaaaaacacttgactcccccaggacaaaaatgactgggggaaacatgcagttcttcaaagagaacggtttcattctgtaccaaagggtgtcttaatttgccttggcaagagaggcagcaccgtgttgtgggtggacagcactcggggggtggac

SEQ ID NO: 155389 - DNA, 333 bp, Homo sapiens
caaattctgccagtgcaatttttgcctaggtagggaggcagattcttggtgcttcctacttcagaatcttctgggaatccattcaccttatagttgtacttattcaacaacattttattaaactcagacagatgtaagaagtgttttgagtgccaaaattacagtgatcaaaaagctgaaaatcttttctcacatagagcttatattgtaatggagagaaacggaaaataaacaagcaaattatctagttggttgaaaggatggggtagaaatttttagacagagtctcgctccatcatctacggctggagtgcactggagccatctcggctc

SEQ ID NO: 155390 - DNA, 261 bp, Homo sapiens
attaggtgctcaggcttccagtggaacattcttcttcctcttgcaccaaagccagcgacctttttcctagggaagcattcttcttctatgtcagtctcctatcattgccattttctggtcccaagacttcttgcatacactatcttctggcatggcatgtatactaaaacttgtacacactctcagatcttaaaatacaacaattatttctctaattagatagttacctattttctatgacttcagtgattgcaaattcca

SEQ ID NO: 155391 - DNA, 221 bp, Homo sapiens
cccaaagtgctgggtttataggcatgagccaccatgcccaactaaatgtaattttatattcctaccaacaacgtaaagggttccagtttctccacatctttaccaaaacttgtttatttgataacagtcattctaatgggtgcgatgtggtaatcttacatttttagtattttcatatataagggataacatagtgctgcccctgtggttattatcacatt

SEQ ID NO: 155392 - DNA, 356 bp, Homo sapiens
tattttagaaggaaagcagatatatagcaattacctctttcaaaaaatatttcgagttttagaagtatagaaatttccttaaaatgtgtaatttataaataaaatcttaccagtaaatgtacagtgttcaaagctgagaatatccaccagaaaatatgttcaaatagcacaaccctaacaaactgttttacaaagaaaagcacataatatagtttgtgtattagtttggaaggaatataatttgtacctctatatcgtggggtctgcattctgaataattcacaatacctaaatggaataccacagaataatatggctaaaaaacagttaatctacactacactttcaaattcaga

SEQ ID NO: 155393 - DNA, 308 bp, Homo sapiens
ccgatgcaggagagtggatgatttgattacagccagtctttaaaattgaagccaacagcctggctgaagaaggctgagcttttacataattgagcaggaaagttcaccgccaagatgggaagtgctccccacagcacttggccggagcctgccctccccagctctgaggccctgcagccctagttgcacaagtgagacatgaaatgtcaaaatgtcaggcacatcaggagagcccaggacagcagctccatcgcgcctctcacccagcacagcatctttggcaccagagggactgtggtccccctggt

SEQ ID NO: 155394 - DNA, 196 bp, Homo sapiens
ggagaagtctcagatggttgggtcagcactgggaggacctcggatgcagtgctgggaagtttgacctttatcctccaggccccgaggctgaaagcttttcagcggagcagtggcagggttgggtggcttttcagtaagatgattctggaagcagcctggagcaatggaggaaccgagacaggaggcaggcagaaga

SEQ ID NO: 155395 - DNA, 412 bp, Homo sapiens
ctgtgcctggccacagtatttcttttatgcacatttgtatggagttaaaactatggttttagcaattgcatcctggctccttcacttaccataagcattttcttacattacccacacagttttcataaccattatgcttaacagatgtgcaatatttcattcaaccgattttactataatttactatttatttctgttagacaaggagattatttcttagacttggattttaatggatttttccattttaataaaaacatctgaaaacagaagtctgcagacaaggtctagtactagtactcttgtgaaaagacttcaggggatcccactaatgcatttctcaagtcatgctcatgttacagagttgcccagtgaaagcctatacctggtctgtaatttcctaagtgtgact

SEQ ID NO: 155396 - DNA, 316 bp, Homo sapiens
aggcaggagaatggcatgaacccgggaggcagagcttgcagtgagccgagatcgcgccactgcactccagcctgggcgacagagcgagactccgtctcaaaaaaagaaaaaagaaacaagaaaaaagaaaaagccgtttttacagtgagatacacgtcttgtcaaagagaaccttccagttctacaagaggctctccaaccccttttctcctcaaatctaaatgttttatttggctaaatgaagacaatcaaaaggctgaaagacgaaacaacatcttcttagtacagacctttttgttataagccatctgaacag

SEQ ID NO: 155397 - DNA, 611 bp, Homo sapiens
agaaccaggaatagaacccacctgctccactgcactctagggctggaaggagatcggggcaaaggaaaggatagagaaccctgatcccatgaaggaacctcctgggaagcccatggcagtggatgaagtgtgatttgcagggctcagatgaaaaaaagaccttcaacaagaccaaattctgagagcttctgacatgaagttcaaggttgtcacctacttatctagtaatcgatagaggccaaacagttcccacactgcacagaccccagctactaaaaggtctcattgtgttactctggaatcatcacctgtgttcagacatcttgtcctgttttctaactctcggtgtcttcttgcagtccagctgtccaagctgcagcaatgagcctcgccatcagctgcctgtctactattccatcacctctattcagaggtgggacttagtcatcaactgaaacagtgactaagcctctggattccccactttcagtgcagcaggaagttgattctaaatttcttgataaaaccccaagtggatgcttacccctggaaaagccaggctgtctactggggagtccccatgggttgacacaactgggtcattcccagag

SEQ ID NO: 155398 - DNA, 536 bp, Homo sapiens
aggacaagcctaattataagttgcacttaaagtgacattccgtagtaaacagaaacttcataaggaaataaacaaccatgttgctttagatatgagtgttcagtgtaaggtgggttagttgtaaggaggacctcactgtgaactaacacgctgtagtgccacaggctacccagtagtagaatataaaagctttgctcacacatctgtgacagacataaaaggcggccgggcacagtggctcatgcctgtaatcccagcactttggggggctgagacgggtggatcacctgaagttaggagttcgagaccagcctgaccaacatggcgaaaacctatctctattaaaaatacaaaattagctgggcatggtggcgcatgcctgtagtcctagctatgcgggaggctgaggcaggagaattgcttgaacccaggaggcagaggttgcggtgagctgagatcgtgccactgcactccagcctgagtgcctacaacaagagcgaaactccatctccaaaaaaaaaaaaaaaaaaaaaaaa

SEQ ID NO: 155399 - DNA, 233 bp, Homo sapiens
ataaataaatatcattggatgaatgaataaaacaccactactgcctatctgctttctaactaaatgaataagaagaaagctatagtcactaaaatgagattttactggtaaaatccttgaaatttccctacttcaacccctttcttttccaagttctttcttttaggaagaacttcctattattttgttttagggtttaagcttggacaaatgttcctgatatgcttgatggg

SEQ ID NO: 155400 - DNA, 338 bp, Homo sapiens
tttttacagactagaaatgcagataggcaagtactctggcaatcatcgtataagatgatgagtgctgcaacaaggaaaagcagaggcatacataacaatgagtgctgcaacaaggaaaagcagaggcatacatagtgatgtgtccgaaagcctgaaggtatgcaagagcagaaacccttcagcaaagataatgaatgtggaccagaaagttttactactaggagacagccagtgtggtaacggggcagggacctaggaacaatggaggtggctctctttcagttcttaattgattcttgagtatgcttaaattctgggtgggaaaataaatagacatg

SEQ ID NO: 155401 - DNA, 167 bp, Homo sapiens
ttagatagatgtatttgacagctgtgtggaggataggttgaggaggataaaaccatttacgaggctgttgaaagtacaaatgacagacagtgaggcaggaacagaggggatacatcagtaaatatttagaaggtaaaatcagcagaacttggtgactggctggatct

SEQ ID NO: 155402 - DNA, 431 bp, Homo sapiens
ctgaaggcatcccaactaatcagctgcacccattccctagtccctgcccgccaaactatccatgaaaactgctaacctctgagccttcaggtagactgacttgatttgatagataactgtcctgcatggcatgaccggactcatgtcagttaactctttctttactgtgacgccgtggtctcagtggattgagtttccctgtacaagaggcggaaggacccatcgggcaatgacattggtgctgccaactgcgtggagaatcacctgcccacctttccactcagccaccttgtgccttgacctttgtcctcatggccctagaaaccatgtccccagaccacagtcaaaggaagaaaaggaaatttatccccgtgtgtcttttttgttgttggtaggggacgcacgtttttcttaaatccctaagggttaag

SEQ ID NO: 155403 - DNA, 679 bp, Homo sapiens
tcaaccaagcccaaaccagctcaatccttgagggccttagttcttacctatctctgcctaacagagaaaaaaaataatattttctggtagatattatctggaccacttaaagatattaagtgaaagaaaaataaccagtttaaaaatcaagcattattgcatatacttgaacatattttattttaaaacatattctagtttaaatgttttaaacatattgaacatattttcaaacatattgaacatattctattttaaaaataaaatagaaaattaagaaaaaataagaaaattatttgacatatattttatatggctgacaaggatttaaaataactgttaatgcaataaaggaaataaaaccatcaacaaaataggtgaaataatggtaaatttcaacagaaattggaatctgtaagaaagaatgaaatgatcacttttgaacttaaaaaattggagagtaaaaatttactgaatgaatgtacaagttttgtcacagtagtacacaggactattgaactcaaaggccagtcaacagaatatattacaagtgaaacaaagagtagatcagaaaaacaaaggcataaatatcaagccccaattaagtccagtgtgtggaactggatcccaggaggacaagaaagagtatgggaaagatgagaggatattatgtgaaccc

SEQ ID NO: 155404 - DNA, 236 bp, Homo sapiens
tgagttcctgatatattttaggatttaagtgcaatgttctccgttaagtatatacagacaatgcagtctgagactgctcaatgatgtctcacacacttctgactctaaaatccagacagggatgccgagttcaaatggagtccaggaaagggatataagctaacagggacagagatgctgaaggattgggacttcctttgtacctgtcccttctctccaggcaaacctgccagaag

SEQ ID NO: 155405 - DNA, 561 bp, Homo sapiens
attttgttatgacaacccaagctgactaggacttataccatagtcaagagaacttgaacagtccacaattaagtggtgagactgtctctggtatgatgcacaatgtatttaactttacaaacagactcattaatctctcaaaagcttaacactgtcaccattttacagacagatccagctaatggttggaggccttccatgcgccatccaataatgcagggagaggcagtgaccatgcccagaacaggattctaaagtcctgcctttcaaatccctgacctagaaaaaaggactactccatttctcacaggaaaatgtgccagtcatggaggcctacatggcacgtctctgcactgctccaggtcaggagggccatctgacactgcacaggcaccactgcagggcaaaaggatgatcaagcatccaaaggccaccgccaccactgactagctgaaaaaccatgaaaaagttatataatttcactggatataaaattaaagcaagattttaatacttaccttgtagggtcactgtgaagatcagaaataaaatacagaagta

SEQ ID NO: 155406 - DNA, 299 bp, Homo sapiens
ctctagagtatccccgcacgctctctctgtggggacagatgtgggagagggtgtgcttggtctgaactggagtttgagggaagaatttctcgagcaagtgtgaatcctgaacatgacctgtttttcaggaaggaaagcagaccacatggaagcagatgaaggaaaaagcagaccacgtgggagccggatgaagggaaggtttctatgaaattgaaacagcctatctgccagtggagaaagttatttcatccttttttgcctgcagtgagaaagggggaaatcagagccacagagagaga

SEQ ID NO: 155407 - DNA, 854 bp, Homo sapiens
tgtgagacaatcagcaagttcaagaagtctttcctgcccctctctctaatgcaaaactgatttgcattcctatgtacctgtttgattcccttcctatgtgcctgtaaagcaactgagcaataatcacacatacaattgtttgtctactatgaaactctcacgtggctgagcagaggccctgtcttttcagtctttgtgccccaagcaccgaacccaacacctagcctatggcaggcattcgttaatgtgaataaatatcaagaaaggatgaagtaatgtctaaggctagttttgagcttgcccaaaaggtataaataaggtaaaaaagatataatgatggtgtaggaggtggtggtttactcacagggatgaaaaagtagaaaaattcagaaataaggtatattcaaatagagcattaactaggagaatgcccaaagtttaagtaaggaaatagcatcaccatgaaagactatttcaatgtgaataaaaatcaggtcataaatttctaagcaataaaaccaaatcagttaactgtgttcattcttaaagcagaggctcttaaccagggttcctttgtccctcagggggacatttggccagtgtctggagacatttctgattgttacagctggggaatactactggcatttagtggacagaggccagggatgctgctaaacagcttacaatgcacaggatagcccccaccaccaaaaattacttggtccaaaatgtcaaaagtgccaaggccgataagccatgtcttagaagaagctggacaaactgtgtgtttgaggaaagcaaagtagagacaggccctttctatgttgcccatgctggttgtgaactcctgg

SEQ ID NO: 155408 - DNA, 887 bp, Homo sapiens
ctgccctaactgtagtcccaatgtcagataggactcaggtctccactgcaaggaccaaaatgttaagttgaagactgaaaatgggaaaatttggaaatgtctttggaacctcaagtacataaaagcctgtaagtgcttcatactcattaacaacataggcatagaaaaaagatatccttattctcaagcatagccttttctaataagttcatgttagatgtcatgaagtttagtgaggagtgaaaatctatgaggaaaaacatgaaccattctactctggcaaaagttcaggacaaacaccataggcctgtataccaaattttaaaccatgttgaataatgtgaaaaaaagcatcacattgcttatgaaaggctttcctgtcgccccttaatacttctgtctcaggctaacatgtttgttaatgagttacagtggtgaagttaaggaaatctgcttcctgtcctagcatgcccattatcccagccatacagatttaataccaggagtcactttaactccatgaagtcattcaacaggtacttgagtatttactatgtgcgtttgtgctagagtagccatttcttaaactttgtggcctcagagaatcccttcacattcttaaagattgagggccccaaatcactttactagtatcttaccatattagaaagtaaaatatttaaatattatagcaacaaatgcatatttttaaaaaaataggtgcattgttttacattttggcaattgtttccctaaatgtctgacttaaatagaagacaactgaattgtttcttttgcattcaattggttacaatgttactagcagttttctataatctcacgtattagtcattaggaaaatatagcttcactgagttatgtcaatc

SEQ ID NO: 155409 - DNA, 317 bp, Homo sapiens
gactttctatcaagacttactgcaatctgttcaaatgttgttttatagttggtcattttgttcacattttagaaataatcatattcagtatgttaaaaatatgtaacttctgttagaactacactgctttgcaggaagctaacactatggttagaattgtttagcaacacatttctttcacttcagggcttgtgggaaagtaaccatatgtgtcatatgtcatgtaattctaagccagagctgagtgctgaaataaattttgagtagggatcattctcagcatttaaaagactgaacttccagataaccttgaattg

SEQ ID NO: 155410 - DNA, 360 bp, Homo sapiens
ctcccaggttcaagcgattctcctgcctcagcctcccgagtagctgggactagaggcacacaccaccatgcctggcttatttttgtatttttagtagagatggggtttcgccatgttggtcaggctggtctcaaactcctgacctcaagtgatccaccagcctcggcctcccaaagtgctagggttacaggcgtgagccaccgtgcccctcctaaagtttcttaaatacacttttaaaagtaaactttaaattttggagtagtttccaatttctggaaaagttgcaaagatagccaagagtgttccctggggccctcacaccatatccccattgttgatgttttatgttaccaaggtacg

SEQ ID NO: 155411 - DNA, 310 bp, Homo sapiens
gcccctccccccttatgggggacctgggcactgtggctggaatgtgggaagcccaactatctgatgcaggctcagaggagcagtcatggctggcgtggggaggtggggtcactgcagtgtctggaatgagggtccgtccccacactgccacatactggatatgtgactcaaggtcacgccacttccttttcccagacctcagtttcctcgttgaaatggggtcgatccttttgagaatcagcgagctggtgaagggagagcctgagatgcatgccagccaggagcctgctcagagccctggtatctcagt

SEQ ID NO: 155412 - DNA, 391 bp, Homo sapiens
attgtatctctatgtcactgtccgtctatgtccatatttatgtctatacgtaagtacactgtataccatgaagcaaatgaaaatataaagcagtcattgctatttttctaagcaatataaaagttaaaacccataaccttgtgtttaagagaaacagaaacttaatccaatatgctcaaagaaggtctggagcaatcagttttggatttctataaacatctcatgtgctgcatttgtctcaacttaagagccaaagttgtcttctgttcccattttcccattcttcttctctcaatttcttggcacttcaaagggactcttttacctttaaacaaattctagctagtttataacgtgatgtattaacctccagtcgaaagagctgctcttg

SEQ ID NO: 155413 - DNA, 194 bp, Homo sapiens
tctgagcacttggagcctcggtgctcaacaacacaggctttggggtagaccgacctgcttcaactccctctgccattgctgggggccttgggagagaaacttcatctccctgagcctcggttcctcatctgtacacagggctaacaacccctgcctagtgggttgatgacaaacatcattatgtaagtccctgg

SEQ ID NO: 155414 - DNA, 521 bp, Homo sapiens
ttttctctctgctcctcagacagggtaattgcaattgctttgtcttcaagtttacttattctttcttctgcctgttcaaatctgccattgaactctctactgaattatattttttataattttcatctctgtactatgtttcccattgatacattgttttcctgatttcctttagttctttgaccatgatttccttcacctctgtgggtatatttaagataaagttttttttaatgcagccaaaagacacatgaaaaaatgctcatcatcactggccatcagagaaatgcaaatcaaaaccacaatgagataccatctcacaccagttagaatggcgatcattaaaatgtcaggaaacaacaggtgctggagaggatgtggagaaataggaacacttttacactgttgctgggactgtaaactagttcaaccattgtggaagtcagtgtggcgattcctcagggatctagaactagaaataccacttgacccagccatcccattactgggtatatacccaa

SEQ ID NO: 155415 - DNA, 382 bp, Homo sapiens
cagggaggagctgatgttctagtttgagggccctacagctggagaactggagaggagctgatgttctagtttgagtgtcttgcagctgcagacccatagaaaagctaatgttcagtttgaaggtcttgcagctgcagacccggagaggagctgatgttctagattttgagggtcctgcagctgaagactcggggaggagctgatgttctagtttgagggtcatgcagctgaagagccagggaggagctgatgttctagcttgagggacctacagctgaagacttggagagaagctgatgttctagtttaagggtgttgcagctgaagactcggggtggagcttatgttgtttgcattgaaagtctttcagctggatgttcag

SEQ ID NO: 155416 - DNA, 288 bp, Homo sapiens
tttgtagaatccaaggtctggtcgggacctgtgagatggctgagaatgacgcctgcatctcacagataagggagctactttatttccttctacttctgttcagccaaaaacctcagtggcactttttggcacttctgggtgtggctgctcatcccctgatccccaaactgtgcctggaatgtgagtgggccgagaagttccttcactggagagcagagtggcagggagcgggcagtgtgcggatgggaatcaaaaggcccgattgtgctttctcaggaaaagcagccg

SEQ ID NO: 155417 - DNA, 391 bp, Homo sapiens
caagatggtcattccaggaggcatctgctacagacatgctttagttctcaccataggttctactgaataatcagaatgcatattcctcacttaaatattgttttcatctgaatgatccccaagatcctaagcacatcccccagtgctgagaggaggaggcgcgggcagaatttcagtatttgttctgagcaactctgatgagaaactcccctctcctgcggctaaggtgctttcctgactgggaagataagatgatgactatccatgaaagtctcctttcccttctctgaaaccccgtgcccctcagagcgggctaagcaagggactgccatacccaggctgccagagaatgtaggctgaaagaggaggctagcttgactcaagaccttgc

SEQ ID NO: 155418 - DNA, 351 bp, Homo sapiens
ctaaggcagagaccagctaaatctattttctgtggcttttcacagtaccaacttttcctatataattccaagtgatgatatggagagaaagtaggaaggtggttgccatctaatatcaagagagttgagaatgaccctcgggatgggagaaggtggtaagatacctaccttcacctaaacaggttgcttcccagagacttaaatgcttcttttatatggtactcatttaaccctcacagcaacacttttttttttgagacaaaatctcactttgtcgcccaggctggagtgcagtggcacaatctcggctcactgcaacccctgcctccagggttcaagcaattcttgtgc

SEQ ID NO: 155419 - DNA, 186 bp, Homo sapiens
atggtggtcgtctagaggatcccgggaatcgtgctggtgctagggaatcgtgcggtggtgggcctttccctaattttcttgaaattttgttttgttttattttggcctttctatcttttgttttattttgttttgctgattttcttttgagtacagagagagatttctatgccgtaagaaaactga

SEQ ID NO: 155420 - DNA, 1268 bp, Homo sapiens
agtttataagaaaaaacatcattcgagggaattgactgtgactttggatctgaacatgaacatagagtgttcttgttcttggactttgggctgaaagacatgagtataaccttccgacctccacttggaaacttagtgctgagatacaggctaaccttgaggacagaaataggaaatgttttggaacttccaattccctagtgacaggatttgtttgcagaaagcagctttggtcagatagcacattcaagattacaggcagacccagaggagtgagatgtggagcttgtcagaatgcatccaaggctggcctgggggttttgagcagatttgcagagagcaggccggtggggaagggaacaggaggcagaaaagtctccggaaaagtgcctctgggaagcagcttgaagggctctgaggacacttggttttcttttgaagggcagagtacacagggaagaactctaagtaaaccctgccctcggcaagcagaggtcagaaggtgctctgtgggcaccgagcagtattcgggatctgcagctagaccaggcctgccatgagaagttgagtttatggtttattattcctcattcccttaacatttttacagtgcattttagagtgcaaggggcttttacatccattatttcctttaacccaggggaagttcactgggtaatacagaaagcctggagctggagttttggtcttaggttcattgtgaccttgggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagac

SEQ ID NO: 155421 - DNA, 396 bp, Homo sapiens
atgtaccagaggccccccagtaaccactgtgcagagctgagtacaattgagggttaattctgtccttggaaaagtagttcagtttgtttcagccagtccagtcaatttgagaccctttctagggcttatattctctgatttttttgtgtgtggatgtcagactggggtttggatttctgtctgtcagcagttccatatctcagcaaacaatcccactgaaagaagtttatctgtgtggaaaatgtccctttcatttaggcatttatcagacaggggtttgtttttgctttccccaatgcagttctgtgactcgggtagatggtgggagggcccaggcaggtgaagaaccagctcatggtcgttgtcgttgtgttgcattggtgacatgacgggtgg

SEQ ID NO: 155422 - DNA, 793 bp, Homo sapiens
cccctctggactcttgaggcctgggagctgatggatctcactgcctaatggtatcaggctgtggtgctgcagacagatgcagggaggccaggcaggccaggtgccaacagctccccatgaagggctggtttctccggatgaagtcagtaccagagccactggcactgtgctggtggccctgcagcagggcctgaggcctgggcatgcggaagattctggagtcccgcgcttagcactctttgatgtcagggagccccagcattggcaagtgcctcttcctttcccgcgtgccaggaaccagtctaaggccgactccagtttccaccggtggcacccctgccttgtctcctgtgccggctgtcatctgaccagcgtccgtttcagacctgcctgccacctcctgcagaggccaggagcccctctacgctgctggtgcttcacatttggccagttctaagtggacattcttttttcttgagacagtctcactctgtcgcccaggctgaagtgcagtggtgtgatcttggctcactgcaaccgacacctcccgggttcaagcaattctcatgcctcaccctcccaagtagctgggattacgggtgcatgccaccacacccagctatttttgtatttttaatagagacagggtttctttcttttcttttctttctttttttttttttgagacagagttttgctcttgttgcgcaggctggagcgcaatggtgcaatcttagctcactgcagcctccacctcctgggttcaagcgattcaacctcccgagtagctggg

SEQ ID NO: 155423 - DNA, 288 bp, Homo sapiens
ggatggctgggtcaaatggtatttctagttctagatccctgaggaatcgccacactgacttccacaatggttgaactagtttacagtcccaccaacagtgtaaaagtgttcctatttctctgcatcctctccagcacctgttgtttccagactttttaatgattgccattctaaaagaacctagactcttaatgttaacttttaacacaccttcagatgatctcctgggtgcctggtaactttctaagccatttctgtccttgcaagagccctgtctatctgattttg

SEQ ID NO: 155424 - DNA, 366 bp, Homo sapiens
cgtggcctcagctactcgggcggctgaggaaggaggattgcttgagcctaggaggtcaaggctgcaatgagccgtgattgcaccactgcactccagcctaggcaaccaagtgagaccctgtttcaaaacaaaatttttttaaaaaaagaaaagcaaagaaaaaaactgtagccaatacttatgaagcactactatgtgccgggcccagttctaggcacttatctgtactgatccacttagttctcatgacaccttcagggaggtggccactgctcctgcccacattttgcagaagagcaaatttggaagtaaaatttggagctggcattctggcccagacaggctagatccagcgcgcactctcat

SEQ ID NO: 155425 - DNA, 459 bp, Homo sapiens
gcaggcgtcttggagcccacaggtcttaggctcttgggctagagcagaggctctgagtgaaggtgatgtccccgagctgaggcccagggtctctgactcaccactgggtgggttttcagggcagatgaactccccatctcaacccacattccccaccttacagctcagccaccaggactctgtgaacatgactggccatctccttccactgttcctacttaaggtcctggtgcttacacaagaaagtggtaccacaaccagctctttctagtggcagctggacttgtgggggcggggagggcacagcttctctaactgtcctcagggctctgtccagaggtatggattctggtaaactggctagctggaaagaataaccaaaagccctccaccatggtcaatttcaggctacccacatgacgccactacacgtgaagttgtgaagagatgtgcagaatt

SEQ ID NO: 155426 - DNA, 774 bp, Homo sapiens
tttgttgtttaggattttcatcgagaggaaacatcttcaagttagccacttgaaggaactgggtgatggtggtatgaacagtgggtgccaggtgctttctgcccttcttgttccactgggtccagatggcattcctagggcaccaccttcttgaacaactcttggggagaaggagtgtcacatggacacagcacatccctgctcagagtccacaatcacccacagtctcaagcaggtgccagtgatgtccacagtcacccacagtccctagcatgtgacagtggtctgagctgagctggagtccaaaaaactttagaattggctccagatttgtgagagcacctgggtatggttctctgcccactgaggcactgaatgcatgatggcccaggccccgaacaatggtgggaagagagagtggcatcggggcaaggctgtcattactccaagcaccagggtggcccaggcctgctcatctactctttggagggaatctgtgcatgtgaaatgaggcccctacgtcatgattataaaggaagagatgaaatcagttcatcttaccccaggccgataatggtcatgccacctagggaagcagtaaaagacctggtcttgggattgttcggggcctgcaggccccgaacaatactcatctgaatcggattcgaaataaaccgattagcaataatcccagtattaataaaaaattttaacccacgagccacagaagcagccacaaaatatttcctaacacaagccacagcctccataata

SEQ ID NO: 155427 - DNA, 1047 bp, Homo sapiens
tttgttgtttaggattttcatcgagaggaaacatcttcaagttagccacttgaaggaactgggtgatggtggtatgaacagtgggtgccaggtgctttctgcccttcttgttccactgggtccagatggcattcctagggcaccaccttcttgaacaactcttggggagaaggagtgtcacatggacacagcacatccctgctcagagtccacaatcacccacagtctcaagcaggtgccagtgatgtccacagtcacccacagtccctagcatgtgacagtggtctgagctgagctggagtccaaaaaactttagaattggctccagatttgtgagagcacctgggtatggttctctgcccactgaggcactgaatgcatgatggcccaggccccgaacaatggtgggaagagagagtggcatcggggcaaggctgtcattactccaagcaccagggtggcccaggcctgctcatctactctttggagggaatctgtgcatgtgaaatgaggcccctacgtcatgattataaaggaagagatgaaatcagttcatcttaccccaggccgataatggtcatgccacctagggaagcagtaaaagacctggtcttgggattgttcggggagctaccgaagtgaaaactgaatttacccacttccaggaaaacaacaaaagaggaacatctgggttcaaacctttatcagaagatcatttacccagctaatcttgctgtggtgcattgtatggtctcagcaattgtcaacaaaagcctcttaataattctaacacagggacacactgcaactcacattttccagtgcacctcagtggttaaagagattgctggtgctgcctgcatctgtcagtctgttcacatatggagaggagcagcggttctcacgggagcagcttctgcatcctgaggaagtttgcccagacatttctggttgtaatagctggtggctcccactgacatgcagtcaacaatgggaatcctatggtgcacaggactgcacccgggaggatcctctagatcaccagcc

SEQ ID NO: 155428 - DNA, 681 bp, Homo sapiens
taggcaccaagaatcccctcccttgctagcctggcatattcagataattttcttttgatacctctgacctgtaataaattttaagctccatatggtcatctttactgtgtatggcattcttagcatttatgtatattcatgtcaataaatagttattgcactgtgtgccagaggggtatgttttagtagatggtgataacaaaatgcaaatggcacttccttaggaagttccatgtcatgtgctgctggaaacagcccctgcttctagtgctgtagtacctgtgtgaccttggccaaattacttcacttctctgtgctgtttccttttctgtataatggagattcttaaccctgctgggaggattagttaaatgagatactgtaagtgaagcatgtagcacaaagcttggcgaaccaatggtgcagagattccagttccctccccttcctttctctgcaagttttctttagtgcttgcactcctgccaaatggttagtaatctgttaacaaacacttaagtctttaggggtgctcagacgacaaagggttgcttttggagagtgaagaatcttcttgtaatataaatagtcaactccaattccagttttaaagtttggtacgccttgaattcaacctgttaagttagcccagctctatctggggttctggaaaaatctatc

SEQ ID NO: 155429 - DNA, 356 bp, Homo sapiens
gagcctctacctctgctctcccaatcttctacattttccattccatctctccaggattccttccagtctttcctgctttcctaacggtggctttgcagatgctcatcttttttgtctgctttaacactccagtttgtccctggctaaatactattcatctttaggccgaacattaaatgtcacctcctccaagaagtttttctcgactactcctccttaagtttaaattaggagctcccactctgtgatactgtaacaatgcactcaccttattgtaacagtgtcctcactatatataactgctggtttaattgttcatagtccacctgttactggcggagggtcctgactacaag

SEQ ID NO: 155430 - DNA, 225 bp, Homo sapiens
tccccgtggccaccctctgtgtcctggagccacgccctccggctctgattctgtgcagctgactctcccctccctgagagtcctcctgccctccagctgcccgggctcctgctgccatcggtgcccacgaacgggccgaccaagcccaggtggcagcatctccccatcccctgttccctggcccgaccccactaccaggagatgaccgggaagcccagcgcccac

SEQ ID NO: 155431 - DNA, 129 bp, Homo sapiens
ccgaagaacagttcaggtcagtccttgaaggtccctccatctgtgtttgtctgatgtttcctccagggaccggaatgctacagaagcaatgctgtgttctcagtgtatcacatcaagaaacacttggca

SEQ ID NO: 155432 - DNA, 565 bp, Homo sapiens
acttgacttgcactttatgtctcggaactacttaatctccgcttctgaaaggcatctgagcttccacaggatccaggaccccaagaatatcaagacacaggaaagggtaatgcatgcctgtaatcccagctacatgggaggctgggacaagagaatcgcctgaacctgggaggcagaggttgcagtgagccgagatcatgccactgcactccagcctgggcaacagagcaggactctgtctcaaaaaaaaaaaagaaaaaaaaaaaaatcacctcttctaaccctgggggttgataaaatgcagaatatttattcaccagaagcagtcttttatatggcacccacttgaccaaaatattagcaaagtttgctttttaaatctacaaaagatcataagctaccaagtgtctgaggctcaagatatttttgtgattatgcttagagaattcacagggacaataaagttgttaaaagttaggagatgtgatccagtaataagacaacactggcactcagtactcaggcctgtgtggccaaacctccctctccccaagtcccaaagcag

SEQ ID NO: 155433 - DNA, 537 bp, Homo sapiens
gaatcatcaacatggttctggagcttccaattcagaatgaaccaccagggcaggctgcagctgaagagaagcacacctgtgttgtccagtacatcctcttccccccacactctacctccaccaaagacagcttctcgacagatgatgacaatgatgtggaagtggaggccctggagggagactcagagctcaatctggtcactgaggtgtgggtggagccacagtatgggcgagtgggacctggccctggaatctggaagcacctccaggacctgacgtattctgagatcccgcaagctctccacccacgggatgctgcctgcataggctccatgctgagctttgaatacctgatacagctgtgtcagagcaaggaatggggtcctctgcccccagagccgaggtctctgatggattggatcagggaggagacacctgcgtccatgagatccctttccattttgacctaatgggattgctgccacagtgccagcagctccagatgttcttcctcttgcttgccagaggtaggtgaac

SEQ ID NO: 155434 - DNA, 537 bp, Homo sapiens
tatgttctcgactctgttacaatcggcatggtggtatgtgcctgtagttccagctcaagaggctacggcaggagaatctgcttgtacccaggatgtgaaggctgcagtgagctgagatcatgccactgcactccaggctggctgacagagcgagactctgcctctgggcatggtggtgcacatgcctgtaatcccagctactcgggaggctgaggcaggagaatcgcttaaaccccggtggtggaggttgtggtgagccaagatcgtgccattgctctccagcctgggcagcaagagtgaaactccatctcagaaaatggagatggagtagagcattccagataaaaagaaaggcatgtgcaaaggctccatgtgggatgaagcatgacatatacgaagaagttgctggagaagagtaaggaacgggcgagatgtgagatacggccagaatgatacatagggaaccagactctgtaaaaccttaataggccatgttaacgatcgagaagatagcttatgttctcgatcgagaaaata

SEQ ID NO: 155435 - DNA, 742 bp, Homo sapiens
gggaaaagggtggaggtggggtacattataaagaaaaatgaacactgtactggcacttaatggagtttatcatctagtaggggaaacatactacaaataatttttttagtggtatatatatataataaaggaataaaggtatagtgctttgagaaataggaattttcccttaggaaatgatgtttgacctgaaaccttaagattcagaacaacttaagtgtgctaagaaagagatgtggccgggcgcagtggctcacacgtgtaatctcagtacttcgggaggccgaggggggcggatcacctgaggtcgggaggtggagaccagcctgaccaacatggagaaaccctgtctctactacaaatacaaaattaatggtgtggtgcacatgcctgtaatcccagctactcgggaggctgaggcaggagaatcgcttaaaccccggtggtggaggttgtggtgagccaagatcgtgccattgctctccagcctgggcagcaagagtgaaactccatctcagaaaatggagatggagtagagcattccagataaaaagaaaggcatgtgcaaaggctccatgtgggatgaagcatgacatatacgaagaagttgctggagaagagtaaggaacgggcgagatgtgagatacggccagaatgatacatagggaaccagactctgtaaaaccttaataggccatgttaacgatcgagaagatagcttatgttctcgatcgagaaaata

SEQ ID NO: 155436 - DNA, 317 bp, Homo sapiens
gggaggccaacttacgttttactgtatactcctttgtaccatgtgaatgtattaacctattcgacaattagtttaaaaatttttttttaactattaaaaaggtatacattgtccttaggggaaaggtgtggtagaatttatagaagaaacaataaattttgtcccaaacccattatccttcccatacccactctgtaaggccactgctaacacagtctctgagcctgacctgacccaggcagggccccaaaagttctgcagtactggtcttgcttcctcaagaaaaacaaatcctctttctgcatttctttggaaat

SEQ ID NO: 155437 - DNA, 290 bp, Homo sapiens
acttcgacggacgcattcagtactgggtaaaaatttcagacctatctcaggaacacagaaatattgggtgccctgataagcactttctagactatggatgtggccaggaattgggaaagacgacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacag

SEQ ID NO: 155438 - DNA, 104 bp, Homo sapiens
cgtccagggatgtggttattattcttgttccctctggaaattctattgctattaaatcagggtttctcaacctcagtaccattgctattttaagctagataatt

SEQ ID NO: 155439 - DNA, 434 bp, Homo sapiens
aaataaataaattagtgataataaccaatatggtctattactctgttttgctttaacacatgatatcacatcagaatccttcagctgactgatgactaccccatgtacaatgcaaaatggtcaaactttaatgacttttagaataaagatgcataggaatgcctagttcttgtttttaattcaggttttagtttagttcttttgttgttaatttctctcacttaagaacctgctgagcagattcgttgagtaagaagtagaataaaatcatacttaacttgcctcaaaattaaatgaagcttactctagttagttgaagcccactccagcttaaaacttcaataatatttaaattatataaaggtgaaagaaaatactctgagtcagtaaagttcacggcacatgcaagggtgtgtttgcagtgagaactttga

SEQ ID NO: 155440 - DNA, 194 bp, Homo sapiens
gtgtggacttcactcccatcctgtgtgtataaactacccaatccatacctcagctgtttatgaaacaactgtcatggaagttgcccagcatgttcccctgggcctgtcttcctcttacatatccacagtcatatattttagcttttaagtaagcaaaacttagggtgtttcctgagtagaccccttggtgagga

SEQ ID NO: 155441 - DNA, 183 bp, Homo sapiens
ggagagggtcagctgaccctgaatgctgtcttttcccaatattgttgttttgggctcttttagcccataaagtccatatctttcagagatgtccaccctgatgtcacagagcttccagcaggcagtgagttgggcatatcccctgtgtgctgcatgaccccttcccccagctcagggcttctt

SEQ ID NO: 155442 - DNA, 624 bp, Homo sapiens
ctgtctccctgttgtttgtgttgctgctcatggttactgcatgaaacttctacttgaattcaacttgtttttattttatgttctacttgtctgaagcaagcattcaacctttccggttaatatgccattacacatctttttggatctactacacccacttctacccaaatgataagggaagcaaaagccctgtcaccaacctttgagagctctgaggtgcaagtcaaggtatgtagctttactgacccacaagaggcacaggtccatctaactgagcccattacagagcacacagcactgctcatactgtaccaggaatgagacagcagagggagaaggaaggaggtgaaacaccttctgcataacatgttgtcagtggcaaaacattaactgggacccaagcctctgacttccaaactctgagcattttctagatgacatacactttaaacaaaacacagtactcattaaagtaagcatattcttcatgacctcactggcatgggtaatggaaaaccaagaagttatctctaattgaattggaatgtttacactggctgcatagctgctcccctaaaggaatctgtggggaaaccaggctctggtttcctcatttcctagtgt

SEQ ID NO: 155443 - DNA, 349 bp, Homo sapiens
gccccaagtagaaataacctaaatgtctatcctctgatgaaaggataaataaaatgtgtctgcctatgcaatggaatattatttagtaagaaaaggagtgaactcctgataagtgctataacatgggtgatgggtgatccttgaaaacattttgatgagtgaaagaagacagtcacaaaagatcacatactcaatgaatgaatttatttatttatttttgagataaggtcttgccgtgttgcccaggctggtctgtaactcctgactcacaggattttcccctgtcaccctccacagagtagctgggtttacaggcatatgctgtcacattcagctgctgaatgaattc

SEQ ID NO: 155444 - DNA, 144 bp, Homo sapiens
cccgcttggcccttctaagtgtactgcttcctttcactcctgctctaaaactttcaaacaaattctcactcctgttcttaaaacttgcctcagtctctccctctgcctgaaaccaactactgcctctcagcaaaattctttcct

SEQ ID NO: 155445 - DNA, 112 bp, Homo sapiens
tttcattaaaaaatatcttaaatttgtagctgaagagctttctaattctgactacaaaagatagaaagttaaaaccgtacagtcctgtcttggtgttaaacttagtctcttt

SEQ ID NO: 155446 - DNA, 525 bp, Homo sapiens
aattggaaggaatgatatagtaattctgcatatttattataaagaacacattcccaaataatagaataaaaacatacattttaatagaaaaattaagtgcttttacataaacatcctattttttttagaattatatgcgcttattcactcatttactcatttattcatttactcaaagatagtagatgccataattttacaaagataatgtccaggagtccaggcctgccacttaaaactaaccttaaagaagtcccctctgagtcctagattctcttggggttgatgtgagaatttggtaaaactgttagggaaaatgctttctaaacagaaagagatatataaatggaggatgatattaacacattattaggcttttaaatactgaacctctgacttgtaatgaaaaatattaatgttaaagtatgaaaatgtcttataatatgtataagttttcctaaatatttgaaattagagtttccatataaaataaaccataagaaagtggagctcaaatgttcaaat

SEQ ID NO: 155447 - DNA, 334 bp, Homo sapiens
ttaggaattgcatggcaaagtactgagttagtgtgatgtttatccacaggtgggaggagagggtgtctgagggtttgcctggaggtgagccatgagaggcaggcaggagctgggccttaagggctgtgggccaagtaggagtttaaattttatcctgaaggcagtagggactatttatggtctgatacctcctttgccctcgcatctaaggtgtattggtaggcagccctcttaggaccaggtttcactcccaacttcaagccggggggagcctttctttaatcttgggatgagcctggccagggtgggttggccctgcttgccgagtgagggg

SEQ ID NO: 155448 - DNA, 747 bp, Homo sapiens
agctgtcactcccccctcccatctactcccattctcccagccctaggcaaccaccaatgtacttctgtctctgtacttttgcctattctggatgtttcgtataaatggaatcatacattaagtagccccttgtgactgggtttgttcacttagcgtaatgttttctgggttcacctgccataggttcttgacttcaggacagtttcctgctggctttagtttcctctggtaacttgggaatcaattgacatctatggaacttctgttatggttcaggtactataaactgtggaggagtgactaataaccgtatatatatttttcttactaatttcccttcatttcacaggtgttgaactaatacagtatagtttcttgttcttcagaagcttacagtcagcaaggaacagaaagccaaataaagtaggaaagggtaagatgttcaacgctgggcgcagtggctcatgcccataatctcagcaccgtaggaggctgaggaaagaggatcacttgagcctagaattttgagaccagcctgggcaacatagtaagacttcgtttctataaataattaaaaaaattagccagacgtggtggcgtgtgcctgtgatcccggccacttgagaggctgaggtagaatcgtttgagcccgggcagttgtgactgcagtgatccctgatcatgctactgtactccagcctgggtgacagagtgagaccctgtctcaggacaaaaaaaaaaaaaaaa

SEQ ID NO: 155449 - DNA, 318 bp, Homo sapiens
cccctggaggctcttcctccttgataattaaaattggtggattttcctctcgagagctacctgaggtaaggatccgagtctctttgtcatgccattaatagtccggaactctgcagaaaggcatctggctgccttctccgttccccacttgggcctggcgggccgcctgtacatgttggggaacaacacaacctaaatctggacaatttgtattttagtagtaacggggatattctctgtctccctctgtcattttgcattaaggacctgccactaataaaactaattaataactgctggctcgatgtggaatagttg

SEQ ID NO: 155450 - DNA, 543 bp, Homo sapiens
cagggagcaaagcatttttctgtcaggctgtaggacttgacctaggaggtgacccagaagcagggctcagaggccaggcctagaggagggagagacaaggagcctcctggtgaaaggcagcagggctggaccgtagggcagatggggccaccacatccccaaatgtaaggcctcttattggaccaggcccaaatggggattgaatgatgtccacctgcaccttcacctgttccctgttcaagcctgagagggatgcagagccttagcgtggactctgtcctgggagactcagtgcaggcctcctgctcccgagccagcattcaccacccagcccaggcttctcaccaagcctctgagaccagctcttcgaggattctccaccatttcctttgcggccatcaccagtggccgcagctctttctcccatgcctcttatccctgggagggccaggagatttcacgtcactgcctgttgccatatcttaaccattgctcctctacccccagataaaaatgctcaagaatggggactccctcagctcc

SEQ ID NO: 155451 - DNA, 491 bp, Homo sapiens
gcgatggccgtagctgtgccctcagccttgcttcacgatgaggaatgatggtgactacctggcactgctattatgtcgtgccactggacagggaggcctgtgttgggagctgccaggagccattgtgagcaggcaagtttgagatatctgaccacagtgagggccctaagttctccaagagggtggctgagactcctagtcctggatgatctgcttcttgtctcttactgggcatgagaaccctgaaccagaacagagaattctagggacacgtgtttcctttggcctgaaccctctgatagccaacacccacctggcacctcactcctggggcctctgccgtacacttctgagtacggggtctctgacaacttcacattacctaccatcatttcctctgtgacctttacagttgtcaaatgagcttatggtctttttttttttccctctagtcctttgcctctggagtgaaataaagctgcacattaatc

SEQ ID NO: 155452 - DNA, 261 bp, Homo sapiens
ttttatgtaattctgacaacaactttacacagtagtagtattctctccatttaactgctgacggaactaaaggacagacaggcaacttgtccagggtcacagctagtaaagaggcagtatggggatctgatccctctgtgcctgacccataagtccagattattttccaccatgccatgaaatagcacagaacttgacaaagaagcagaattgttcaactactagggatgggaaagtcttaagttagcatggagctgtgtg

SEQ ID NO: 155453 - DNA, 445 bp, Homo sapiens
gcccttataggaataggggcatttgaatacagacacgcaggggagaaggccgggtaaagacagagggagaggttggcgtgaggagtctgtaggccaagcaatgccagtgaacaccagcagggcaccaaaggctggatgtgcaaggcgcattcgtccttccaaccttcggggggagcaaagccctgccaacaccgtgacttgctcttctggtctccagaactgtgagaacatcaacgtctgttgctttaagccaccaaacgtgtggttctttgttatggcagccctcgccctcctcagcctgaaccatcaccactctgccttacctctcaatatcccaagtaaaagccacctgaagcaaccatgtcttaacagagcatgtcttggaaatgttgaaaaaagactttccccattttatgaatttgctgcataatagaaatttaaatta

SEQ ID NO: 155454 - DNA, 442 bp, Homo sapiens
gtacttatgtagaagaatgtccttaccattggaaacatacacacactagggtaattccagagtgatggagcatcaggcggacaactccaacggttctggagaagaaaacaagttttctctactgtacttgtaactattctgttttgggctgtttcaaaagttttcaaaaacattttaaatgattagtatctctccaaaatgaaagtaatggatacaatcttaatacatacacacacattctttccaacaagaatgttctctttgtaaaagtactaaataagtcttccatttggtcactagggaagtagtataaaatagtgttgcataacaaaaaagaaaaaccaggctttccatgtagtaacactgacttcaagctccagttcatcacatacaaatttcatgaccctaggtagacttttttttttttttttgagatagagtc

SEQ ID NO: 155455 - DNA, 381 bp, Homo sapiens
tatctctctcttggcaagtcaagctgactgatttggaggctacagactctaccttggctggcctggccacctcacaacctcctctccaaaggtgacatgtactacagcttaagacattacacggcacctgaagcaaaaactaaaagtagatatggtatatgaagggacaggaatttagggaatagacccaatttttcttttacttaatcagcgttgagtttttgggtttctaggagggcatagaaaacttgaactggagaagcaaggttcattggcatgtgccagttgatacttcactaagtctttactagtaaaaatgatgacatttatcttctttcttaagccatgtctattctgttccaactttaccaagaatgacag

SEQ ID NO: 155456 - DNA, 433 bp, Homo sapiens
cttctcttgcatcttagttgtagccacatctaggttgcagactatatcagtatagtatttttctttagtggctgccatatttcattatttttggtttctaaagtatgatggtagaagtactcaagttacttcaggagagtttggggataaaaaatttgtagtgtctgttaccagatctttattggctatttttgattggagcataaaatctagatggttatcattcactttaataaaacatataaataaatatattgagactctgtaatacaaagaaaagtggttgtaaatccgagtccttcttactgaactatagttgggtgattttcttttattttcatttttactgtatatctttgagaatataaagaagaaggcatatatttatattcattactgtttaaatgtccaagtgaacgccgagaggttataa

SEQ ID NO: 155457 - DNA, 340 bp, Homo sapiens
agttcgacggagactctcctgaagtactcaagttacttcaggagagtttggggataaaaaatttgtagtgtctgttaccagatctttattggctatttttgattggagcataaaatctagatggttatcattcactttaataaaacatataaataaatatattgagactctgtaatacaaagaaaagtggttgtaaatccgagtccttcttactgaactatagttgggtgattttcttttattttcatttttactgtatatctttgagaatataaagaagaaggcatatatttatattcattactgtttaaatgtccaagtgaacgccgagaggttataa

SEQ ID NO: 155458 - DNA, 210 bp, Homo sapiens
ttagatggctgtgtcatcaattagagtataaactctagaagcactactgggtcttcatttctgcactacccttaggccatagtttttctttgcatatttctgttcccaaattgggaaatggttacagaagaagaaaaaagaatatgggacaaataatctgaagaatctacaaactggcttttacacaatttgggaccctcctcatctctg

SEQ ID NO: 155459 - DNA, 761 bp, Homo sapiens
taggaaatttggtgattttacacttatattcaattaatactaattttaaggacttaatctctattcctttttcagagaataaactaattggtagcctgtaaaaatgtgtctctgggaggtagaatgtgaagcgggatgaggtcatttgttcttaatagaaatctgaacatcttaacattaagataccttctcaaaatagcaatagaagaaaatccctaaaatttgacagataacattttctaagctttttaaaaggacatttttaataaatacagctaaatttcattcttcttatattatgaaatttaatgagaaacaaagtctttttgtaggctggatttcatgttttttcctaattagtccagtacctagactagtttatcactccatatgccccattcttttcatccgatactgttctttctgcttggaatatgtccctccatgtggccactccgttctcttttgggaatcttccacgagtccctgatactgaaaccttctttggccccttggtgtttgataccacatttaaggcctttcacatattattctgtgattatttttactgattttatttccctcaaagatttaggtctcttaatgtcagcacccatttcatctgctcttgtgtatcttgtgcctttttggtgctcaataaaaatttgatgtaagcatggaattttctagaggctttgaagtggtaggcatgcctgaaatacggactggacccactctattatgtttcttctagggactga

SEQ ID NO: 155460 - DNA, 748 bp, Homo sapiens
ggaagccacaccaaccagagctcacctaggacctactatatggattccacctgcccatcatggggcaagatgctggccttcctttagaaaggggccaaatttcaattcccaccagaaaatcaagaatacataatcagatagttctgaatgacgtgaatggttctctttcaacctcacaagattttgagagtctaatattaggatttgtgatcaaaaagttgcaaacgtgcactatgtcataattccttagatccgacaataaaggattctgttgtaattctccatcttaagatgatttttttttctcttggaggaaataacgacctaaataaatgtcatgtgcttgaatttctgaaaggaaaatgttaccccatacccatttattttagaaaggtcggatttgttcccctgtcaacaaaagctttgagctgtacattggtctagacacccccaagtactccagaaagttgagggttaaaaatccaagacagattttataaatgtaggactgacgaaattttcaacaaaaaattcactgttatgtcatatcctataggaaaggctttatccacacatgccttcttgatattctatgctatggtttcatccagtagtacattggttcttatagatacatggaaacaatgaggttctttttcctatataatttttatttctgtaggttacatatcccacctgttatctagaaaacattgttcagttatatgtacatgtggtgttacttgaa

SEQ ID NO: 155461 - DNA, 357 bp, Homo sapiens
ggttcgaatgtcctagttacagagggaagtgggcctgcaaaccctcaggcttcagaccacccctttccactgcagggaaacaccacttttgctcatctctttggcccttttggtagcttattccttgaggaccatgctcctctctgctggggatgaggctgcctgctggtggctccgtttgtgttttctgggccttccagaggggctgcctttattctgcagccagccctgacccttcccacctctccatgcttgggtgaagagtgaggcccagggcagctgactgacagcacagctgtcctctgcgttttcctggacagaaaccatcgcaggcccacccacctcctgactgcacag

SEQ ID NO: 155462 - DNA, 585 bp, Homo sapiens
agtgtgcctcatgcttctagtaccctacgtgttacccagaattctccaatgaaagagatcttcacattggcatctcaactcactagaaagtgggcattctcaggtcatgataactagcgtggtgagcgttttcacatgtcttcagggactccactgaagttgcacaatggctttcctcttctttggagaagtaacccaatgaccagcacaactcttgagcatcagtcaccgcttctgtggcatcaactgactagcagtttggcaattagggtgcaaatgtgctcttggctttgctttaagtatctgcatcaggaattttccaacatgagaggaaaagaatgcaacccttttttttttggtaagctcttgtcactacctactaatgcaaaactctaggcctctgcaaattctcccccttccctgaagtttctcagaatccttaagtagtacattcgatgaatacagaaacaagtcaggttagttactatgcatcattttggctttggtgcttcggattcagctccctctgccctgtgcttggtgtgtggaaccacagctgatgtctatttctaactcccactagat

SEQ ID NO: 155463 - DNA, 283 bp, Homo sapiens
cttgcctggagctcaccacactgcagtgcgtgttctcctgggaagggagctgtgacactggcctgctggtcatgacttagagctacatgtcagtgggagagtgtggcttgagcctgaactgagccctggccccacagacggagtcccagccccagccccagatggagcctcaaacctaggcagccctggttcacaatggagccccgaccctgggccagtctgaccccagtcacagactgaatcccagtcccacattgagccctgatcccatccaagtccatag

SEQ ID NO: 155464 - DNA, 337 bp, Homo sapiens
aacaggctttgtaggaggacactcaagacggtgtgatttacaaaccgaggccacaaagctactgtgctcccatgtttgagcttccatgtgtggcctggaatttaatgggtcccactccagtaggatgcattctacagtttggggacatctgggataaatgatttcctgggattctccagcagatagcccaggggtctaggccttcctgttgtgggacggggaggggtcctgtgctggcagcaacaccccctggccccccgcccttcccgctctctcctgtcttccacattggctcaactgctcaaattcaaagaccaggagacctgcttgatttcac

SEQ ID NO: 155465 - DNA, 519 bp, Homo sapiens
tacttttccacagggtacacaaaaaaatgtgccgggcatggaggtgcacatttgtaatcccagctactcggaaagtgaggcacaagaatgtcttgaacatgggaggcagaggttgcagtgagttgagattgtgccactgcactccagcctgggtggcaaagtgagactctgtctccaaaataaataaataaataaataacaggaaaacagaaaaataatgagtgaatgaattctctgacctctctcttaccttcctgaatcattgcttttctgtttctgtcttctctagtttaaccttgttcatctacttcctgaggacactcttgtggttttaaaacttcacagttacatttagtaactctttatataaggaaacagattgccacataatccatgataactgggtggaaaatttttaatctctcttgtacttaaaaaaaaaatcacctgttcctcttacctgagattgcatatgtttacattttggccttggagataaccctttccctgtggctgagt

SEQ ID NO: 155466 - DNA, 156 bp, Homo sapiens
cttgtaaaaactcatagaatgtacaacacaaagtatgaaccctgatgtaaacttcggactataaaataatgtatcaacattatcttatcaattgtatcaaaaggaccacactaattaaaataataatgaggaaattgtgtgtgtgtgtgtgtgtgt

SEQ ID NO: 155467 - DNA, 826 bp, Homo sapiens
ctgaccaggtgagagatggctcggaagtgagggagaggggagagggatgcaggttgtgggcctgtaatccttattgatatcagccaccctcaacctgagatgtaaattggaatcacctgtggctctcaagctggcattcagacgggcagcttttcctgagccctcaaggagattctgtcttgcagcacgtgggtaacaagtggattgggtaaataggctcttccctggagggatggtgttaacgcagagacccgagactgagcttaggaaacaaaagtggaacagaacaacctcctgatttcaaaagcaaaggcttaaaatttatttcagaatgagttacagtgatattagtatgtttttttgggtggggaggacagaatctaattttagttgttttagattatggtactttttcctgcttgatttacatgttaaatgtttctgatgaactgttaaaatcttcgaggtttttgcttcatttaaacaaatgatgcctgccaactctacaacttaaatatgttttccgtgtatatagatatatacttaaatatatctactgtgtgttttggctttgaggttttcaaaaatgtgtattcaaatcgtgtagcgctacagctaattcagtaataaggactaggcttagtggctcctttctgtaatcccagcactttgggaggccaaggtgggaggactgtatgaggccaggagttcaagaccagcccgggcaacatagtgagacccacatctctaaaaacaaaaaatacaaaaattagctgggcatgatggtgagcatctgtagtcccagctgcttgggaggctgaggtag

SEQ ID NO: 155468 - DNA, 298 bp, Homo sapiens
gacggctgcaaagcacacacaccttaggcaatcacgcctatggttcagggacacaaatttaagtgataaaactacaagcaagtcaaggaaattaaacttacagaagtcaggatcattaccataataattagctgtacaggccgggcacactggctcacgcctgccatcccagcactttgggaggccaaggtgggtgggttacttgaggtcaggagtttgagaccagcctggccgatacagtgaaaccccgtctctgctaaaaatacaaaaattagccaggtgtgatggcggccacctg

SEQ ID NO: 155469 - DNA, 227 bp, Homo sapiens
tgagccaccgtgtgcagcctctgatttcttgattgtgagtaactgggcccagaaacagtggaggaatcctcagagtctcacctgccttgtgcctgttggtgtgagcagtataaccaatgaccagcaagccaccattgagggtgggggcaggttctagatggggatgcctggtttgtaacatctcccactcaggggcacccagccctctggaaaatagcacgtgaaca

SEQ ID NO: 155470 - DNA, 352 bp, Homo sapiens
tattaaggtacggatttcaactctcagaaccaccaggaaaatgtcactggagatgacagttctttagcttaggtaattcagtttcttgggccctttcccaggggccacagatttaattcctatggctatttttattcccacctccattcctttaactagcttttctgtctcatccctcctagattctaacttcgtgccaggtcactaacgcactggccccttgactcacagtcaactctgcctcctgactggcatcccaagcttgaagtcccacgtggaggagtgttcagactcaaccccctggggcttccacagtcagaatctgctaacttgtcccgcacaactctgtgag

SEQ ID NO: 155471 - DNA, 289 bp, Homo sapiens
tggttctcccccgcttccagctgttttccatcaccttcatgggtgctttccctcctggttggtcctttgcttaacttgtggtgttccctagtactccatccgtaatcttccctttccctcatattctccctgaacactcttcttcatggctatcatgtttagaaccatacttctaaatctgcatttcagatccatctagaaaccttcaggtttttattttgggctgcttattggatggagttatctgtgtgacttggaggtatgtgaaaagtcaacatgtcaaaactca

SEQ ID NO: 155472 - DNA, 368 bp, Homo sapiens
aatactcctaacagtctacaaccgcacgagggcaggggcccctcccccagcacctattgctcgcctctccagattctagaacttttcataccaaggcttagaacattaaatccctcctgccacccacaataaaatgaatccacatgcactcgggtatctaaggaacagaggtgaatcctgacaagtcgagacaaactttctcctgaggaaaaagagaagatcctcccccaccctccaacctgccgctataggcagcctgctccaaagtcattgtcaagctttgaaatgccaaaaccagtgcctggattttgaacctcatggggtctgactttcacacaatccatgcgacagcataccgcccctacacc

SEQ ID NO: 155473 - DNA, 386 bp, Homo sapiens
cttaccgttgtctaggtcatgaaaaacaaggaaggtctgagtaacaggctcagccagtaggaatctaaggagacatgatgattaaatgttatatgagattctggaacagaaaaataaaggccattagatttattagatttataacaaaacaccatagagaaatcaaaataaactatgaaatttagttaataaaggcatgtctgtattggttcatcaattatgacaaacgtaccattctactgggatatgttaatagtagggaagctggatgtgacatatgtggaaattttctaccttatctttgcagtttttctgcaaacctagaactgttctaaaaaatagcttattcaggccgggtgcggtggctcacgcctgtaatcccagca

SEQ ID NO: 155474 - DNA, 194 bp, Homo sapiens
ggcttgctgaaatttgaatagctggcaactggcagaatgggatttgactccatattgggtgaccctgtgaccccccaccccttactctttgtaaccaccgttttatatttgacattttggggtgtttttcgatttcacatgtaagtgagatcatctggtatttgtctttttgtgtctggcttatttcatatagc

SEQ ID NO: 155475 - DNA, 404 bp, Homo sapiens
tggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcga

SEQ ID NO: 155476 - DNA, 326 bp, Homo sapiens
ctccagacaggattcccatcctgctaagccctcgccaggccctagacaggtgtgctggaatgtgtcccacctttcttccctgggaacaaagaagtaccctccatcctccaaaagagaaagccacacggaaaccaaaggacatggcccgtaaggacccatgaggctcatgagggtcagaggttagacacttacttctaccttccctcctaatattttaataattagcagaacaaggccgggcatggtgacccacacctgtaatcccagcagtttgggaggccgaggcggggaaatcacaaggtcaagagatcgagaccagcctggcc

SEQ ID NO: 155477 - DNA, 256 bp, Homo sapiens
cctctggccagaactgtggattggaacaacgagcaaataaaaatttagctacaaatttcaattatctcagtagggcctctaataccaagtataacaaaaaaaaatctagctacatggttccttaagcatgattccaaatcaattaaaaaaaaattaaaattatcctgagaagctcaggtgcagcagctcatgcctgtaatcccagcactttgggaggctgaggcaggtggatcgcttgagcctaggagtttgagac

SEQ ID NO: 155478 - DNA, 460 bp, Homo sapiens
aggttttatagaagaaacatacttagtgacgttccttgacggagtagaagggcggggaggggaacaggtaggagacaggagaagcaagtccacagcactaacaaacccattcctggacttgtgcacatccttgagcttcagcccagcttttgcaggcagcagtgaccctgtatttcaattgttaatgccatgatacccctatatagaagaaattccatgactgctttcttaaaactgtttttgatattcagttccttcctaatttcattttagtttatcctcttggctatttgtcctccttgagaagaaagagtccgagagagagagacatggtctttggtatcaagatttgcatgtataattttctgagctagcttttctcaggaggagttattccttctgtctgtaagtgtccccaaatctttatgaaataacatactaattgtggccaagatgctag

SEQ ID NO: 155479 - DNA, 136 bp, Homo sapiens
gtttttgatgatgatgtgatccaagtgggctctctgcagtgtgaggccagcaaggtgcagtcaccaccccccacagcccagtccctagcattgtggggttggaaacccgatattacccattcatccagaaatacta

SEQ ID NO: 155480 - DNA, 363 bp, Homo sapiens
tcctttgaaatgtcctccccctccattcccctggcaagcttctacttttccttcagacttcggcttctatattactttaggtaacaagtccctgacccccttcctccaaatctaaatcaggactctcatttttaaaatgttaacttgttgctatatatctatttgtgttggtattcattaaatatcttttgaattgacacataactcatgaagagaccttctcatttgtattaacatccagctcatatttttcatttttctgcaagaacagcttgccagataccttgctgccgtccagatacataatctctctcttaattttttcactttctaagtttttaaatctttcaaaggaggaaatgc

SEQ ID NO: 155481 - DNA, 111 bp, Homo sapiens
aacacaaacagtagattaaagcattgtacaatgtcaaatatattgaaggtaaaaactgtaccttaagactcttaagactatcactattctcagaaaatacatactaaagta

SEQ ID NO: 155482 - DNA, 384 bp, Homo sapiens
gaagggggaactctagttactatgactcttagctgttctctgcccatttactctttccaccttagaggagataaagtgtcttatctgacactttaggaagggcaaattgggcacacttggttcagctccaccatctttgttttgttattaacctgactttgggacatagatgttcattcagctcctccagggttagggctggttctgcaattctgcggcagagtgaagggaaggcctacttcattccaaagttgtctttgtctatatctaagtggctaaagcaacctaattctattgctcaataaaaaattctgtttcttgcactgcacgggggtcatgctaatcttctctgtatcattccaattttagtatatgtgttgctga

SEQ ID NO: 155483 - DNA, 235 bp, Homo sapiens
gaaagagcgagcttgatctgggttgctgggatgttctagggttgcttccactaagatcagcaacacatagattccttttctgcatcatccaggaactgggcattatgcacaccctcacacaacgcaaaaaagtagtaactgtgctcatcttatagatgagagtggctctaagaggctaggtgccttcccaaggtcacctgctggtaattgacagaacaggaatctgaacccgtgg

SEQ ID NO: 155484 - DNA, 405 bp, Homo sapiens
aagaaagagaggatacagcctagaggtgactcttatcaccttgcttacaattattggctaaaactagtcatatggccacacccctgaaaagaggtaggggtaaattaagggatacagacattggataaacaggtaccttttattttggaggaggaggaggttcttttttgttttttgggtttttttaaaatttgagacagagtcttgctctgtcacccaggctgaagggcagtgacatgatcttggctcactacaacctccacctcccagactcaagtgattctcctgccttagcctcctgagtagtcaggactacaggtgtgcaccaacaggcatgcaccaccatgcccagctaatttttttttttttttttttttggagacagagtttcgctcttgtcaccca

SEQ ID NO: 155485 - DNA, 619 bp, Homo sapiens
ccatgggttcgtgtagacagtgtccttcctagtaaccgtccgggggtggggtggacccagcatgtcccctggagatggctcaaatatttccagttcagacagtggcagtagcagcagcagccctggcccggccttgtggtgctcttgagggtgcgtttctgtcggatcagtcctggaacctggcctgtgggtcaaaggccctctcacaaagcaccctccagcaggtttgggctgccttatactcttctccaggttgtcgaactcctgtttctctgaaaggaacccacgcctatagccctgaccacaggcagaagaaacataggaaactctcggagctcgagagacctcacaaagtgtctcacggtcatgagaggagagatgagagaaagaggtgtcacagaagtgtcaccaacttactcttcagaccctgagtcttctgattatgggcatgttcaatcccctccatcttgtaccactcctcatcagatgtacgtcgaccactacagatccctggaggaggaccaggagcgcattgttcacaccagaagcctgggaaaggcacagcaatgctttcaggaagactcggggcaagcaagaacgaactggtgaacccagggaa

SEQ ID NO: 155486 - DNA, 804 bp, Homo sapiens
tttgggcaggcctgtgaaggccttgatggttgctttctccaccattagaccctctctctgtggccctcctggtggcctcccacctccacttccatacagtgccctgcccttcccccagtctccagtgtcagaaatggttttcaagaaaggagccaatgattgtgtttatcttgaagagctaaatacaaaagaagttcccatttgatgcagagcaggtgctttacaagtcatttgaccgggaaacagaggatggaggcattttaatgggaaacaaagctttaatgggaaacactgtagaaatatttgctatcactaatggtagaatttcaaacagtgggctggaagtggaggtggggagctgggtagttcttttgggaacgggtccctgtgacaatatctagcagctgtcagctctgtatttggcaagggcagctttggccctgcaggcaggaatgctgtaagagtgtgtatgcatgcatgtgcatgcgtgcatgtttgtttgactggtcaggtgttactgtcaccagaaggcattttttgagcacccagtgtccactttcgggatgagaaacttgtgtacacagggttcctcgttggcattggctgccctttgccaaggcaattattagacctcaagaagatagtgttgttgcttacaaagtcagtgcctctagctagttgtgcgcactgagcctctggctgggggcattagctctctgctcactaagcttctttattatatttcctggccagttctgaccggttctgtaggcacccaaggctgccttgttcagtccctgctgg

SEQ ID NO: 155487 - DNA, 301 bp, Homo sapiens
gggaggggtggaaaaaaatccaacagcattattttttgggagagaaagaaaagcaaaacaatagatataatatagtgtaaatcaaagtatccctaagtgttttgggaatacaaaagtgtagctaacataacctgggagtgatactggtggtgtgtaaggttggggagaagtctaagaagatgggaagctgagctaaatcttctaaatcatctaaagtagaagtggtttactctagtaattgaggaataaagatataaaatatctaggggactgcttacctagtacctagctctgctcttta

SEQ ID NO: 155488 - DNA, 448 bp, Homo sapiens
aacacttggtgtctatggcaggtggagaaagggactcttggggtggggaaggacaagagaacggggttggcatgaagagggcagtaaaagctttattgaacaataatgctctttttctttaagttgtttcaattatccctctgtatccacccaaacaatgtattttacaaagaccactatggcacttacattatacacaaggtaagtaaagtggaaaaataggtatctaagttctgaaaagaaagcagaaagaagaagtcacctaaagatttcaaaccatacactactggaaagaaggtgtcttaatgctagaatccaatataacttgatccattcagagctataaggccctcaagacttatgggcgtgctcttttgggctaatggatgatatcacttaaagatatttcacatagcaatatactgaatatttagaccaaagaagtatt

SEQ ID NO: 155489 - DNA, 224 bp, Homo sapiens
ggatcagctggctgggaggattagtgagcacctctgtattttgaggtctgagtggtctggagttgtgagtgatgcttctggcctgagggaaagggaatggggtgaatggaatagcagccagccttgagcctggagtgagaagcagagaccaggctggccagggtctgagggcttcctgcggacgccacgcaggtgagcacagctgcccgtggggcagtgcacct

SEQ ID NO: 155490 - DNA, 169 bp, Homo sapiens
taaaatcacatagctctctcaaatggttgggttagaagctcttgtttgttttaaatggttgtgcctcttatgaggcctgtggagagaatgagtagtgagtgtgaaacaagtttggggaagatgtgactccccctccacacacacagaacttggcaaaaggtatgcaaat

SEQ ID NO: 155491 - DNA, 118 bp, Homo sapiens
actaaccagtgcattttctgtttttctgaccagaccatcatgggtacagagagccagcgtcagctcagagtgaatattcataaaacctgatttcttgcttaatcttaagcaataatct

SEQ ID NO: 155492 - DNA, 191 bp, Homo sapiens
atttcacagggatagtctcaaggttcataagcagctccaaaggtacttgaagatatttctgaaagccttaatcagaattggcaatgtttcctctgatgctgtggataccattcgtcctcctcagtaataataagcactaatatctctggagcacttgggatatgccaggcttcatcacataccatcttatt

SEQ ID NO: 155493 - DNA, 270 bp, Homo sapiens
tcttctgaggccctaataataatatgctgaatgtctggagcctctactacataacacatgccaaggatacctttgggtattaatttaatgaagaattgtagtagaaatgacagttgtgaatttaaaaatccatttcacaggaagtccttaaaaaagattatttaagcatttcatcctttaacttttctaaagtgcttactcactgtacatgatgccatttagttattaaagtgagtaacacagtctcaaacataaaatatcttattggac

SEQ ID NO: 155494 - DNA, 626 bp, Homo sapiens
gcgggtggctgtcctgtgcattgtagcataattagcagcatccctcgtgtttacccagtagatgccaatagcacctccctctccagatatgcaaaccaaaatgtctctaaacatttccagaagtccactggggacaaaatcgtctgagattgagagccacagcactacactgtcctgcctcccctcatgtaagtgttttctgaggggctgcaacaactccaccttgtccagtgtcttcagctgtccctcttctttcacggtgatcttcatgaccgtgcaggtagccccttgtctttgccacagtcaacagaaggcttactagccgggccacctttcctagcaactcaacctctctgtctcccaggcacagaaggcacagggcttggggcctgatagacacctctatagctcttattattatttgaatcacaggagttccctggggtcagagcctggaggagaagtgccccgaacctgctgaccctctctggcccagagctgtggacactgctggttctgtgagtttgttttcctggttgagcaagaacaccacacgatggtgttgggccaaaactggtcccattttatgctactatatctccactgcccaggctggagtgcactgg

SEQ ID NO: 155495 - DNA, 242 bp, Homo sapiens
ccagatgtggtcctattttcattgcagctaatacaaaaccaaatgggctaaggataaagttgtattcttagatataagaacttgttgacaggaagggatatgaggtaactgaacatgtataaaacatcttcacctggaaatatgtacaatgaaccaaagataacaggccatagttacaacaagtttttcaaaagtaactagccgcaaaatgctgttcttgcccaatattcacagtggcttca

SEQ ID NO: 155496 - DNA, 237 bp, Homo sapiens
catcttcattttcctgtggccttctggctcttccttccccaattcttctgaaacattattactgtagctattttctaaggaaaatccaatcatatcattcctctgtttaaaattcagcttaaaaatgctgaaaagagccaggcacagtggctcatgcctgtaatcccaacactttgggaggccaaggcaggcagatagcttgaagccagaaggtcgagatcaacctggcccacatgg

SEQ ID NO: 155497 - DNA, 236 bp, Homo sapiens
ctcccagcagccaggcgccaatcacccagattcagaataccacgtctgggcaattttaacttaaaatatcccattgcatttcctaggcaatactaaatggatagcctctcaatgatgtgactaaaagaggatagtccttgccaggtagtttctccttaggccgagctcagagaacactgaaataaaacaagtgggtgttttatcaacagaggaagaaatccatgggggggccgggg

SEQ ID NO: 155498 - DNA, 511 bp, Homo sapiens
gcttggcacgctatagatctatctgtgtcaagtgcaagaaatactcaggtggacaagacatagattatccttgactgaacacagaatagacaagacttaggtgatggtgcgtctcatagggcagacacagaaatcagtggggaagggaagggcatttcagggaatttcatataccagggatataagagcttatgatgtgtttgaggagttgcaaatagtttgatggtcctgaacactgcaggtatattgttgagtgacagtagataagcctggtccaaaagatgcaggccagttcatgaagtttaaacaccttgaacaccttgctaaggctttatcttaaaggcagtggaaggtcatggaataattttaagcagggtattgacttagctttgcattttggagagattactaatcatgtggaagatgagtttgtagagagactaatgcattatgcaaattctatagtaattcaagtgaaagatcatgattgcctgagtgaaggtgatgagtc

SEQ ID NO: 155499 - DNA, 444 bp, Homo sapiens
ctagagcgcgtgccctccagctgccttatccagatgtttccccacccagcagtgcagtaggggccgtggggcctggaagggtggtctttaaggagagagttcaagagaggccagagctcttgggtcactctggaacctctgtaggaccaggggctgccaggaattcagcagggggcactttgggggtccctggttctggaaaggaataggccagccagtccaggagaaacagaatgtgagccacacacgtgtgagccatggatgtgatgtaaatgtcctcagccacatttaaaaaggccagcaagaaacaaatggactgaatgttaacgatacattttgtttgacccagtttatccaaaatgttatttcaacatacaatccatatataaaattattacagatacttcacattctttttttttcataccaaatcttctaaattcc

SEQ ID NO: 155500 - DNA, 338 bp, Homo sapiens
catccgccggtcccacacacggagacgtaggaatgcagtactcacgcacaagggaagtatgcggtactcacacacaggagaagtaagaatgcggtactcacacacagggagaagtaggaatgcggtactcacacacgggagaagtaagaatgcggtactcacacacaggagaagtaagaatgcggtactcacgcacaagggaagtatgcggtactcacacacaggagaagtaagaatgcggtactcacacacaggagaagtaggaatgcggtactcacgcacaagggaagtatgcggtactcacacacaggagaagtaggaacgcagtactcacacac

SEQ ID NO: 155501 - DNA, 480 bp, Homo sapiens
ggtctggacattactgggacgatcagtaaaactctgctccttctccaaccttttcatatgagtgagcttcaggggtgcagttggcctttggggagaatcgaaacttaagtcagaatacataggaggcattattaggtgatgatattgaggatgctaatcattgcattttgaattttagtgtcatagtggaaaaatttgagaaagcgataaggagtagaagattgacaagagaaagaaaatatcaactctgaagatggcacagtaaggagaataaaaacaaaaggctggtattttggctggtgatcaagaaaatggtgttctgaagcaagggaggttaaattttgcctagatgctaaatcccaatagtgacattatataaattggaggagggtgaaggagaagagaagcttcatgatttagctactgcctagcaagaaaccctgtctctggccataactgtcacatggggaggggagccag

SEQ ID NO: 155502 - DNA, 313 bp, Homo sapiens
cagcacaccagcagaagacacctaaatagcagattcacatcagtttctggttggttcattttagacatgaatagacttcacatcattctaaagcagctaagagatgagtatggctgcactggaagaatggaacctgaggggtgggactgctgtttccattaagcttttcagtttacatgtgtctattacattgctatacacaaaagcattaaaggacaaaaaaagaagaaagaaaaaagataagcatgcagatggcttgtcccacaccaggagatgagaactaaaggaatgatgatgtcagaaccctctcccc

SEQ ID NO: 155503 - DNA, 405 bp, Homo sapiens
caggcatgagccaccgcgcccagcctggaagttttattctttttccttaagaatgtttcttcaagcgtgagggatggccacagtgtaggtcatttaaccgagttctcagtttgggtaagagttgctcagccacggctgggtgttctcatcgttcctgggatatgccagttgccgtatgtgggattctgttcagaaccccattagcctcgagcacggaaacacgtggcagacgtcccaccctggacgcactggtgccctccggtgtttgctgccctgcttcaggcggagacacaggcctcccgctgcacacctgtggatgggctctcgcgtgggtcgtcctcccactggccgcactctgtgccccatggccctcctgcgccccgcccggcgtcctctcacggcctc

SEQ ID NO: 155504 - DNA, 316 bp, Homo sapiens
aatgttcttcctcgttttttctggaccacagtcgtctgcattagaactacctggaaggcttgtgaaaacagagttgtgactctaccccagagtttccaattctgtaggtttggggtggggcagagattctgcatggctaacaaccactcagaggatgcagatattgctgatggagactttgagaaccaccggtctagacccaattctgcacttaatttcatctaacccattccttttcatggtgagttccttatcagcagaaaccttgccttttccatcctctataaaactaagcattgcgaccggaaagctaatc

SEQ ID NO: 155505 - DNA, 453 bp, Homo sapiens
ttatatttttacatacaagtaacattttgcacagtattggacatgtagtaaatgctctatagtatgacttttaaaataaatactattgaataaatggtggaatcacttaatcacactaacgcagataacagttctaaaactgaaaaaaaaatttaaataaacaactatttgaaaacattggagacaaaccagaatcgaatagaaatgggcaaggagtgtaatcctgaaagatgatagcagcaagggggaaaatttaagagtatagctttttgcctgagggcactccccagtttatgtgctgcttgggacatcaaaaagtctgaactttactggatagaagtatcagaggacaaggttaatagctggaagagcagctggaaagttaggggaaaataatgtaaggggattagcattaattcccttctgtaagcaatgagatgtaagctacagaat

SEQ ID NO: 155506 - DNA, 554 bp, Homo sapiens
ttgttttgtaccccgtgatatttctggagagcaagcaacaagtgagccaaataatctgggcctggcaggactacagaggtcaaaagggaggacatgagaagccacgagctgtccacagagatggcagccttctccctcccatttagcggggctggaaatgagctccctgtgactcctttctgtccttccccggctcctcccagtcacctcagtgtgagtgatgagtagtgcagtgacagcctcgaccacataccacatttctgtcctgtaatagctttgctaccgacaactttctttctttttttttttggtaccaaatttctttatttgaaggaatggtacaaatcgaagaacttaagtggatgttttggcacaacttatagaaaaggtaaaggaaatcccaacatgcatgcactgccttagtgaccagggaattcgccccatggctatggggaaattagcctgaggcttagttttcattatcactgtctcccagggtgttcttgttaaagatatattctgccaagccagaatatcaggggctcctctagtgc

SEQ ID NO: 155507 - DNA, 398 bp, Homo sapiens
ctaaaaatcttaatattctttgtagtagagattcaaacagtaattctaaacagctatcaaaaatccttaaattcagttttgactacagttaatgaagaacatacagtcctttatccttttgctaaacttcaagaaagcagtagttaagcctgatacaaaaagtttaggacacatatttcatttcctacagctttcccagattccttaaaaatgttgaaaacagaccaaattgtggtattcactggagctctggagagcccattaaacatgattttgtaaacatgtcaaggttattacataacataaatttgttactctagggaaggtaaatattatatccctgttttaagtcaaattttaaaccaactacacagaaagattttactgaacgccatcaa

SEQ ID NO: 155508 - DNA, 612 bp, Homo sapiens
ctgggcatccctcagcttctgacaaacaactgccttcattagaaaggcccagaattccagccccagggccacccatcttcttggcagtcctgagctcaggtcacctcatgtttttatttttacacagcctccccctggcctcacacatgtagcctgtggcatgtgagcaatcaagcgacaggcaaccaaaaaagggtaggaggcaaagaggcaaggaataccgaatctgtgacatcttcccccaaggaacagcggcgtcgccagtgtctggataaatcacgttttatctcctttcgagagggacgcagggcagagccgcttcatcttggtgatgtcgtctgtctgcacagtgttgtccatctgacagggagatggcccggccctctggcttcagagaaaagatgatgaaggagagcttgagcaagagtccaggagaggaacaagaatgacccagcaagcactcattgagcatctgctgaatgcaaagcctagtgctccatgtagtgtgggggcagacaggaggggtgagctgcagagccatcatggagagatgagagatatccacgggaagcaggtcacatgcaataggatgcagttacacgttccactgtc

SEQ ID NO: 155509 - DNA, 412 bp, Homo sapiens
tttctttttttaaccaatgcccctgaggataaagctgttaatactacccaagctccaaatcaggtcaaataaaggcagtcttgtaagtggagttttccaggaattgagagacagtttaaataatcacaattttctggaaatgaggctttgtagaatatccaacattatatttcaatcccagtgtctgccagacttctggctgtcagcatgattgtgggctgcttgttttcaaagctactgcggagctgtacaaggagataggatagagcaagttaaaatgatacaaagctcactgtttttacttagattcagccatttttcttgaaaaaacacttcctgggttgctgcaagtctttcttaatttgagtggtttttgaaaaaggtcgacgcggccgcgaatttagtagtagta

SEQ ID NO: 155510 - DNA, 230 bp, Homo sapiens
agtgcaaaactggatgctgcaactgaattaaaatggaatcgcatgaaaacaggggctcttcacaaattgcctgtaagacacaagatgaaatccttttgaccagtcactccaggactacgtggaatagatttcttccaccttctcctgcagaagctactaaatgacaccagcagtaagacaggagaggaaggcatccccttggaagccatttaatgatcacctaattgttc

SEQ ID NO: 155511 - DNA, 873 bp, Homo sapiens
caggtaaagaaactgaggcttggagaggcaaaatgattcggctgaggccccacactaggttcctgacaagcgtctggcttctggaccagagttcacatcccatcccatcaggctggaagagactgcgggtgaactgaatgcctctcaacgtccctttccacccctggtggccaggctcattaggagaaaggatgtcagaatctcagtggaggtgtgaggatttttctcccaaagtcataaagcggaaggcatcctgcctgtttaactggcagcccgtcttctggcctcacctcccttcaggtactgcttttttatctcctcctaaaatgcggcagcccttatcgtcccaatctcaaatttcactccattttttttattacacaaaagagaaaaaaatctgtcagtaaaactgtctcctcaaatttattcgccgagactgagggttttattacgaggaaaatacacccacaccccacacatccacacacatacccacacaccccagataaagcactgaagaattatccgagtcgtaaatctctgtttcaggctgagggacaggggagtttcaaggacgagactagttttcctttggttttatttacatctgtttctctggggctgtgtcagggccttactgtcagccagaggagtaaataactgcttctgtgaaacctgcttcaggcagctggagacaagtgcttatctcagctgcagggtgagggatctggagggcaggccccactgtcccagctgtctgtggtacacactccttcctccctcagcctctcggaaggcaaaggaaatgggaggctcagacacgctcaggtggggccagcgggctagcagctatttgcaaggatgttattctgt

SEQ ID NO: 155512 - DNA, 861 bp, Homo sapiens
gctgtaccaggtcctgggaacagagccgaatagacaagaatgttcccattttgcaggtaaagaaaaatgtgggccagatcatggagggtctccacagcaaaggagctcagcttctcctgaaggcggcaggaaagagcagtgtgcgctcaggggaagcttgctgccttcacagcacctggagaagaaaggaagtgggatgagaagaggatttttctcccaaagtcataaagcggaaggcatcctgcctgtttaactggcagcccgtcttctggcctcacctcccttcaggtactgcttttttatctcctcctaaaatgcggcagcccttatcgtcccaatctcaaatttcactccattttttttattacacaaaagagaaaaaaatctgtcagtaaaactgtctcctcaaatttattcgccgagactgagggttttattacgaggaaaatacacccacaccccacacatccacacacatacccacacaccccagataaagcactgaagaattatccgagtcgtaaatctctgtttcaggctgagggacaggggagtttcaaggacgagactagttttcctttggttttatttacatctgtttctctggggctgtgtcagggccttactgtcagccagaggagtaaataactgcttctgtgaaacctgcttcaggcagctggagacaagtgcttatctcagctgcagggtgagggatctggagggcaggccccactgtcccagctgtctgtggtacacactccttcctccctcagcctctcggaaggcaaaggaaatgggaggctcagacacgctcaggtggggccagcgggctagcagctatttgcaaggatgttattctgt

SEQ ID NO: 155513 - DNA, 100 bp, Homo sapiens
ggggcaagcagtgggctatttgaaggctccacaggagcacaggagagggttacctcggtccacccactgcactctgaaacttgaaaaccaagccaattgt

SEQ ID NO: 155514 - DNA, 514 bp, Homo sapiens
ataaaaataccataaagcaaaagactggtgaatctgactacattaaaagcaatgattttagcagcacccattttaaagatccttcccagtctgcagcttacattttcaccctctcaaaagtgtcttctgtccatttcctgtggcagggtctggggaagaggctgtaggcccgtgtccggccatgaagatggcaagaagcctctgagacagcccaagaagcaggcccaggagagggacagagatgatgaggcttccagcagaaagcaaaacagaccagaacctcaaggggccgaaagcacaggccgcagggaggcccagccacagctggaactaagacccctggcggaaagcacgctgctccctctgcctgggcggtggcggcctggactccactcctgtttcaacacctgcacccccgccaggacagcttttgccatcttcagctagagtgagcgttgccctggagcctgttgcactttcaagcataaacttttctttttttttttaaattaaa

SEQ ID NO: 155515 - DNA, 602 bp, Homo sapiens
tgttccagggtcttagtgttccttgtctcttcgcagtataacactcatatgcttatggctggagagatacttagctgggtgatagttaaaggttaatccgagaatgagcagtggatatagccgggagctcaggcagctcggtggatatctgagaaatggtctaattcatgctcaggagctgtgtgcctttccatcccttgcggctccctatccctcactgccaagggttctctctcctgcttgggcttagtgtcctacatggggtggtgaagcgatggagctcctcactggcctcgcttcactactctcctccccccaggaggaacttgaaaggagggtaaaaagactaaaatgagggggaacagagttcactgtacaaatttgacaactgtcaccaaaattcataaaaaacaatagtactgtgcctccttcttctcagacaaagggaaacaccggtgtttcccatctctactaaaagtacaaaattagctaggcatggtggcgcatgctataatcctggttactggggaggctgaggcacgagaattgcttgaacctggaaggcggagtttgctgtgagccaagattgtgccactgcactc

SEQ ID NO: 155516 - DNA, 300 bp, Homo sapiens
  misc_feature (220)..(220): n is a, c, g, or t
tagtcagagatcccgagttaagggctacccatgtggctttagcacagtttttcaagttcttcatctttcaaagtaggataccagtacctgcttcaatactcagggagggaggatcagtcagggcacagaggccttttagagcaatggaattaatgtggatgacatcataatggagataaatgtcattacacatttgtccaaacccctggatgtgtaaaancaggagtgaaccctaatgtaaactatagactctgagtgtccatgtgggttcattagttgtaatgggtagcccttaaactg

SEQ ID NO: 155517 - DNA, 419 bp, Homo sapiens
tagtcagagatcccgagttaagggctacccatgtggctttagcacagtttttcaagttcttcatctttcaaagtaggataccagtacctgcttcaatactcagggaggatataacagctgcagagggctggccatgcctagagtctcatgaccccttaggaaatttttcatgatgagactcaaagatagtgttcaatgttagactggtttcgctacagaaaacaggaatacttccactgaacaaccgcatacgaaagctaaatcctgctagtgtaaaaatcatcagatttcactggatagaatgaaagaagaataaggaaagaggaatatgataaaaataaaaagagaagtaaaatttgtagcagaaattcaaattggtgatttgctgaatagcagaaaatctaaaatgaggaaaaaca

SEQ ID NO: 155518 - DNA, 401 bp, Homo sapiens
gatacatgcctccacaaacatcaagtaggtaaataaataagcagacagaagtgaaataaatggagaatcaaaagtgaaatcatagcaataattacttttaataattgctttgaagacatttccactattaattcgtgagcccagggtggaaggcaagcacatgtacagacccccaaccatgctctggtcctgaaggagaagtccattcaggaacctgtctagctatgtggtgggatccccagctagcggtggagatgagccctggccaggactgtcttatagcttcacaattaactgggcagttcgggacaggatgacctggtgaactgggagtgtcatatgctggcaagtgaggagccaggacttccaaaaaggaagtttgtcactgagtcagcgatgtt

SEQ ID NO: 155519 - DNA, 170 bp, Homo sapiens
atttgggaaaggctcagtggtgcttgccaaccccattctttttgttatcatcattcatgatagcattaaagactattaatagtgtcatttattgagtacttcctgtgtttataggcatggctctaaaccgagagcttgaggctgtcacttttcacatcgagccacatcac

SEQ ID NO: 155520 - DNA, 398 bp, Homo sapiens
tttttcacacaaaatctcactctgtcgctaaggctggagtgcagtggcgcaatctcggctcactgcaacctgtgccctccaggttcaagcgattctcctggctcagccttccaaatagctgggactacaggcatatgccaccacaccctgctcttttgtgtgtgtgtgtgtgtgtgtatttttaaagttatggcaagttttcaccgtgttgaccaggctggtctcaaagtactgacctcaagttatccacccacctcatgcctgcagttcccagccattcaggaggctgaggcacgataatcgcttgaactctggaggcagaggttacagtgcaccaagagtcgtgccactggacttcagcctaggtgacagagcgagactctgtctccaaaaaaaaa

SEQ ID NO: 155521 - DNA, 395 bp, Homo sapiens
ccaaaatttggggattacaggcatgagccaccgcgcccggccctgccctgccccctttcttttctggatgctgggtgtgaagacagagcccgcaggccaagaccgcaggaaaaaggcacgcagccgctgttgtatcttcagagtccacgcctctggcctctggggcctccggttcccctctgtggaatggggcaaaccttccagagataaggtgacccagggaccagcgctatgctaaggaggtctctggccttcgacaagcttctaatccaagaggcctcccagatgcacctcaaaatgtgcccatttcgcggacggaaacaccttccaaatagtaggctccgttccaagcgcgggggttattcctgccgggtcttgctggcagccttgtcggg

SEQ ID NO: 155522 - DNA, 251 bp, Homo sapiens
tggataaacaaatcatggtaccaccataaaatgaaacactacttagcaatttaaaaaaacactcactgatacagccaacaatatggatgaatctcaaatgccctatgctaattaaatgaagccagtctcaaaaggctgtatactgtatgcctctgttcataattacattatggaaaaagcatatatacaggaacagaaagcagactggtagttggcttggggtaaagggaggactgacttataaggggaga

SEQ ID NO: 155523 - DNA, 441 bp, Homo sapiens
catgatcctgcttttgttttgttttggtttttgcttatttcaggtatattagtatttaatttttgtgatttgtactttcatatatgaaaacaactgttaatactttttgtttcttaaccgctattaagtacttttgacctggatctcagccagtgttaatgctgttgctactacttgataccattgtaaattataagcagtttagttaatgcaacatagtatttgtcttttgataagcaacgtgaaaaatgttaaataaatcagaagtggtcagtggttccaataggctacttgttcttaacaggctactagagagaaacttctccaaaatttgttaatgctgccaacagtcaagcatgtgggctcctcctgaaacattcatttccccaggccaagaccacagctcatagcagctgtctgcttatgtgaccaggtagtgaa

SEQ ID NO: 155524 - DNA, 1909 bp, Homo sapiens
  misc_feature (1299)..(1299): n is a, c, g, or t
atcaggattcacctgtctgcctggcagtggtcagcccgttctcagcaagaaaccattgacaagaaagtaccacgtggcctgggtagggtcgaagcggaacttagtttcagagaattagaaaaatcttggaggggaaggccgaagaagaaacaattcatgatcaaccttctcagagtctttgtcagtaaccccatccccatcctgacttaacagtttctatgggaacagctcagcatcttgtgactggtggattcacttcctaaattggaggccatgacttgaggcctttgcagttttctgatttaggggaaagtgaagaaagggaaagagaaggtcatgcctttgtaatcattccgatggcctgcatcaatattttgggggcagaattagcttctgggtggccagagcctttggtctaaccctgagtgtctgggcgttgtgcagcagagcgagaaagccctggctgtttgacggggtgtgtccaccagtgcttcctggcacaggtcggccgggctgcttcacttcttgtttccagagattcacggcaccagtccccctctggtacccagcctgacagggccatgttggtgggaccaaagctgtactgttgtttatgacgtgtttcatgtcagtatttcaggcccacccactgggctccccctcccagattgccaaagttgtggagtctgtttttcttagttgaatgtcttagttctctgggataggtgaacagatctcaagagcaaggaacatcatcgcaggtctgaggaggctagattcccagtcctgttggagttttttaaatctgatttaatgatctgaccctcccactcctatctctgccccatccgagtctggctgctttcccagggggcagagcaggctgtgccaaaaggaactctaacgtgaaaagcgcccttcacttgtagcttgtgcaggccagtcttgcttacccctttagattaacaaaactgccttcacttgtctcattgggattaaaggatcagaatatcaagagagattgaagggggaagatgccagccaacaggtgatcctcttagaacctgccctctgattcctgcagctgaagagaaaccaaatgaaggcgattagtctctgcctggggtcccccttcccaagtgggtaccactagctggggaacctcgccccctccaccaggccctctccccagcctgtcctttaggattgctgagttcagtggttagatgttcttacggctcttctctgaaacggagttactgctccttcttaggcacccctggctcagccaagccctgnacccacctgacgggttttcatgtgtgcctagctgggtggtggacttggagaggcacagggacagcttggggctccaggggggcattgaggcagcactgatgcagcttaggattagcaaggtcaaggtgactggctttcacccatatgttcctctgtatggatttcactgagcctcgattgctgccccttttcatggcattttgttctgggattttgctttgaaagttagggctctttcagccttgtggtgagcagtgaattgtcctcgtcctctgcttcactttccagattttgcccagaaatttccctgcagtgcttaggaagctgcctggtagagcaggtttctaagtttgaggcgaagcagctctggaagctgcctctgtccttgctgttggaggcagtgatttaagtagcagttgcctagagatacatcctttctgttttaatctcaaagagagaaaaacccagtccctgtaatcccagctacttcggaggctgaggcaggaggcaggaggcaggagaatcacttgaacccaggaggcggaggttgcagtgaccctgagatcaccactgtgcgatctctgtctaaaaaaaaaaaaaaaaaaaaaaa

SEQ ID NO: 155525 - DNA, 272 bp, Homo sapiens
ggcagatcacgaggtcaggagttcaagatcaccctggccaacatggtgaaaccccgtctctactaaaaatacaaaagttacctgggcatagtggcagatgcttgtaatcccagctactcgggaggctgaggcaggagaattgcttgtgaaccgggaccctggaggcagaggttgcagtgagccaagatcgcacaactgcgaactgcgctccagcgtgggctgcagaggcagactccgtctcaagaaaaaaaaaaatcagctttctttccttc

SEQ ID NO: 155526 - DNA, 358 bp, Homo sapiens
tatttaagaagtgaatctggggagatatttgcacaaattgaattgtggcttgcttccagtggttgcaactatccgttgctttgattttggtgtatttagaaaaagaactggggaatgcagaaagggaaatgtgtcaggcttacaggagaaaattgtttctttagaaatgcaacaggcaggcacaccaccaaaagcatgttccataaaagaaaacaaataaatttgattttgtgaaacttaagaatgcagtgctctttgaaactctaaaatatacttaaataaattctcccctaggaagatttgtgggaactttttattggtggaaagtaggttggaacttctagtattaatagtaaaa

SEQ ID NO: 155527 - DNA, 718 bp, Homo sapiens
atccttcagagagaacaagtatacaaattcccttccaaacagccaaaatgcctattgcccctaggccccattcccatgcgtaacctaggaaatttatggaaacagctgaaatcttactaattttatgtgcttaaggaaatctgtatttgttctcagaggagttggcgtgatatggcaaagaaataccatcaaatttttgaaaattctcttagcaaagatgggaacagcataaatttagcctgggggaatatgctagacctgaataaaaaaaaggaaacagaataatctcacagtagtctgctttacacaatagtgtgctcatgaaatgctcagtaaataaatcagcttttgattattattaccatttcctcatatcaaagtaaaaaaattgggtggaagatgtgtgcgtacatagataatacctgtttttcagtcctgtggttaatttacagatcaattttaactttcaggtttgtaggaaaccatgcgagtggaggattataggaagggggtgtaaaagaattatttgcacaaacaattaaataaaattgcttacaagatctggtaaatgttaagatcgtgtaaaaatatatagccataaaatcaagtcttagtaacaaggagtacactctgcatgtgtggacgattaacatcacgatttaaaattctacagtgcctctgaattgccaaagaacaatcacatggggaaactatcgtt

SEQ ID NO: 155528 - DNA, 681 bp, Homo sapiens
ttcattcaatagaaatatagcttagatatacaatagaaaggtgactggggtccatagtacttccctgtgtattattgggtgtatacttggtttcttctaactttaaaaggaatatgagaaagatggagaaaatattttatatgtttcaatttgatctcaaattttggggagatttagtgttctctcagtttcattgactatttcttgaggttccagttgagtagtagcttcccaacaagatggactaacaggggtcagttttactttcctgcatgtagcaacaacagaaacagaaatcatatatgaaacaattgttttcaagtcatctgacattagggaatgaaggacaatgatccctgagagatgggaaacaaatgagacaagccctgcacttgccttagtttatcgtctttggagtttctaggctgtgttacagtaagggagaaagcaagtgaaacccagggaactccctcagttgaggagacagagctgagagtccagtaagaccaaagaagagcgggtgtcggcaaattaccatgtgcttttattgtaaataaagttttactggaacacagccacactgtttcatttttatcttgtctgtggccacttttaagctataatcactgagttgagtaacagtaactgagaccatatgacccacaaagcccaaaatattta

SEQ ID NO: 155529 - DNA, 168 bp, Homo sapiens
aaggatactgttgctttaccagaaaaagtgtgaatgttgataataatggaaccaaattcctaactgaccaagattgatgacaatcgagaggtcagatgtcttagtgagtctggtcacacaatgaagtctatctaaacctataagtctggctaatcatcagctctgtga

SEQ ID NO: 155530 - DNA, 197 bp, Homo sapiens
cagagccggggttgcagccaagccgtccgacttgccattcaagccttcaactgtctccaggctaaccctcccagagcgcctcaccccctttactttcctatccagcagccagtattgttaccagaagcctaggagtactcaggattttatgtactttaagttgacgtgtgtgtgtgtgtgtgtgtgtgtgtgtgtgt

SEQ ID NO: 155531 - DNA, 130 bp, Homo sapiens
taccaatctttacttttatgctgaatgggttttgtttgttttagaaaatacctggttatacagatcttcaatatttttgtgtagatctacggatttagcaagtctttgaagtcattagaatctatcatgg

SEQ ID NO: 155532 - DNA, 773 bp, Homo sapiens
atttcaaaatgatttcaaatagaaagatttcaaggaataagttatacaaagatctctcataccctttacccaaactcacctaccgttaatatttgtcctgttaacgttattatttgcacgttccctctttatatgtatatatagacatatatgcatgtacatgcatgtacattcacacacacatgtatttttttctgaacaattttagagtaagttgccttgtcatggtccattgccctatatcatatatttcttaataggggcattctcccacatgactatggtacagttaccatcttcggttaatagaacattgattcagtactttgatctaacctactaccacctgtattccagtttgtcaattggctcagtcatgcctttcatagcattttttccctccagtccaggatcaatctgtggtcaggtgtagcatttacttgtcatgctctttagtctttagatttgttgtttaaaattattgaaaccaggctgggcacgctggctcaggcctgtaatcccagcactttgggaggccgaggtgggcggtatcgcttgaggtcaagagttcaagaccagcctggccaacatgatgaagtcttgtctctaataaaaattcaaaaaaaattagcaggtgtggtggcgggcacctgtaatccgagctccttgggaggctgagacacgagaattgcttgaacctgggaggtggaggttgcagtgagctgagattgtgccactgcactccagctgggcgatagagctaaactcagtct

SEQ ID NO: 155533 - DNA, 219 bp, Homo sapiens
gtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaa

SEQ ID NO: 155534 - DNA, 267 bp, Homo sapiens
agatacacaaagaaacaagaagctgatgcctagtccagccacaggataaggcttttaaaggaaacaggaaacctgacaaaagtacgaatactgatctcagcacagcacagctctaggtagcagaggtaaagagaggagggaaagtaatccactttcagcattctgacatgatatcatgctactcaaatcattttcccaaacagtatacacagacattattttatttggtattaagacaaaaagctaaaggactgttttcctatggat

SEQ ID NO: 155535 - DNA, 225 bp, Homo sapiens
tgaggctcagaaaggtcctgggactcatctaacttcatgcagaaggtaaaccgccaggctgggattacatcccatgttgacctagtgccttcctcactatcatgctgcaaaaatgttacctcctaagagatctggatcaaagacctggattgaagtcatttctactgagatgaccaggcttttttttttttgccgaattgcccttttctggttggggggattcct

SEQ ID NO: 155536 - DNA, 315 bp, Homo sapiens
aaattggagactcccctcccgcctggcgtctcttcatccaaggttttctgagcatgactctgatttggagggttaatattaattaggagccagtttagacctcagttgcttgatgaggtagcttcaactgttgtcacgaatgtggctcctttttgcttgtgcctgcttttggtgaaagtttctgggtttaaaagccaaaggaagaaatatgcagagaaagatagaggaggggacaattactaaagaagtgcaaagcattctcttagaacttgagggaggaacaagaccagagtgcctgggtgggtgtgggttctg

SEQ ID NO: 155537 - DNA, 331 bp, Homo sapiens
ggtatttgagttgggtgatgtattttaggttggattcccaaggcacgggccctaaaaggaagagtccagtgcaagaggattaggaaggaagtgctcctaggaggctagtgagggtgtggacaaagcaagacaggcatggggtgaaaaccaagcaagggggccacgggagactccagtggaactctacacggtaagttctgccccgtgaaagcgtgaactgggctttcatgcttccatactggacagttatgggaggctggggacagccagggacattaattccagccactggctgctgtaggcaaagcagctacagcatttggaggaatct

SEQ ID NO: 155538 - DNA, 378 bp, Homo sapiens
ttacaggcacctgccaccatgaccaactaatttttgcatttttagtagagacggggtttcaccacattggccaggctggtctagaactcctgacctcaggtgatctgcccgcttcggcctcccaaagtgctaagaaacaggaatgagtcaccgtgcccctgccccttttacttagctttttagcaatgcaattataacctttaccttctctccaccaggcacagcaaggttatctaacaatgtgtttacttagaagttccacagaagaaaccttgaagcaaatcaggtctctggaactctcttccaccaggagattgcttcaatttacagcttacctctgcctgcgatggctccagccagaccacccagtagatacga

SEQ ID NO: 155539 - DNA, 122 bp, Homo sapiens
ccccctgtgtttttttctgtgagtctctgtgaggacatagggtttaggaaggtggggaggaatgctttctcctgggctgaaggaagtcacttgctgccagagacaggccagcctgatttgtc

SEQ ID NO: 155540 - DNA, 610 bp, Homo sapiens
caagtgattctcctgcctcagcctctcaagtagctggaattacaggtgtgcaccatcatgcccagctcattttttttttcttaaatttttactagagatggggtttcactctattggccaggctggtctcgaactcctggcctcaagtgatccacccacctcagcctcccaaaatgctgggattataggcatgagccaccatggcctgccttgcaaacatatcttttaactcacaatccgaaaggatatagacaaaaatatcagggaagggctttgattggtctcattcaggtcatgtgtctgtgcctgtagctggaggtcagagtactgcagttgagagccccatcagaatcccaaggaatgggaaggtgcatgtcctctacaaagcaggagagtcagttaccaaaataaggacacaaaagattctggttagacccaaataggacatcttccatagccagaatttcccttatcttcatgcttcaagtttattaaaacatgggattagagtggggcacagacatttactatcctagtttctccttggatgtgctcaaatttgtcaatatccctctccaaatgtgaccctctactctgaacataatctgct

SEQ ID NO: 155541 - DNA, 388 bp, Homo sapiens
gcctttctacatccttgagtacagctgcttatggaaaatcaaacctgctctggcagggttgtctcactggcagcaatggtggatgaggacgatcctgtcctcacaggctggctgcagcaactgccctggccagccccagagatgctgtccaagcttcctgtaaggtgaattgaggaggcagagtggaggtccttctgcagtcactacctacttttttcctttatctaccaggaagcaaagatcacatcctcccaagtccaccctgagattctaagaggacagatctgacaaagctctgaatcagctagtcctcaaagagagtccaacccttttaagcaattaagaattgggaggccaggagtgctggctcacacctgtaatcccagca

SEQ ID NO: 155542 - DNA, 220 bp, Homo sapiens
ttagtttagagatcactagtttgttataagagagatacaacatttacataatgaaatatttcagaacttcattatttcagaaataatgaaagaattatttccatgatgaaagatttcagtgggatgggcagcttcatattgatgccatttcaatgacgatttatttcagtctatatactttccaagaatgtctaaataagaaaaaatccttgttgctggg

SEQ ID NO: 155543 - DNA, 153 bp, Homo sapiens
taaagaggaagtcaaactgtccctgtttgctgacaatataactgtttaccttaggagtctgtaagactcctccagaaagctcctagaactgataaaataattctgcaaagtttccagatacaagattaatggacacaaatcagtagctcttct

SEQ ID NO: 155544 - DNA, 281 bp, Homo sapiens
aatctgctgagggatattgctgagcagtttgaagcttgtggtgaaaaaggaaatatctttgtgtaaaaactagaccaaagctttctgagaaacttttttatgatgggtgcattcatttcacagagctgaacctttcttttgattgaacagcttggaaatagtctttttctagaaccagcaaagggatacttgagggtgcactgagacctacggtgaaaaaggtagtatcttcacataaaaactagacagaaactttctgagaaacttctttgttatatgcg

SEQ ID NO: 155545 - DNA, 183 bp, Homo sapiens
gatccacccgcctcggcctcccaaagtgctgggattactggtgtgagccaaggtgcccggcctcatcagtttccatatgtgctggactgctcgatgtctctgcttggtagagacctcttatgtaagttacaggcatgagttgtctttgacccagagatgcgccagatgtgcctccaggtaccc

SEQ ID NO: 155546 - DNA, 609 bp, Homo sapiens
agaaactatcatggactcaatgtcatagactgaatgactgctgtgtgcaacatgcattgatgaatgctaaattcagagagccaaactttaaggagaaacaggttatttgtataagcacaaagctatcttcccaaaagtattgactaattactgtggtagttttaaggtatgcccataaattcgtgattctcctctctccaggaagtggagcttaattcccaatcccttgaatgtgggctgcacttagtgatttgtttctaacaaacagtacagaaaaggaaaaacagtcactttctagaggagaaacctgacagatatcactttaacctgaagtgatcgaggttaacctcaccaataaccaatcatgttgatgtcttgtgcctgctcacatgacacaagggcaaaggataccacctctgtgggtctttcccaaaatccataacctctgcttaatcaaaagaaaacatcggacaaatccaaaccaagaggcatactacaagacactacctgaataataatcttccaaagcgtcaaggttttattggggaatctaaggaaagggtatccacagattcttctgttatttgcaacttttctctaagtctgaaa

SEQ ID NO: 155547 - DNA, 388 bp, Homo sapiens
gactacaggcattatttgtgatcctcagtatagcgagaagctctgggctaggaggactgacagaaaagcaaaaattagagggctcatattctaagtaattttaccttattcttctaaatgcaaaatcttcatttaaacaattttttttcattttctgtttgcttttgctatttcaaaattaaggccaacttaaaatatatgcatgcctacttagaataaccacaagcaagcatttgcttgttggcttttacagaatcctatgtccaggaaagaaactatttcctacatgcattattgaaagactaatcatttattagaccgaaagtcattaactctaattgtttcaagatttacttgcatttatgattctttcctgttatagatgcct

SEQ ID NO: 155548 - DNA, 450 bp, Homo sapiens
caacggctcagtggtgtgtgtctttcttagtctgatacttgaacttctcctttagtcataatctgcttacagatttcgtttttcatttgtttgtttctttcatgtcttttactgtgttttctgcaacgtctcttctttgttctcctatcagtttcttcttcatttctgtgatggctttgtttattcttctattttttttttttgtttagttctaccaattcatgcttccctattcctgttatctagacatttctcccttgagttcttgtatttcttgtttgtggtcttgttcttagtgatgatggcttcactgattttcttaaaatcaagcaaaattattcagttataatttttgtcttctccattgtaatttttttttagtgtactctgacagttggtacattatctatcatttttcttaaagtatctctcagtcagtaccatgccagt

SEQ ID NO: 155549 - DNA, 628 bp, Homo sapiens
tttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgctgctatggaggcaggggctgcagaaggagtcggcgtatggagtctcgaacccgaggatttgtctgccgtcacgatggagcggtttgaacctcagattaatgctgaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaaatcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctata

SEQ ID NO: 155550 - DNA, 541 bp, Homo sapiens
tttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgctgctatggaggcaggggctgcagaaggagtcggcgtatggagtctcgaacccgaggatttgtctgccgtcacgatggagcggtttgaacctcagattaatgctgaggaaagtgaaattcgttattctacatggaagaaagctgtgatgaagtcaatgggttgggttacaactcaatctccagaaagtggtattccataaaacctaccaaatcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctata

SEQ ID NO: 155551 - DNA, 844 bp, Homo sapiens
aatactgtcattacagtatttagatagattagaaaaggtgtcagtttctagtaacttcagaataataaaacagacatggtgatatgaaatactgatattttatacttttaaattaatttattcttaattattcccgcatttacagtagactttcccaatgctaacagaaaaatccattcaaaaaccaacagagtgagagacaaatgattctgttttagttttggctttgaaaactactacaaaatccaataatagtttcattcattagtgtttaaagacagctaaagaaatgccaaatatcatatcatcaactaagatggatatcattataccatcaactctatttaactacacatccttccaattgttcccaaagtccacacttccactatcctcaccacagcccactatgttgtgagagattgtccaaatgagcacctgaacaaaataaacaagctttggattgcctaattcaggtgtcactggggaataaacttccaagtgaattgtatttaatgatggatggtccaacgtaacctcatttccaagttcttaaatttgtcccttctcttcccaaacttgccagctggcagtcttggaaaatttttccacagtctcctttttctgacagcatgattggaaacgcaggcccttttcctttccgcacatatgggctaagtcaggttgaagaccctgcctgtaacagaggttatggagatctgggtggatcccacagatacctcttgcaggagatatttacaagaagttccctgaatctctttccattgtgattttgcattccttagcttatatcctttatattttatgttttcatttgtaaaga

SEQ ID NO: 155552 - DNA, 711 bp, Homo sapiens
gagtttgagaccagactggacaacatagtgagaccccatcattacaaaaaagttagccaggtggagtgctgcacacctgtagtcccaagctactcagaaggctgaagtaagaggatcacctgagcccaggagcttgagactgcagtgagccatgttcatgctactgcactccagcctgagtaacaaagtgagatcctgtgtcaaaaaaaaatgtatatatatagatacacatatttataagcgtatatatatatatataaaactgaaagtaagaattcaatatatcaatttgatgaattgaaagtatgaagagacaaaacaatagaaaagatggaagagaagataagaggcagagatacagtgacaagatctattaaagtgtaatttgagtcccagaaggagagaagagtgcagaatattttaataaacaatgactgagaattttccaaaacaaaagacatcaatccacagattatataaactctactaaaccccaagcataataaatgcaaagaaaattctctacctagacccattacagtgaattgtggggggaaaaaaaagaacatattaaaaacagattaatttcaaagatgcaacaaatatgccattgactgatttctctgcagaaataatgaaatctggaagacatatattctacgtgtgaaaagcaaattactgtcaaaacttctcttaaaaaataaagtcaac

SEQ ID NO: 155553 - DNA, 416 bp, Homo sapiens
ggtcacagtgaagggtctcagacgagccctcggggggctggcgctggtgcctaaactcactgagctaaataattacagcaaggctggggcctggaggaattcacccaggtctgctgctgttgacccttcttgcttcattttatttcttcttccaccctcctttcctctcttctttccctctctattcttgtctgctttcagtttcgtatgaactccattcagctgtgcttggttctgcaattctttgtctctccatttctttcttcccctcctctccctccctcttctctctccttctgtgtgtctctcttcccctcacttcacctctctacctctcccccgttgtctcctccccattctttccctctgtgtgtctctctcccctcactccacctctctctctctgcctctccccc

SEQ ID NO: 155554 - DNA, 536 bp, Homo sapiens
tcgacgttgtcgcttaataagcaaagaaggctggggctgggcacagaggctgatgcctgtaagcccagcactttgtgaggccaagttacaaaaaatatgtagggaaacactaagtttataaactaaaatttggctcttaacctacaattatttcactatcatgaaacattgctgttaaagtgcaaaataatgaaccatgatcatctacgctgcaactaacgagtctgtctgacaccattcagttctgagataggcatccagatccccagggagctggtgaaacttgcagcacctttgagcttcctaccaaccaatacttataagaatcgccaaggacagcctgggcaacatagtgagaccgtgtctctacaaaattaaaaagtaaattagccagacatggtgacacgcacctgtgatcctagctcgggaggctgacgcaggaggatggcttgagcttagggagtggaggctgtagtgagccatgaccgcaccactgcactccaacctgggtgacagagtgagactctgtctctaga

SEQ ID NO: 155555 - DNA, 173 bp, Homo sapiens
ccatagaagagcaagagggagaagcaacctggacctcaggacgacctctatcttccctcgactgtctgcctctaggtaaaagagaaagagacttctatcttattgtattttggggtctctttgtttatagtggcttagcctatactccaaaacaccaacgatttctcttaact

SEQ ID NO: 155556 - DNA, 149 bp, Homo sapiens
tcctgcaagcagtgtggggatgtgtactggaaaatgccataattaatggggcaatgctcagagtacacaaaagggtccagtggtgggaataattaccatcttaccaaaaagaatcaaactgctttcaagtaacataactgagttacaga

SEQ ID NO: 155557 - DNA, 750 bp, Homo sapiens
ttacatttcttctttgttcttgaaggaaagttttacattatataaaattttgggtttactgtttttctttgagtgttttaaatacatcatcccactgcctgctggcctctgtcgtttctgatggactgttaatctgagtatccctttttcatgatgaattggttttttgtttgttttttctgttctcaaaattttctttctctttggctttaatagtttggctgtgtgtcttggtgtgggtctctttgagagtatcgtatgtggacttctttgagcttcttggatttgtagattcatgttttttctcaaatttctaaaggtttttggccatgatttcttcaagtgttctctttgttctcttttcttttctggcagttttataatgcatatggtgatccacttgatagtgtcccttgggtcccttgtgctttatttatttttcttcatcgttttttctttgtgctcctcacacttgatgtcatttgtcctattttcaagttcactgtttcttgtgcctgttcaaatctgctgttgaggccccccatttctagggaactttatatttcagttatacttttcaggtccagagtatctgtttggttcatttataatctccttattgatattctcattttgttcataaatcattttcctgatttctattagctacttgcctatattttctttagccctttgaacatatttaagatagttgttttaaagtatttgtctaggaatatacattattac

SEQ ID NO: 155558 - DNA, 127 bp, Homo sapiens
aagacaactaaaattcagccacataaaccaccaaaatgtattcaaagtccccctccaccaaacccaacccaaaccaaacacacaaactttaacccacctattccatatagaggaatgtctcctcagg

SEQ ID NO: 155559 - DNA, 424 bp, Homo sapiens
aatggaaaagaaattaacccagacaaatcactaaactccaaataaccaaagacatcaaaaaatgtttcatctcaagatttgttttaaaaagtgtgatttaaaccaagatgctatttttctgcctatcaaggtcacaacttttttatgatcataattgctaggtagaatgcagtgaaattggtagcactcttatttgctgaaggtgggactataaattgatagagtctttctgtgaaataaatattgactctatttgacccagtatactcacttcaagacgaattcaatttttaggaaatggttagaaatatggtcaaagatttacatgcaaatgagcttaaaaagcactatgataatagcacaaggttggagcaacctacatctccagtattatggatatagttaaataaaatatactataaag

SEQ ID NO: 155560 - DNA, 219 bp, Homo sapiens
cactacaaaaggcactgcgaatacagtgtctgtgccaggcattgtctgaactcacctaaacaaagtataaatagaagcaaaccttttcaatgtaagaacgataatagctaccatttcctttgaggggcatactgtaatttcactttatctcacatacagaattagaataagtttattggcctgtctgggaaaagaaacctgatgtcaggagttggagac

SEQ ID NO: 155561 - DNA, 604 bp, Homo sapiens
tccatccaccactagtcctgcctccctcgtttgccaatgtctcacctaaactgtggttcagagacttaaacacaattcatcaacggtgctctaactaacccacaaaacaggacaacagactcgatgtaatctaggcacccatcagtgcaacctgagcttgctgtttttagcagccacatcacagagatgcctcacataagcctgtgcctcaataaactctgagctacttttcatctcgtgcacttgagaccgtccaccaccccccaagcatttctcaactcctgcagatcatttatccttagtatctcatgttgctgattttagaacattattacaacctattcagatcattctgaaactagaatctgctatctatagtattagtcatctctcctaattttatgtgacctggaaattagataaacttactttgatccaggtctttacagaaagaggatactgtgatttaaaatgtgctattcaggctgggcgaggtggctcatgcctgtaatcccagcactttgggagggtgaggtgggaggatcacctgaacctgggaagttgaggccgcagtgggccgtgttcgtgccactgcactccagcc

SEQ ID NO: 155562 - DNA, 213 bp, Homo sapiens
ttagtattagcttactttcccatgtgtgccaatctggtgggctgaaaagttatttgattgtggttttgatgtgcatttccctgttctttaatgaggctgtgcatcttttcatatactcatgggtcactcatgattcctctcctataaggtgccaatttgagtcttttaccgatcgtcccttatggttaccttcttcttgactcatcccagcag

SEQ ID NO: 155563 - DNA, 369 bp, Homo sapiens
ccagtcttcgtcccatcagtgtgaaccaacgaggatggttggtcacccaaccttgtttgcaggctacaaattcaaccagctgccctgttacttactgctaccaggttgccaagatcctgccagaaggctaagtggggaaactgctccattcctttggctcccactaccagtcgctggtataggaaccccccaacaacataaacagcaaccagtgatgcaaacctgatgggagaagatgcgcccatcaggaagaacagtacaatcgattcatgaaattggttggtggcaagaggagatcaagaagtaaatcttcagatcctgacctgaggcgatccttagataagcaacctactgatagtggaggaggca

SEQ ID NO: 155564 - DNA, 363 bp, Homo sapiens
tgcaggatgctgagagcagtgtcccttcaatattgtgccccaggaacctcaccttggccctggccctgctgttaagttcatgcctgtaggccaagttctacttctgctcctgagtggcttctgaccccgactggaagtactgcacataaattctgccccctcagtccccatctggtgatgcttgggaagtaagtcatcacccaacaggctcttgcttaaggcagctggcaactgcaaaccctaagagcagctgcggtcatagatttgaactggtgcatagtcaagttattgttagccctgatatcctcattggtaactttcctcatgaccaggactgttccctgctagtagccccactgcttt

SEQ ID NO: 155565 - DNA, 116 bp, Homo sapiens
ccgcggctatgagaataggaaaaaaaaaatcttctgtaaatcaagatataattagaacttatactcagattttcctttaaaggaaaacaaatcttcaaatgtcttctaaatgagag

SEQ ID NO: 155566 - DNA, 648 bp, Homo sapiens
caacattttcagagccaagactccatgacgagttaggcagagcacacttcagatttttagacatctctaacgtgcaaaatatagtgctactaacatataattcctcctctcaagaaatctagtttcaataatggcaacgaatggggtagattccttcctcttcagctgtctcccaaggtctcaccagtcaataccctaaacatattcaccctcttaaattttcattagccctcctggggtggctgggcccacagtagtaaagcatataaagagagggcagaaagaggacggcaaataaagaacctatgacattatgtgttgtcattggaagagaggccgcattaggtggccctcttttttaatcagcactcaaggagtgttgggcccaagcccacactccacatgtctccttgactggccactgttgggggtctctgtggacaaaaggaggcatcagagctgatgaaagtcagctgaggtcagtggttcccatagtgtgtccctgaaccagcagcagcatcaccagggagctggctacaaatgcaaattctcaagctcaccccccgatctactggatcaggaaccctgaggacagggccaatcatctgcccatcccctccagggattctgatgcactctaaagggtgg

SEQ ID NO: 155567 - DNA, 633 bp, Homo sapiens
ctctcgcatgccctgaggggtgaagcgcgtccagtcagagtaagaggtggaatctaccccacaattcggaggaggtttgacttggagccgcagtggcagccatcctgggaccccaaggggggcagggagggaggtgctgagtgcgatgcaaccctcggaacaaaggggctgcaacttgggcagagacaaagtccaagtaacatgcaccttgatcggaccactcctgaagcctttatctcagagctttcacctgggagctgatagatggtcctcacttcttaatgtggtgctgggcctcaggcctggatggacacggttctgtcttggaggctgcacatggcagccccttgtggcattcctgggcacaggcccagcccacagcaccacgtcaacatcagccctggccccccaacaacccttggagagcaaccgtgtggggcccgggcccgggccctgggaggggctgctgcaggggattcagtgctgttggtcaggggccgtcctccacatgggtccagagagcaggtttctggtaaagaccagcagggcgtcatctttaggttactccgactccctcccagccctaatcttagggacctcaaagatggggtgctcatgcctcccatgtaggac

SEQ ID NO: 155568 - DNA, 412 bp, Homo sapiens
taccaaatctttgaccatgccttctatctgttcctgggccacattgacatcctctgtagggccctccagggtgatcttgtcttcgccctctgtgaactcgatgtgaacctttggcatctgctgagtgattttggaggctctgagttgggcatgggcggtcatctctcgatgacatcccacatgtccgggcacagacacccagggcatcctagctgggtgagtaataggttctgaaacaaccagaagctggtcgaagtcctggaataatcgtgggtggaggaaacttcatcttgaagaaggcatctttcaggggagatgcaggggcagtctccaacaattcctgacagctgagtggtcagaaaaggcaaccgtggagactgctgggttttggttcagctcattggccaagtaa

SEQ ID NO: 155569 - DNA, 565 bp, Homo sapiens
cttaattgataatcagatacagacatatacttgatcagatattttataaattctgatttttgatgacaaacattttcaggaaatatcattttgacaaggaaaaatatcaaaatgaggtgctatagaagtctttatgaagaattatacacacatgtgagaaactggtgaatttgaaaaactaacaaaaacccatttaaagatctccattactgttcaacaaaattaaagcaaatcttatgtaaatataaaatgattcataaggaagctgtgaactataattagatggaaatattctgattgatattttggacacaactaattctcactttgccattagataacatagactaagatgtcatgaaatctgcatctgttcctagaagcactattaagaaaagagataaaggaaatgtctgctttataagtttatagcaactttgcacatatctaaaatgttacaattcagattcaagaaataagtgaaaggataaaaaggattcaagagcagccagtttatgaattgcatggactttacatgtgaaagagcttcctagtgtactcctat

SEQ ID NO: 155570 - DNA, 129 bp, Homo sapiens
aacgaacccaccaacagtcatgaataatttactggccgaattaacatcttcacagcttctatagttaactaaatgtttttcaattaaattaacacttactgaagaacttaaaggtattggtcaggcagt

SEQ ID NO: 155571 - DNA, 408 bp, Homo sapiens
  misc_feature (5)..(5): n is a, c, g, or t
ccttncctagtcaagatcctaggaaaagtagtctctcacctcctactcctggctccaaatagcctcaaaacatggcttctgtctccctccctcaattaaaactgttctcaccagagtcatcaatgacttcctacttcccaaatccatcagcacattccagctctaacagtcttccacccttcctggcagaaatgctgccgccctgctcttctgcctcccactctccacccatgcagacattactaaaccattactgctgtttcccacggagcctgtgggatcctcagaatcttctcaaggcagtgcactggaaggctgacaggaactggggcaaaatgtaagggttaggggaagagactgcatggagagactgagcagagaagcaggagtggagtccgcatttctgcc

SEQ ID NO: 155572 - DNA, 449 bp, Homo sapiens
attcccttctatccccctccccagagaatggagaaagggggtgcgaaagacttcaattcggtttgactggagaaaaacacagaggtggcgtaggatccacacatcccttgggggcagacccagcggcggacgcctggacaggcggcgggaaaggcgctgcgacgccccgggtgccccctccttcgacgccactggcatcacctccgaaagcagcaggcacgaaggtgccctgccacgggggctggacgcagtggaggcaggctcatcaagcacgaccagagctcagtcggccacacgtcctcctcaatgtcactgtctccctgctctcccaccccgcgccgctgcacctccctccccccggcaacctgggcgggagtcccaagcgtccgccccagagcggactcacagcccccgcgctccctcccgcgctgcgcccaccgcgcggccgc

SEQ ID NO: 155573 - DNA, 265 bp, Homo sapiens
gtgaggaatgagagggaattgaagggaacaggtaagaggtcaaaggtcacatctgaggtcaggacccaaggttaggggcagggggtaggaggtcacacttggggggatcaaaggtcacaccttgaggtcaagcaagattcagggttggaagtacaggtcacactgtgaggtcagggttggggtagagatcagagaagtcaccattctggggtaaaggatgaaacactgaggtcagaggtcacattatagagtcagggttgcctga

SEQ ID NO: 155574 - DNA, 455 bp, Homo sapiens
cagcactgggggtgggaaggagccaggaggaggcatgcctggtggaggaagcccagaccccaatgatgataccacaggattgggggcagagggtgaaggaggtgcatctgcaaacagctgatgagggcggtcaggctgggagagcgggttctgagctgccagaagtcgtccagctgctaagccatggcgctcacccttggagtccttctcgaaggcataagatacggtgatagggtggttacagaggtactgcccattcatggcttcaattgctgcaactgaagcatcaaatgaagcaaaattaataaaggcataacctttggagttgcctgtgtcagggtcccacataatcttgggggtttgtaagatgaccccaaaggcgctgaaagtatcataaagcaacttctcatcaatctcagggtccaggttcccattgaaaatgttggcccctacat

SEQ ID NO: 155575 - DNA, 399 bp, Homo sapiens
catatagcgaattgctaatatttattgggggtgtactgagagtgtttgtttatgttcattaactcatttatggtctcaatcctcacaattcctggcacctgtcttcatttcacagagaagcttgagacttacaagaggttaagttacttgcctgtagttaaacattaacctcacagccccatatctgcaattccaaacacccagagctctggaaaccacaatttgattgatcccttttcttttaagattggtgcagatttatttggcagaaaaacctgatgaagcttttaaaaatcatttttgttcggctgggcacggtgactcatgcctttaatcccggcactgtgggaggctgaggcaggcggatcacaaggtcaggagttcaagaccagcctggcc

SEQ ID NO: 155576 - DNA, 441 bp, Homo sapiens
  misc_feature (312)..(312): n is a, c, g, or t
  misc_feature (373)..(373): n is a, c, g, or t
gacagggtgtggatatacaggctgggagggtctgtgggcagcagccgaggcccaggttgggggagcctcacctaggatgaggctagggctggcagaagatccccacagaggagccaggaggaccccacagtcactctagctcccagggcctggaggtgcaggcgagccccgtggtctccgggcagccggccctgccccactcacatccgtactggcccgcgggccagtaatcatacactaagattaataaacagcacttcaaaattaaccgcataagggctgtgcttgcagcaaggtttcacaagacaaggnacccagattttttcttcccacgtctagcttgcagagcagctcccgtagccatttcaaaaanctctctcactccatctttggtctttgctgaacactccatgtacccaaaagcgccaatcctgtttgcca

SEQ ID NO: 155577 - DNA, 424 bp, Homo sapiens
gcacgcatgttgctcgtgtccccctcctctgttttcacagtcccattctcgggcaggtcactgttcagcagttgcagggtgtgcggccagatgggtatttgcggagggggagctggaaagcatcctgggctgggccggggagagactcaggcctgggcagccttgctaagtctcccctctctccctgtgtctccctgtttcccgccactccaatggatcctgttcttctcgcttccccggcctggggtcccaccaccctgtctccccggaaccccatgtcctgtgttctcactgacacctcttctcctttccctcctgctgcttccccctactacctgcccttcccaacccattctgaatgctccctccttgcccctgtgccctctgtgttgactctgctgatcccctcgtggccctccacgtc

SEQ ID NO: 155578 - DNA, 945 bp, Homo sapiens
atctgcctcctgtgccagctttcaggcagtactttcatgagagaaggtgcagaggtggattctgggattagcaggtgattgttggaaggaaaggggaggtctggaaggtccttgggcacgcacagttatctgtccgtgccagctcgtgggtcctgggtgtgaatcctggggaagtctgtatgaagcgcggtggaagttcagttggcatcagccagctggttctgcacagactctgctggctcatgtgggttccagccggtttcagccagttttgttcttgtcggcgtttcagctgcctgtttcttttcacgtttgccatcctgcaaactcgaatgtttgtggattttggtgtctaactctttggggtgccgttccatttgtcgggcctgaggggtctcccgtgcaggtggcttgagtcccatgtggccaggtgacaccgtcatgcgggtggctagcgtgttgggtgacagtctccagggctgtccgctgctgctgccccgggacctgtttccctttgtggtccgtcatttctcaggagacgccttgcgatggtcttagttccttttcttctgcttacaacagaaaacctaaggccatgtagtttataagaaaaggaattaacttgtcacagctctggaggctgagaagtcccaggtcgaggggccatatctggccagggccttcttcctggtggggactctggagccctgaggcggccagggtgtcacatggcaaggggagggggctaagcgagccggttccacccaggtctctcctcctcacaaagccccaggccctctgccacattaacccatctgtcccttcatccatgaatccatgaatggattcatccattcctgaaggcagaggccacatgacccagctgcctcttgaaggccccagtacctaatcctgccatctcccaataccaccatctccaacacc

SEQ ID NO: 155579 - DNA, 444 bp, Homo sapiens
ctaggccttttagaaaacatggagttgttcctttggccacgtatatgcgaatctataagaaaggtgatattgtagacatcaagggaatgggtactgttcaaaaaggaatgccccacaagtgttaccatggcaaaactggaagagtctacaatgttacccagcatgctgttggtattgtaaacaaacaagttaagggcaagattcttgccaagagaattaatgtgcatattgagcacattaagcactctgagccgagatagcttcctgaaatgtgtgaaggaaaatgatcagaaaaagaaagaagccaaagagaaaggtacctgggttcaactgaagtgccagcctgctccacccagagaagcacactttgtgagaaccaatgggaaggagcctgaactgctggaacctattccctatgaattcatggcataataggtgtttaaa

SEQ ID NO: 155580 - DNA, 488 bp, Homo sapiens
tcgactcctagtagtatcccactgcactccactaaaccatctccaaatgcgatccatcctttagagagatttgttggtgactcatgcgcgatttacatagacctcgaacagaatgctgttcttgctttgtaccgtccgtagcttccacaactcctgacttggaaaaccccttcggaacggtaaaatcctagagggcagagcctaggtgtgtaatccttcctttgaaattccctattgtattacatctggtgttcatggatgcagaacttgtcaaaactcacaatgagctgagggagtacaactggattatctaagttcagaaatgagaagtgctgattgttttggcttctacccagaatttagtagttacacagctaaagagtttctatttttaaaggttagatcatatggatatttcacaacatgctctagagtttaattactaagaaaatgactggatagggaagcttctttcaacgataggaaca

SEQ ID NO: 155581 - DNA, 950 bp, Homo sapiens
gagggaagagctatactgaggagagacggctctacttgatgtgcagagatacatcgggcagcttgagttgatctccagcttctctccagcagcactttccactagctgcccaacagcctcagtgcttaagacgaaaccaatctttcctctatttgtatttcctcctctattgccaattcctcttcaacagagtttcaaatgaaaatctcaggcacctttcgaacccacctcccatagcgaacctatcgctcactcccagggaggctccctcgtgcagcctcctgccctcactcggacccggcagtgtctctggtgcagatgcctgccgcttgcctcttccggaacaatgctcaaagttttctggtgctcagaaacctccaacccacccttcccactgcctgtgcgacaagcttcagacacctcactctggctctgcccactctcctttctacagtattccaaacctatcactctaactgcctacccttccttccttctctcccacatgaagtaggacctgcctgcctctgccttggtcatgccctaggatcaagcaaaatttatgagaattgcaaagttgtgatgttgggagaagttgccagagtattttctcacttttgtctcaactcccttgtaagacggtaaaatcctagagggcagagcctaggtgtgtaatccttcctttgaaattccctattgtattacatctggtgttcatggatgcagaacttgtcaaaactcacaatgagctgagggagtacaactggattatctaagttcagaaatgagaagtgctgattgttttggcttctacccagaatttagtagttacacagctaaagagtttctatttttaaaggttagatcatatggatatttcacaacatgctctagagtttaattactaagaaaatgactggatagggaagcttctttcaacgataggaaca

SEQ ID NO: 155582 - DNA, 427 bp, Homo sapiens
tacttaaactccagtctatatcactagtattgactataaagagcaagtgaaatatggatcgctcatgcctcacgcatgcgtcagtcactacccttgctatcaattgtatttctcattagcccgagtcctaagattgaatcccgaggctcagctgccacacctcatcagtccgttccgagctcccaggtcttgctcgtggttcctgatgttctcctgtgttaaatttttcttccactaaatctttctcaatcagtgaacataatggctcaggaactccaataagtaagaaactgccacaagcaaaacaaaaatggagtaagctatgaagagaaggcaaccaaacaatcacgattctcttcccgcaataaggtctagaaacaaaaataacaaaaagcctgggaagagcatcccaaataacaggcatgag

SEQ ID NO: 155583 - DNA, 278 bp, Homo sapiens
  misc_feature (113)..(113): n is a, c, g, or t
aacgatggtctcagctagagtcgctgggatacaggtgcctaccaccacgcccgactaattttgcattttggtagagatggggtttctccatgttggctaggctggtatcgaancttatgacctcaggtgatctgtccacctcggcctcccaaagtgctgggattccacgcatgagccatctgcacccggccatatgaaaagctaaaattccttagtgtggccaccaagaccctccatggtctgctacctcagctgaaccctcctcccccgtgacctac

SEQ ID NO: 155584 - DNA, 473 bp, Homo sapiens
gccgccttcttctcaaaaccttaaacttcaccaattctctgcttgctcccaacagtttcaaagcaatgagtgtcctgcttctccatttctttgtattttatattgcttgtatactgtcaaatagtttccctctttaccagcaaatttccactgaccaacaaacacactcggttctctcctgaagttaaagaaccaaacaagcaaaccaaaataaaaatacttgcttgaatcctcaagctgccatttctcttccatgtccatcctttcactccggctcctcactcctggtcacgatcttgcttccagaaagtaccacactctcacaccacctgtgtagtacccgatagtagtaccacactgtcacactctcatgccacctgtattccaaaaacacaaactcctatcacatctgtttcctgcccaagggctcttgggcagcctccacagtggttagaatcaatctccaggatgtg

SEQ ID NO: 155585 - DNA, 175 bp, Homo sapiens
tctggcgccctcacacaaaccgtgtttacagtagcctgtggcttggcccctctaactcggacccgggctttaccctccctcccctagggagggtcggcttggtccccaccccccagggaccttagcaccaagtcagcccccttaggatttagcatgtcccagactccctgaaaag

SEQ ID NO: 155586 - DNA, 409 bp, Homo sapiens
gaaaagactttataaactgcataacatcttctgctctttcccaggtcttcgggatataattcaatttcatgatgcaattaagaaagaagtctaaaccaaaggacacttaccgcactgcagcaacatgtggctatttatctagcgtgatttcacagagaatttttaggtcatccagggtttctgtgcctgtagtttttcatctctcaaaatgggattcctgactcatagtgtggggcgaggctgaaaatgcatggtatatatggaaatgctttctaactggaaggtgactaaggacacaggtactgtggtgtggtcctcagagcaaatcctttgtgcttctttcttttttattatactttaagttctggggtacatgtgcagaacgtccagtttttgttacataggtatg

SEQ ID NO: 155587 - DNA, 305 bp, Homo sapiens
agaccaaagaaggaaaaccatgtgaaacatcttttcattttctatcactatcagcactgtcaacggtgaaataccctcctagcaacttgttttaggaattcccagtttcacgaaagatgtttacttttattttcctactagttaggttttcttgattttttttctgtgcttagcaacaaattaaatcaagaatacattttacactgaatatgtagatagggacaatgtaactaacatgtagattactataactaccttaaaaaacaagcagtttttttttttttccttttttttctaataacttg

SEQ ID NO: 155588 - DNA, 546 bp, Homo sapiens
tccttagtggtagcttttgtatccccaggagctgggccagcctggcacaaaacgggtgttcagtgaggttttgagctaatgaatgtttgcattactggtttttctgctttccaaaatgccacatgcatgtctattctaatgatcaggcgaatgtacgcaaatggcctctggatccaatccactaagatggcccagactcacgtgaattcacaataagaagaagttcacagaaatcccaataaccaagctatttaaatatcaaagcaagttctgccccatccaatacattttgaaaagaaataatattggaagggcaagatacaaatctgaacaattctcagaagaatcaagtacttcttctatcagatgagtgaacggcttccaaatttatctcaaattttcaaacaaaccaagaccttgtctagcagaggcactgcaatgaagtgcggccattctatagaccagggtgcattggtcttaatttcttaacaagacacggccaatccgtagctgcgctcttaaatgtaaggagtaacggaacggtcg

SEQ ID NO: 155589 - DNA, 511 bp, Homo sapiens
ggctaacctggcaaaaaagaaatttactaagaataaaaattgaaaaaccagacctccaaaagtttgagaactaaggtagccctgagtatctacctgaattgacattggaatgattccattctaaccattaggtcacttctctgaagatttttatttctgacagagttgtgtatagtttgagtcatatacccattccttaggcctgagggctggaagagggaattggtcttcagggactgtcccaccacttattagaatttacttatacatttatgtatattgcttgtgaaatgacatgtacaagatcattcattcattgcagcatggtaatagcaagttgtctaccagtatcttaagtaaacaaaaagtatagactgtggatatagtatgtgtacataaagtttacacattagatttttaataaatatgtggcgtatttattgttttgaagactttggcttgaccatcttcatttacccagtctttatgccccttttatgtatacttggta

SEQ ID NO: 155590 - DNA, 440 bp, Homo sapiens
cacgggctctcaggaacctgctcctcacggtactgaacactccccgagcccctgccagctgaaggtaccacacaaagtgagaattagtcagaaccactggcccgacgcgcattttaacaaccggaaaagaagagctgcctcacgggaggctccactccttggtcttcagctgtcaagtttcttacatgacagaaaaaacgtctgttacggatctgtggaggcaaagttgacctacaagctgggcaatggaaggagaggcccaccaaggccactgtgggcaccagcgggcccgccccaccctgcgtcctgagcttggggtatggccaggagccctccctggggccagtctggcctcctgactctgagtcttcgcctgacccgcccgcccctctcacccgcgcggctgaggcaggatcccagaccacccgccctcacctctt

SEQ ID NO: 155591 - DNA, 520 bp, Homo sapiens
aaaaaataaaaacaactgaggcttcaggagtcatagaaattttgaaccagaagttagtttaggaaacattcaagggaaatccatcattttatgccagagaatccaaagcttgaagagaggcagtgacttggcccaggacacttgaaagcttgagaggcaggccagtctcagctcagctccttgttcccttctgcaactgccacaagtggagacagctgttcttccccagccaatcatacatatcccttgtgaatgcactaggggaccccaaaccaggtgtcctcctctggcctggcccatgctgctgtaggacctgtaggagctgggcgctggtccacttgctgctctccacccctgaccttgtcaggccaacagagtcaaacagtaacccagtattgaactgggacttggttaatcaaaagctggggagatagcagatatgagaggagggaataagttggcaatggggtagactagaatgctgtcgtagaaatcaggattcctgatttctgcttcatat

SEQ ID NO: 155592 - DNA, 625 bp, Homo sapiens
atgatttctatgagtcctttcagcaaatcactgaacccgagagacaaactagattcttcccattggtatctaggattcaaccagccttattatctgactccttggtcatgaccagtctctgttcagacacctaatatctatcgaaccccttaagttaaatcagcctccagatttcagcagaaataaatgcacagaaaaaataagcccatataatttgctgtagaatgtaaaaagcaacttttgatatttaggccaattacagtaataaacattaaataaaagagactgaccaactgcaaactggactattttcaaacttgtggccaatgactatcctctaggtaagagatgaaggtgcctcacaaattcaactgtataagatgtatgtgcccagcagggtcgtgcctgaagtagccatcctgcctttctaacctatcttgtcccatctatcacctcacaacattggccactaatgctgcatcctcagtagagatgggatcgtgacctacccaaacattcattataaaggtgtaagaatcaaagaagcatgttgtcagctctgcttttggcaataaaggaaaggtttttctcaggttttcctcttcacatggttttgggctgacag

SEQ ID NO: 155593 - DNA, 439 bp, Homo sapiens
aatgtagatgacgggttgatgggtacagcaaaccaccatggcacatgtatacctgtgtaacaaacctgcacattctgcacatgtatcccagaacttaaagtataattaaaaaaaaaaagataaacgagcaatcattcctaacatgtttcagtaagcaactataattctaatttcagaatcatcagaaaaaaagttctaaactggtacctttaaaggctcccttccccagaaaatgacggttttatttcatcaaattatttctttcttattttattttattttattttttcgctttttgtctcccaggctggagtgcagtggtgtgatctcggctcactgcaacctccgcctcccgggttcaagcgattctcctgcctcagccttccgagtagctgggattacaggtgcctgccactacgcttggctaatttttgtattt

SEQ ID NO: 155594 - DNA, 470 bp, Homo sapiens
tcacctgagggcaattagggagctgttgggggacacaccactttccctgcctggcctgagagtccctctagcttgattggcaacaaccaaaccaccagaagggcccactgtggggtaggacggaggggagatccagtttggaagtcattaaagttgtgattttcatctttggctccaatcttgggggaaaacatccatgtttcagacactcctggtgggcaggagaaattcgacttcctggttctcagaataaatgctggttcggggcaatagttgtatcaacaggacattctggagttggccatcagagcagcaccaatcaattacccaataacaagatgataacgcatggccccccactctcttctaaaggttactccctaataggatcagatagctgggggccaacaggaagttaaggggccttgggtgtcatttaccccatgttaaggctctttctgaacacacag

SEQ ID NO: 155595 - DNA, 374 bp, Homo sapiens
cgccgaccccctctaccaagtcctgctgatgttgattggaccaaagtgatggagaatctagtttggagtccggtaatcctggggaggcgcgagcatcactgcagctcaactgtcattcctgccttgcagctcatttaactgcctctggcagcactatttctggctgggccatctatttttggtggccagggaagttgttatttgtttcgttttgttttgatgtgttttacagtgctctagtgtgatgatgaagataacatctggttattccaggattggagggggtttgtgggtgaacccacaaaccccctcccggcggcatccggtgagctctcgctggcccttgaaaatccgggggagagggtgtaaatctc

SEQ ID NO: 155596 - DNA, 418 bp, Homo sapiens
aagctaattttttgtacttttagtagagacagggtttcgccgtgttagccaggatggtctcgatctcctgacctcgtgatccacccgcctcggcctcccaaagtgctggaattacaggcgtgggccactgtgcccggccatgttttttttaatatcagatagaagtgttggtctctgctgaatcctttgaggtacagctgccaaacagcggaagtacacttattctggggaataaagttgaacaaaattaagtttgcatctttttatccttttcataaccttttttttttttttttggacaaagtcttgctttgtcttaggctggagtacagtggcacgatctcaactctctgcaacctctgccttccaggtttaagcgattctcctgcctcatccttccaagtagctggaactacag

SEQ ID NO: 155597 - DNA, 275 bp, Homo sapiens
ccatctcacagatcatgtgttcgtccccattatggtggtatgacgaggtcgggcttaggggaagtgatttatggcatgagcgctctgtcttcatgaatgaattagttgccttttataaaaaggtctggaagcaactagcttaggcccattttgctgttctgttgttctgccacaggaggacacctagattgtgtcatctgtgaggaaggggcctccgcctgatgtggaacctgcgagcaccttgatcttgggcttcccagccaacagactgtgag

SEQ ID NO: 155598 - DNA, 363 bp, Homo sapiens
aagtgctggagatccctcccccatagatactgatgctgggtgggaattcatcccagggttctgtggggagtgggctatagctggttctggttttagggaggactttctggacatagatcctaattgcaatgaaacttacagtcatgtgagaaagcggtgcaggtgtctgagggttatttgtggttttccaaggcagaagtgaaaattcccaaggggtacacagttgttcaggtgagtacactttctagtaaatgaagccatctagcctagtcagggacaggaaggaggagcttggatgtttgctctttggtgtaatcctgccttgattcagatccagcctttcccactaagatgtgtgactag

SEQ ID NO: 155599 - DNA, 225 bp, Homo sapiens
atagaaagagcatggacattagcactagagagacctgggttcaaatctcagcctttcctcttaccatctgtgtgccttggtaagctgctatgagtcggcttggcatttacagaacggttataataatgttacttttttgttgtgtttttgggcttttattgttgttgtttttgaaatggagtctcgctctgtcacccaagctggagagcagtggcacgatctcag

SEQ ID NO: 155600 - DNA, 375 bp, Homo sapiens
gctttctggagcccaaagaaaatgtttagtacgcacctgctcttcccagcaagtctgtcatgtgcaaggagttgcagtgagtggcagcctgttcagagttgtggttcagggaggaagcattgctagagtgggctttgggcaggagcatttatctcatggagacagttttctgctgactgcatttccacctggaagggcatacagagtgttgtttcttctgcttgtgattttaaaacttgcatatcagtatctacctgttttgagtcttactagtattttatgcaggaacacaaaaaaaatacttaactaccttttttgtaaaataccgaagtgagttgttatttatttcagatttgaacttttcattaacctttg

SEQ ID NO: 155601 - DNA, 151 bp, Homo sapiens
catggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaa

SEQ ID NO: 155602 - DNA, 419 bp, Homo sapiens
caatctagtctcaggacatggtagatatcatagagcattgtcgaatctcacactcaacagcccaagtcactttcaaatagtttattttcaaaagaggaattatgattctgatcatttagtcaattcactaaagtgaaaagcatgaaaaaggaattaagagttcataaagcagaaagcctcgaacaatgttatgtttgtcagggtcaaagataagaaaaagcactcagaaagaaagaggggtgaccttggggataagacgagttttttaagcaccaagttcccccacgctttcctatattttcccctaccatccatgtctattaccttcacagtccagtcgtttttttcctgtggaatgcatcaggacagctagggagctttaaaaggtgccaggggctaccctaggtctatagaatcac

SEQ ID NO: 155603 - DNA, 511 bp, Homo sapiens
tcagctagtctggaaactacagggaaggtaagaaaaacaaaatgaaatacaattaccctgggcatgggtgcgggaatgtgaccggagtcgcatgctcctgtgtctctggacctgataaattctgcatacctcacattcctcagactgttctgagccgcttttctctctcaagttgatggatgtacggagttaaaacatattagagtgtggacatttgcaggtataaacataagcagctacacattttgctcatgttggtatagctttgaaactagctacgtgctcaaagtcacgtgcctactaagattagacatcaagacataaattatgtcttctgattacaaacccaggtctgtcttttctatttgcttgatttctggtgaaatcctctctgagcataaacacaaatggaggaatctcaaaggaaaacattagtagaattggctgtatgttttaaagtacatgaaataaatagcatagattcttgtaaatttgaaaacacgagtatctc

SEQ ID NO: 155604 - DNA, 204 bp, Homo sapiens
aatgagattcctgaggaaaggtgaacttcagggaatgagacaggttttaaagcaaagattctcctggttttggcaaactcagacattctggctattttactaagaagagattttctctacacttttcatcattacagtttcattcatgataataagccttatttacccccaggccagtcagatgtgaaatgttatattaatttc

SEQ ID NO: 155605 - DNA, 437 bp, Homo sapiens
ggatcgagtcggacccaaggtccttagcccaagggtcctacttctgttgttgttgagacacagtcttggtctgtcacccaggctggagtgcaatggcgcgatctcggctcacttgaatctccacctcccaggttcaagtgattctggtgcctcagcctcctgaggagctgggattacaggtgtgctgtaatttttgtatttttagtagacggggtttcaccatgttggccaggctggtcttgaactcctgacctcaagtgatccacccgccttggcctcccaaagtgctgggattacaggcatcagccaccgcacccgacccttgcttttcttttgaagtatcctattcttttcctgtcgtttctgtgaagcatccagggcttctctggtccaaagtcagtttttacatgaatgtcaggcttaagggattccagtgc

SEQ ID NO: 155606 - DNA, 489 bp, Homo sapiens
tcgccagagaagtagagagtgtgtttggcggggttagggtccctcccaggcagatggagccttttcccaggggcacaacctgggctgcccttgactgagcaggtttgaaggtactctagaccaccggatcatcttcacaacagtcccattaactagacgctcttattttcatacctttttggtgagagagtttaggtaaggtacccagagccatgtatcaggcagtaagtcactgaaccacgatttgaattcagccggtctcattcttctctgccttggagtccgggaaatggagaatgtagtggaggagtcaccccagtcaaggccaagcagtggggtgggggtggtgctggaagaggggctggatcacaaaggacaggacccggccaggtatgtgtgtgcaggaggagtggagcccacagtgggatctgaagtctgggaaggaaggcctcgttgttatactaaaatatcattccttgtttcaccgga

SEQ ID NO: 155607 - DNA, 227 bp, Homo sapiens
aaaaaaaatttgtgctgcgaggtaaagcatgaatgagtatctccatttcatatggcttccaatccagtctcacgagcttctcttagttttctatttcttgaattatctatagacctatcttgcactatactaagaagcactatctttttctcagcctctatttactcagatagtctcgtctttccataactccatgctttgtgctttttaacatagctgatacatca

SEQ ID NO: 155608 - DNA, 531 bp, Homo sapiens
gactcatgtcattaaatgtaagttacggccactagcatgtggaaatcatcgctcaagcaccttggcaataacagtggcatggtgtggcttcacgagtctttttaaggggaaaaagaagtgtttcgttcagtaattgctcctggatgggggcccagcctgcaacagcttggcatgtggaaggctctggtgccaggtacaatgctgaagaatcagatgcggaaagagagtctctctgaaccgcaaagccaaatattaggttgaaccctatagaattttaacctacaaaatggacaatttaatatcgtttcactgattggtccaaagcacattttgtagaatcaaggaaggaaccaagcccaagaaaagcagggcggggaagtcatgggggcagaactccccaccacaccccatccttcttgcccctaccctgcaccagcgatggcctgattcttgagtctggggtcccagtaacttccctagtcttgaattcttagctttgattcatccctcagggtttggggctcatgttca

SEQ ID NO: 155609 - DNA, 375 bp, Homo sapiens
aggtacctgcaaaggctggagacccggaacccactaagtcccagcctcagcctgggcactctgtgaagtcaccaagttaggttcaaaaatgaaaggaaagaggaaaccagatcatttgcaagagaaagcaaacccttcttccttgtaggatgaaatttgccagaacttagttgtgactgacgtatagctacccctttctccctctttccttctttgtctgtatcttctcattagtcaattttcattctttctttctttttctttgttgtactatttcaagatgaccactatttcagacactgttcccaccccaaccctaggtaggttgggagaagaatggataatgatttggactttgtttttgagcctaaaggt

SEQ ID NO: 155610 - DNA, 217 bp, Homo sapiens
gcagatgctggcaacacttgactcactaaaacaggaggcagttacaaaattacagtagtacagtacgtactagtttatagagttatgtttttgggggggctttcacatttgttgatttttattggcgatctctttttcaatacaatttatggcgtcatcaccatttccagtctgattatacaagtgctaagtggcagaaaggtctggaataaataca

SEQ ID NO: 155611 - DNA, 480 bp, Homo sapiens
gaagaatccttccttgcctcttcctaacctttgttggttgctggtggtccttggcattccttggcaagtaggtacatcactccagtttctccctccatcttcacatggccttcttccctctgtgtgtctgtgtccaaatttccctcttcctataaattgggctgggcgcggtggtttatgcctgtaatcccagcactctgggaggccaaggcaggcagatcacctgaggtcaggagtttgagaccagcctggccaacatggtgaaaccctgtctctactaaaaatacaaaaattcagtgggtgtggtggcaggcacctgtaatcccagctactcgggaggctgaggcaggagaatttcttgaacctgggaggtggaggttgcagtcatgcgactctaccccagcctgggtgacagcaagattctgtctcaaaaaaattaaaataaaataaaataaaagacatcagtcattggctttaggg

SEQ ID NO: 155612 - DNA, 189 bp, Homo sapiens
atgaagtgcagcaggtaggaagctcctgtttaggagttctctaaaaactcatttccttacccttctcctcctgagcttcctgaattgatgtggccacggtgggtggtacatctgcaagcattctacgtttccttgcttgtccacgaaatggactttctcatctacattttgaagctctctgaattgggg

SEQ ID NO: 155613 - DNA, 531 bp, Homo sapiens
ttggcatgtagtgatggacagtgcagttatcagaactagggccagccaggcagagggtgggtgaggattggtcagggccgttaaagggtttaatattttactttgagaggttttgaaggatccccaatacccaaatggagatgtttactagatcactgtgaggtttggtggcctcagccccaacagtccctcactgggtaccctccctcttctcttaaagccaatgtgcttcaggggaagctaactccaccccagacaggatttgaacccctacagatgtatgagatcattagcatgacacagttactattgattgcaaattacagaatacccagctcaagccaactcacacaataaaggggcccagtaagttgcataactagaaagttcaagacatccaagacaggtttcagcaatttgatttggtcattgagctgcgccctgcaaggcgtcaaatatttctgctgttctgctttgtgggcctggttctggccttcctcttggtggcaggatggccttcctcttggtggc

SEQ ID NO: 155614 - DNA, 466 bp, Homo sapiens
agttcgcagcttatttggtatctggcagggctttggagcatctatatatgctgggcacaggcccctcactgcagctgggggaaaatcaacagagaatcaagggttgacctgcaggtttacaagtctggaaagttaactagtcatcaactcaggggagagatgcatctaccagaatgccactgattaacacttttaaaataacctgggccaggcacagtggctggctcatgcctgtaatcaatcccaggactctgggtggctgaggcaggaggatcacttgagtccaggagtttgagaacagcctgggcaacatggcaaaaccccatctttaccaaaaataggaaaactagccaggcacggtggcagatgcctatggtcccagctatctgggctcaggtgggagaatcacttgagtccaggtagctgagacttcagtgagccatgattgtgccactgcattccagcc

SEQ ID NO: 155615 - DNA, 414 bp, Homo sapiens
gaggctgaggtgggcagatcacttaaggtcaggagttcaagaccagcctggccaacacagcaaaaccctgtctctacaaaaaatacaaaaattagccaggcatggtggcgggcacctgtagtcccagcgactcaggagggtgaggcaggagaattgcttgaatccaggaagcggaggctgcagtgagcagagatcacgccactgcactcctgcctgggtgacagagtgagagtccatcttaaaaaacaaaacaaaacaaggggtttgagggaaatccttcttcactgtttctggcttctcatggctccaggtgttcctgggcttgtggccacaaagctccaatctccgcttccctcttcgcatggccttctccaggtgttgtctcttctcccgtctcttataagtaccctggtt

SEQ ID NO: 155616 - DNA, 161 bp, Homo sapiens
atatccagtgacctatggggcagtgtcagatggtttaacatacctgtaatggagtgatgggagtggcgaatttgggagtgggaggagtggcagaaaaactacaagcatgaattgttttattgtgcttcacttaattgttctttgcagatattctttttttc

SEQ ID NO: 155617 - DNA, 232 bp, Homo sapiens
aaatgcaatatctgcacttgatacttcgcttttttttaattgatttataacactgctacttccacaaagcacttgaggcatcttgcaactaaaataccgatacaataaaaacaaagacatgtacaataagataaatactgagaagtaaaagaagggagaaaacagtatattcaatcaattttgatgaaagctagaagaaagtatagaatctgtctctcagcctcccatcagc

SEQ ID NO: 155618 - DNA, 371 bp, Homo sapiens
tgctggctcatttaactaacaagtcataggacaaggacactttcaggtacagctagatccaggtgtcaaatgatgtcatggggaccccatctctctccctttccttttcgcagtcctgcttccttctatggtgtcagaagtctgagacacgtggtctctacatggtggcacctggattatagcttcacagcaaggaagatttagcaaggaaaaatctctctttctatcactcccactaaagtcccagaactgaatcttatggaaccttctggggtcacatgcccacccctgaaccaatcatggaggctggaggaattaagaaagctgattggcccagtctgagtcatgtgccttcccctgagccaatcata

SEQ ID NO: 155619 - DNA, 337 bp, Homo sapiens
agctctatggacactaggaaaaaaccttgtagagagagtaaaaaatttaacacccatagaaggtccaggtatgccggcatacctggaccttctatggtgtcagaagtctgagacacgtggtctctacatggtggcacctggattatagcttcacagcaaggaagatttagcaaggaaaaatctctctttctatcactcccactaaagtcccagaactgaatcttatggaaccttctggggtcacatgcccacccctgaaccaatcatggaggctggaggaattaagaaagctgattggcccagtctgagtcatgtgccttcccctgagccaatcata

SEQ ID NO: 155620 - DNA, 190 bp, Homo sapiens
ttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacgggctc

SEQ ID NO: 155621 - DNA, 332 bp, Homo sapiens
tccccgtctcttaagtcctatatctgctcaatcactgagttatcagttccatcttctaaaacatttccatatctagtcacttcatctccactgctacctctcaaatcaaggtatcttccctctcccctatactaacatgatattctcccaaaggccttcacacatttacccagcctccttccatatcattttctatattacaaccggagtgatcatttaaaaacccaaataatgtcatttccatgtataaaacccttcaagagcttccaactgaatatagctttattcaggtttccaagaatcttcatggtcttttacaatggttaaaattt

SEQ ID NO: 155622 - DNA, 470 bp, Homo sapiens
atgatgacagatatgcagtcccttctctctgtggtcacatgggagaatcactcttgcctgctccccttgcattttggtggcatgttggactagttctgaggaatggcctgtgtccagactgcagccagagtccttgagtgagaatggtagagcctcctgctaccatgtgacaggcacgtaacatgagtgggaaacatgcttctgtgagtttgagccacagaacggcattcttacagagtgccttggagtaatgaaactcaaaactattttttaaattcatcatttagtattttccactaattcagactcattgtttagtgaaaagaatacagccatcggtaaggcacatgactgttattaacagtatgaatttagacaaattatgtaatagagttttagttttcttgtgtcaaaggcctcacctccacaaactacaaacaaaacttttgatgcttcaaattagtccatac

SEQ ID NO: 155623 - DNA, 309 bp, Homo sapiens
ggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagat

SEQ ID NO: 155624 - DNA, 216 bp, Homo sapiens
catagagggaggatcagaaaggagaaaagcattcagaggaaatagaaggtgcaaaagccgtgggagccagggaatagaattgtatgtttagggaactgaaagaaactcacttatgttcagagactcaagacttccctttctttctaggggagcatagagtcaatggtagatggcacaagcaggagaaagactagaaatgggtagaactcctcagtc

SEQ ID NO: 155625 - DNA, 363 bp, Homo sapiens
tgacatggagtgaacattcattaaatagcttctgagtagatgaaccaaaaagaatgtaacctttttgtctaaagataaaaaagagagaacactcaatgctgatgaagatatggagagaaggacatttcatactttgctaaaatgtgcagaacttggttcaagctttctagaagacaatttagcaaggtatatcaagaatcttacagttaacctccttttactcaagaaattcactgtaaggaatctctcctaaggaaatcattaaaaatatgcccaagattcatgtatttaaaaggttaattactataataaaaaatagtttttaaaaactggaagcaaattagacactcccaaattagagaa

SEQ ID NO: 155626 - DNA, 427 bp, Homo sapiens
aaaagtgcacatataagcatccggcgtgtggtcacacacagcaaatattagccattgtaatttctaatagctgtatctttttgtaacctgttctttttgcacacactctctctcatgtaactgtgttctggactacatctcactactctaaagctcacgtctagcacagaccagatgcttgaaaaacatccagccaacaagatgggaacacagcgctgcccttgtgaagacaaagtcaggtggggtgcagggtggtgagaccactgtgtgaggacctggggctttgggggccgctgaaggagcccctggtgggctcctggggactgggaagaggttatgagggaggtccaaagggtcggagcaggaggaaaagtgcctcaggctgaaggaggagctcgtgggtggtctggacgggacagtgtgcctg

SEQ ID NO: 155627 - DNA, 106 bp, Homo sapiens
cctgatggttgcttgtgaaaacagcactttacaaacacgttgccatatttacttgcgcattcacactttccaccaatttggagaagaaactcagaagagaggcttt

SEQ ID NO: 155628 - DNA, 355 bp, Homo sapiens
tagagggaagtagctttcaggctgggcattgaaagacaggtaggaattcacagagagaatatgtgtggcaactaaaggcagagggtaggtataggaagaatggcatatggcacatttgaaaggcaatggatagctggctttcttagtataaggcgtggatgtaggtgctatggaggacactatcttcttctcaaggagcttatggtctaactggggagaagaatctacagaaatgattcctgagttggtaacaaggcaaaatagaaaatgtgatttgtagaacaagagtaggctgtgaggccaggaagctagttaggcagatcatagatcaccttgaacgctaggcttatacatt

SEQ ID NO: 155629 - DNA, 625 bp, Homo sapiens
actaattacaggctgatgccgatggtgtagggagcacactcaagaaccaccggtgtcctgggagagagaggcaactaacctaacgcagtgcagttgctgagctctgtgtaggagaaagcttccactttgggaagagctgggaggggccacctacctagacccagtggttcagatcaggaaagtctgccctccagagatgctctagtgcgctcttgaagggtgaatcaggggtaactagctgcggaactgtgagtagttcaatgtgaggatgagaatacaggagagggcagaggtgtcaggcaaggggaagctggctgtccttaaggtccccaaaatgataataatctaatctgaagtgctgaagctcagatctgctgtcccctgggctgtagctgagtcacgggtgagcgccaagaggcagctctcaggtggatctcagtggcttcgattgacttcgagaggatctttcagctacttcctcaaaattaagagacttgaggaactctctgaggctagagtggattcagggatctggaaggtttctgttcccagtgtactaattctttgagggagtattgcacacacaaggaacaatcatgtaagaacattaaaaccatttccaggc

SEQ ID NO: 155630 - DNA, 197 bp, Homo sapiens
ggctttctacctgggcagatgagaatttcaccagtgtgctgttccacaaacccacccgtgtacacacctacacccataccccaaccacagactcacgcagacggcacacacaccagcccgatacctcatacacgttctcgcacgtgcgcgcacacacatacactttctctgcatcctacacattccatccacgctca

SEQ ID NO: 155631 - DNA, 232 bp, Homo sapiens
gtcaccttcagcctttgatctgctagccctactgccagacagatggatggatgcagacataggctcacagactctctctctctctctctctggcccatagcatctggtgcttccctcatctccatctactgagttccatggtcagccccctaggaacctgaaggcaggctcatctttatttcacttttatcttcccagcacacaggaggtgaacccttagtgaccataccca

SEQ ID NO: 155632 - DNA, 548 bp, Homo sapiens
ggtagcattcttccttgcctctccccagcttctgctgggggctggcactccttggcatttcttggtttatagctgcagccctgcagtccctgcctctggcttcacctcatgttctctgctgtgtctgtgcctccatatctatgtccattgctttgtaaaaggacacaaaacatgttgggtttaggaaccatcctattcccgtatgagtccatcttaattaattacatctgcaatgaccctatttccaaataaggtcacattctgagggactggggtaggggaggttaggactctaacatattttttacgggggaggcacaattcaaaccataacaaacactctcatttgggtaataacttttaagctacatatccttactcagtgattttgcatgatcctcccaaatgacttttgagttagtcagtctcctcagtttacaaataagaaaagagcacttatctaccctttcttctcactctttcctcgcattttttttcctgaacactcatttgaaactattgacatatatcctatgatatatgtcaat

SEQ ID NO: 155633 - DNA, 312 bp, Homo sapiens
cgaaaaggagcaggcatctaacggagcacccgctttaggacagcatgggaagaaacacttttatttcactaactgtgctccacagcttgaggacactgaggcccagtgatctgctctgtccagggccacatggctgctcagtgggcccacatctgactgtcaggctctgctgcttgcctcctttcagggcaacctgtccacccacccagcagcaatacagccattgtctgacccactcccccaaatgcaaaatatgaagaccactggagcatttgaaagctcttggccctgcccactccctgcgatgcaccc

SEQ ID NO: 155634 - DNA, 341 bp, Homo sapiens
gacgtacccctccatcagctcagattccggaatgctgcacttcccaagaagctgtactggaactcctcctcttctccccatctgcactccctcttagaaactctcatctcggccaggtgtggtggctcacacctgtaatctcagcactttgggaagctgaggcatgagaatcgcttgaacccaggaggcagatgttgcagtgagctgagatcaagccactgtactccagcgtgggtgacagagcaagcctccatctcaaacaacaacaacaacaacaaaaccaatactctcatctcatagctttaaacattatatgactcctaatttgtatctccaaccct

SEQ ID NO: 155635 - DNA, 368 bp, Homo sapiens
cattctcccaaaatggtagcaggatgtttccctgatggcgttgcccaggccttgaaagagccgggagcgatttcaaatgggctccgggctcgtgtcaggagcaggagctgcctttggtgggacacaggtcaccaaacctgacccacccaaatcttcagcactgacatcaccgccgaaaacgagaagtttgtttacgacaaggtctcatattcctgcttgttctttacctaaaaatctaaatttcccatgtgggtccttacacatctgtatcaacaaaatcacaattcgccaagatactgaaagcaccaacaatttctgagtttaaggagaagagacaaagaaatcaagacaacaggaagaaggatgca

SEQ ID NO: 155636 - DNA, 351 bp, Homo sapiens
ggcaaggatcgaaggtatcaaaatgtgttttaaaacctatctgaaggagttgattactatcagcgctaaaacccagtctttagtctcctccttaaccaggatgcagttcctagagataaaatataatgttaacactgatctaatatagtaaacaatcgtcagaactttggaaagatttctctctctctctctacacacacacacaaatagaaacacacacacacacacaaaaggatgaaatgcctaggaataaatttaagcaaggaggtgaaagatctctgtaaaggaaaactacaggccaggcacagtggggctcacgcctgtaatcccagcactttgggagaccaaggc

SEQ ID NO: 155637 - DNA, 337 bp, Homo sapiens
caggctgaggccagaccatagagggagcatttataccagccctagccagaggggaatctcctgtgccttggtcagaacttgaattctggcaaacctcgtcaccgagggccaaagtgccctggggctctaaataaaattgaaaggcagtgtaggccccatgaactacaactcttaggcaagtcctagtgctgagctggacttggagccagttgacttagcaggcacatgacctactgagacaccagccagagcagctagtggaatgcttgctcggcccctccccgccaacctcactgctccaaaagagacctcttccttctgcttgaggagatgagag

SEQ ID NO: 155638 - DNA, 301 bp, Homo sapiens
aggcagcatgtcacaatagttaaaagcaaggctttggcggcaggtcaaagctccagtgcatgttccaaagcttcctagctgtgagactttgagcaaataacttaacctctctgagtctttattttctcagctacaaactggggataattcttcctactactcagagtggacgcagggattgagtgaggcaatatatgtcaaatcattaacccagttcctggcacatattaagcatgcaataaatagtggctttaaaaaatgtgctggctggatgtggtggctcatgcctgtgatcccagca

SEQ ID NO: 155639 - DNA, 663 bp, Homo sapiens
acggcatctgtcttttctcccctatcttactgataatgtgtaccctttaatagctttctaagaggaattcaaattactgatttttaaacgtgttacaagtatttctcccagtttgttgtctcttttgccttcattatggtattgtttgcctttgtggtaggatgttttgttttgttttaatactgtgattctttaagctgcttgcttacctccccagaggtggagaaatttgttataactctgcaatagcctccctatagcagtctactgacccagtccctttatctcattttaaagtctttgccccttctacccttgaaatccttttgattgtaactagctaaccctaggatgctgagtcactaagacttttgaagagaagatatggttaggtatttcggtcaatgttgtctgtgtttacagaatacaagttgctctagcttttatgtgaaagtttccctctaaagagaaaggattgttcgatcttttatattagaaagagaaggaactgacagttacctatggaccttattaaagtttctattttatttattgtttgcaaacatcatcttcatatgttcaaggaaaaaaataggagtgtgacacagttgaaatgcagaggaaataacacattaatcactgtatagtaggacacatgccatt

SEQ ID NO: 155640 - DNA, 394 bp, Homo sapiens
aatttaagcctctaacttaaatcatttattgtgctacttcttttgtaagctcctgtatgcatacaaacaaatgtttcttcctgttgatctgtcttttgccagtttaattcatggattccttgatactaaacgttaagaggatagaggaagtttttcctcctgacactgccttgatctctgtgctcttactctggctctttttagtttttgtttgtttgttttttttttttttttgagatggagccttgctttgtctccaggctggagtgctctggcgggatctcaactcactgcaatctctgcctcccgggttcaagcgattctcctgcctcagcctccctagtagctgggactacaggcacgtggcaccacacccagctaatttttgtatttt

SEQ ID NO: 155641 - DNA, 583 bp, Homo sapiens
gtcacagactcattaattagcgttgtgtttccagctctcagatgcaatcaggcaaggagcaacttcggagctgagcatttgtacctcgggaggcagaaggagggagccaggaaatgaggagggaaagacgggggaaggcctgagtttgcaaacgctgagagaggcaaagactggggattttaggtcaggtcaatcagtggtcaggctgcgtgccctctgtggcccagccagctgccaaggactatggcttgactcagcccagggtcaagacaggcgtcttttcacctgcagaacatctggagaatcacagcgtcacggaaacagcattagacttagaggcagtggtcttggttttaccagtgtccagctgtgtgacagtggccctgtttctcaacctgggtctcagtttcctcatctgtaaaatgagaggtggtgataaataagatgatcgctgagaactgtctcgctcccaaaaggccatgacttccactgtaaggagtccaacatgctgtaccaactattttaggaaattgggccatccctccctggaaccaagattggcgcagtgaccgaggcttagaag

SEQ ID NO: 155642 - DNA, 665 bp, Homo sapiens
gcgagtaggtgtgattgacacagggtgcttcggagaggatggcaggacatgaactgggaaggaaaatataacatagaaaatgccaaaggtcctggactttattgtgttagcaagtgcaaactctcacaggtgttttaaagaagagagtggcatggttggtttaaaaatagtagcagcagggggtatactggagggaagatggtagataggaggcaggactaatttgcagttcccactcagatggacagggcagcgtgtggaaacccacattgtgaactttggctccaagaactactgcaggaatataccaggaaagccaagagaattgagcagacagaaggagatggattgctgctgtaggctctgcgggacagcagaagaactccaaaaaaaaggacataatctcttgggagctctatggccccgcccacagtgtgattttccctataataccacagctgatgcactcttgaaagcgccacctcctggctggaggccaacgaacacaaaaccagtagtacacttaacaaaaatacaaccaaggaccctcacagggtcacttcactctcctgctacctccacttgagcaggtgctggtatccatggctgaaagacctgaagatgaatcacatctcaggactctttgcagacactccccagtacca

SEQ ID NO: 155643 - DNA, 435 bp, Homo sapiens
atttgataccatattagaattaagaaagtccacagtttcctttagtccacataagctataatggtgtaaacccagctgagtgattttgtatctatatcatcactgccagggaatgtagccttttaggtagatagtatgtacaaagtttagtgaaaaccagactgtagacctaatagattatatataaggggtttcctctcccacaaatctaaattataaaatctattacagtacctgctcagatttcagacactattcaacaatatagcttatgcatttgataaatgtttttgttttttccttcaaagttgaacataggcaaaaggtataagttattgagattccaattaagttttaagattcactggttttgttatgttctctccaaaaatattgtttattgagaactatgtattttaatattcatactttcag

SEQ ID NO: 155644 - DNA, 483 bp, Homo sapiens
cacacacacacacacacacacacacacacacacacacacacacaccctcgcactctccatcgcgccctttccagcttgcttcccgctggagtcatttcattctccattgctggaaagcagatgtgagcagagctggacccagacacacacaggcactcctgattcccttgcgtttctcctcctggaatcttaattttacccatgtagtgctgaaggaacacaaatacagcactcggggccctaagcaggcctgaccgtcacctccatgagccccctctccccatagctctacagtgtccatgtagaaaaatcgtcagtgagggccagtgggctcatctttgtcttttctctgagatgcaagagcaccaggctctgggccagatgctgctaagcgctcactgtgtgacccccttgcttttctgagccgtagttgttggctcacataagattagtatttttactcgttgcttccatccaccctta

SEQ ID NO: 155645 - DNA, 133 bp, Homo sapiens
ctaaagtaagcatattttaggatggcttattctgccaggcttcacaggtgaggtattagggaattaggactttgccttctcatactttggggcttagctttttatcatttgcagattttatttttttaagaca

SEQ ID NO: 155646 - DNA, 595 bp, Homo sapiens
gatggttaaccttggcccatacttccatttatagggcaactgagatttgaacatcctgctcaggcttcctcttaaccaagtcctgtgtcctcacatgatgcattggttatacctgactgcattcattttctgatgctgctataacaaatcaccataaatttcatggcctaaaacatcacaaatgcattttcttaaaggtttttttagagacaacgtctggcgttatcatcctggctggagtgcagtggcaaaatcatagctcactacagctttaaactcctgggctcaagcaatcctcccacctcagcctcccgagtagctaggtttataggcatatgccactgcacctggctaacttttaaattttttgtagagacgaggtctttctatgttgcccaggctggtctcaaactaatggcttcaagagatcctcccactttggcctcccatagtgttgggattacaggtgtgagccactacacctgttcctcttgaagttctttatgtttgaagctctatgtgggtgtcagttggctaaaatcaaggtgtcactagggctgtgttcctttctggaggctccagaggagaactcttt

SEQ ID NO: 155647 - DNA, 165 bp, Homo sapiens
caacatagtgggacctcgtccctataaaaaaagaaaaaagttgccaccatacgacctgtcagggtctgatggcctccttcacatggctggagtcagtgcttcctctccctgagctcccacacatgaggtttttcagtcctgcctcctagagaatgcccctgacct

SEQ ID NO: 155648 - DNA, 273 bp, Homo sapiens
cagggactcaggaataagggtcgcctgccagttgggcagaggcagcaccagactgccacgaccactgaagcacagcacttgggagaattgacagtaacacccagccactcaggggaaggggtgtcacaccgtcaccaaccccctcgaccccagcactgtccgtgatccacacatgcctgctgcctcctcatgcccggggcagtgccgccaaccatgcccaggagatcatgcagcctgcaggcagtggggtttgtgatgccagtaatcccaggc

SEQ ID NO: 155649 - DNA, 217 bp, Homo sapiens
ctgccccgacagtctcagacacacaggcatagggcaggggaggcagaactgagaccaagagccttgcaaaataaagtggttttttttagcagaagtcatgctacatccttacattaacactgtaagctacagtctattaatttgatccttaagaagtaaacaggctgggcacagtggctcatgcctataatcctaggtattttggaggctgaagcag

SEQ ID NO: 155650 - DNA, 555 bp, Homo sapiens
tataaaagtatctatccagacacactctttgtgcagtactgaggacaaaaaccttttcatttgcaggatgtttggtattataagaagtcagtttccagcactagcacatctacactaagttactgttccttccctagactcttagttagtggggctgaatcagtcattttgacttagagttttagaactcaatttcacatctaattctatagaatctggcattaaaaaatcaaaatttccctaactccccaaaatagaaattatgagatggtgaaaaaacaaaagccattaggtcttgctaagatctggtgacaaagtacttcagttagactcaaaagacctacattttcatcagttttcccactcagagtgtgtccttactacacaaaactgtgctctggcctaaaacaatatagattcaaatttctaaggaaaatcatctccaattaaaatcacatataactcctcacttctatattgaagtcaagagattatgttgtattttaaagatcccctatagcccaggcacggtggctcacatctgtaatcccagca

SEQ ID NO: 155651 - DNA, 536 bp, Homo sapiens
tggtttaagtggcaagttcacatggattattctccaacctcttgtcaaggagcaataggactcgatggtcaaaagatcaagttctcttaggatataacaatctagcatacaatcttggctctgctgcttgtgagctatatgatcttggacaagtaaatacactttctccttcatttcccccttttataatggaaataataatagtaatctcccagaatttatttatttatatataaatacatgtcatactcttagaaaagtggatgccaaataataagtgttcaatacatgtgaatagttcttattaatgctaaaagaagaaacagaagagagctcataacctccatcaatgattctatataatttagcatatgaaaaaagtggcagaaggctaaagataactatactaactaatctgcaagaaagagcaaaacaatgttttccagaaacttcgttgacttctaagaaagttttcaagcatatgtgtgtgctgcttactgtgagtactcagggaaataaatcactataagaaagtg

SEQ ID NO: 155652 - DNA, 135 bp, Homo sapiens
atggggcacacaggaggcactcaataaacacctgtacccttccccagaaaaggacccagagaacagcaaggggataagctggcagagcaagaggggcagcgagaaagaggtaggagatgaggagggatgttaatt

SEQ ID NO: 155653 - DNA, 353 bp, Homo sapiens
ccaggtcagggagggcccgtaagccttgctgcaggctggattctgtccagagggctctgagcagggaagggacagagctgcacttttatgtggggaatgggctggcgagaggaagacaggaggcagacacagccagacggctgtggcatgctgccaggggaaaacgccgacagactgtgccagggtagcggcaggagggtggagagagacatgtggactggagaggctgagaggggacagtcactcggacttgatgacacctgtcagaggaccgtaaggggtaaatgagttaatccatgccactcctcatgcagggcctagcaggtcccatcttctctcgtcagcacaattac

SEQ ID NO: 155654 - DNA, 364 bp, Homo sapiens
gtgatgctgggcgtctagaggtccctgtaacatctatgctgtacatcttgctttttaatgaatgaaaatacactctgaaagctacttccttccaattacttataagcttaaatttggttatatctttatagaaatgtctgaagagactaacattttttatagttaacttggtttttcatataaacataaactttggtgttaaaaaggtaactgaaggaaagaataccagggctagtaccattatacaagtaattggtaggcttttaactgaactgttattatttctaatatatacctctagaacaaaactacattaacattatcgacctggttcttccccattccaaactaagactttccttcc

SEQ ID NO: 155655 - DNA, 580 bp, Homo sapiens
gtaattcctccttctctcctagttctctgatgactttaggcagggttttattatatatattacattattatttttattttttgagacgaagtttcgcccttgtcgcccaggttggagtgcaatggcgcgatctcagctcactccaacctctgcctcccgtgtttaagcgattctcctgcctcagcctcccaagtagctgggattacaggaatgcgccaccacacctggctaattttgtaccttcttttttagtagagacggggtttcaccatgttggtcaggctagtcttgaattcctgatcttaagtgatccacccagttagggctcccaaagtgctgggattacaggtgagagccacctgacctgactgcaggtagggttttaaaatctgatcaagctttcctagcaggatggctgggtggaatcgccagagtggtaattctttaacacatgttagaattaacttcatcaaggaccacataaagtccttcactggtctcagctggtatagcattgtctatctgaaactcttgacactattgtcattttctatacttgtctctatcgtccaattctctt

SEQ ID NO: 155656 - DNA, 481 bp, Homo sapiens
tcagagcttactaaggatcgtgctggtgtctgctggttgtcttgcagagcacaaccacacacagtgagcgtctgctcctcaacttgggtgctggtgcctgagctgcagctgcagttgcagccttctctatagatacacaaagatttaacgttccttaaacaaaaataactgaaaggacttctagagaatatccacttgtcttataaaaggactctcagcccagagagcttctgtgccttgtcgatagtggcagagctgggatcccaatgcttctgccctgctggtttgagtcacattctccatagagcagtttgcccttcccagttctgtgttagtcagccccgttctcacttgcatcctgcctcgagtcacttgagcagcctctgggttcttccacagctccttgttctctgaaatgaggcccatcctatgcctgatgccgaggctgctcttcactctccacgatcctaactctgggtcc

SEQ ID NO: 155657 - DNA, 349 bp, Homo sapiens
acctagcacttcctgtacagggctttcaaaagaaacgtaggaaaggggttttcaaaagaagggaaaaggtgtaggtgctttgaagtgaaaaataaatgtgtatgtatattgtatttgcttatgaaatagtagttgcaaatgcaggtggtttgcggcctcagcatggaaagctttaagcctctgaccagtttggacttaatccttaattaactagatgagaagtggtttttaaaatgttttgtttgttttgcttatgacagtgatatgtgtaagtttcctttaggcaatatgctgaaacattaacccagcagaattaatttgaaaagatagaaagactagagtcagggag

SEQ ID NO: 155658 - DNA, 475 bp, Homo sapiens
tggtctcaatctcctgaccttgtgatccgcccacctcggcctcccaaagtgctgggattacaggcgtgagccaccgcacccggccgggagagtgttttataagttgaaaaacactagaaaaataatattagctattataattggtccactcaacttcctcagatggagttcgccccaagcaaaacaaatttccctcaactccaccccataaactgcaagtccccataactgcccctcctcttctcctcctttccaggctcacccaaacttggcttcctctgcctgtcccaggcacaggcctggcaggaagtgaccagcctcccattagctcttgccacaggtctgggagagttcacaggctgctgagctgagataagaggaccggcaggaactgagggtttcctcaccctagaaaagcacctcctcctactactcctttgccctccagactcaaggcaggaagagaaacctgggg

SEQ ID NO: 155659 - DNA, 384 bp, Homo sapiens
cccctcaacttctggggaggggagaggaagagagatactgcaggtcaagttgattacccatagccaatggtttaatcagtcatgagtacataacggagcctccctaaaaacccaagaggacagggtccggagaggttccaaatagctgtaatagtagagattcctggagggtggctcacccagggagggcatgaaagctccgcaccccttctcacatgccttgctctatatatctcttcatcttcatcttctttttgacaggatctcactgttgcccaggctgcatgcagtggtttgatcatgactctctggaaccacactcatacgcctgggcacacatacgctcacacatgtgcacgcaccccatgaacaacccgtagacac

SEQ ID NO: 155660 - DNA, 260 bp, Homo sapiens
aagtatgaaattacaggggtgagccacagcacccggccttaaaattttttttaattatatgtttaagatgtaagtgacataggcattgtcagtggccatccatttcagtcttttccggtagcctagtttactgacccaatctcacttaggttgtttaccttttcaattcttttatgattaatttattatgttttatgtatttaatcaaataattaaatttttaattttaggaatttaattacaatttttttaatgcactt

SEQ ID NO: 155661 - DNA, 338 bp, Homo sapiens
aaagtggtgaagccactctggatggccatgaggtggtttcttaacaaagctaaacaggtcttaacacacagtccagtagctgcgccccttgctgcagccacaccacaacctgtacatagaagtttcggcaaccctattcataactaccaaaacttggaagcagccaagatgtccttcagtgggtgattagatgaacgaactgtggtccatccagacagtggaatgttattcagtactaaaaatacgtctatcaagctatgaaaagacatggaggaaacttaaatgcatgttactaagtgacagaagccaatctgaaaaagctgcctactgtctgattc

SEQ ID NO: 155662 - DNA, 350 bp, Homo sapiens
aagggagatgctggacaaagtttcagttagacaggagtagtaagttccagtgatctacagaacagcatagtggctatagttaatcataaggtaatgtatatttcaaaattgttaaaatgggccaggtacggtggctcatgcctgtaatcctggcactttgggaggccgaggcgggcagattgcctgagttcaggagttcgagatcagcctaggcaacacggtgaaaccctgtctctaccaaaatacaaaaaattagctgggtgtggtggcaggtgcctgtagtgccagctacttgtgaggctgaggcagaagaattgcttggacccaggaggcggaggttacagtgagcc

SEQ ID NO: 155663 - DNA, 275 bp, Homo sapiens
ccagctctggtcacgccccttctcctgagagctcccaggactgcaggcaacttgctgaagaacttgggtaatttcccggaggccggctcacctgtttccagcccatcagtgatcttgaaacttacaaatactcagactcacactttccgcctatccgtgcaaggtaagaggagccaaacacatctcgaaatgcaccgatttttcttcttctaagggggcagactctcgtggtgtgcccccaccctctctgttaatgcctctattgtgtaaaaacg

SEQ ID NO: 155664 - DNA, 529 bp, Homo sapiens
gatcccaaggacactggtatagttttcagtggctgagcagtactctgtttcactgaatgggggaaaagttttccccattttcattttcatttctctgatgtcactgttacttatgcctcattggatctggattatctggataagtgcaacctacatctcataagattttgatgctgaaagactgttaagtgaagatctgctctgatcagtgggcaggagaaaaactggccgaatgaggtcattatttaaaacctgtataagacaaagccatcttattttagtatactgtgtcttgaaaaggacatcccacactgtaagaaaacattccttaattatgttatctgaattcactaacttttggtgttcctgtaaccactcattttaaggctttttttccagatgtatataatatgtaatttcaacagcaaaaaagaagtaagagtgtatgatgtaaaaatctttttttcattaagattcaacattcttttctgtgtctagtcccttttcagtgtcctgaaatatatttgac

SEQ ID NO: 155665 - DNA, 328 bp, Homo sapiens
  misc_feature (254)..(254): n is a, c, g, or t
  misc_feature (289)..(290): n is a, c, g, or t
  misc_feature (304)..(304): n is a, c, g, or t
agaagtacatgctatttaaccaaagagaaccaagaaaatgtaactttcagagtgctgacacagaagtggtaattggttcatgtataacacagctgaggtaaaataactaatttctaaaaatataaaaatgatcaacagggttgaataaaaccagtaaaagtggtataaaataagtctagtaaggaatttcagctccaagcaatttctccagcttagttcgtaagaaaacccaataaccataccactgtcctcantacatgccatatggcatgtagtgaggacaggagtnngagaccagcctgtncaacatagcaaaaccctgcctcta

SEQ ID NO: 155666 - DNA, 113 bp, Homo sapiens
gtcctttaaaaatatcctgtaatcttggctgggcacggtggctcactactgtaatctaagcactttgggaggctgaggcagccggatcacttgaggccagaagtttgggacca

SEQ ID NO: 155667 - DNA, 214 bp, Homo sapiens
gaaatggctacacagaaaccactcattccagtcctagccaaaatcaaactgtcatatctgaactacaaggttacctttgctaggtctttttattttaacatttcaaccaaagtacgttttcgctaaacatgtgactttccaaagcagcaggtgtctaatataatcaagggcacaaaatatatttaaatgtttaactcaaattctgccacttcat

SEQ ID NO: 155668 - DNA, 170 bp, Homo sapiens
cacacaccccaggctttagatacatggctggtccccaacaacacccatacccaccacacacaagcaagactggtaggttgtactgggccatattatttcaaggcccagatccttgccgttaatagtaggctggtaataatttctagtttttattttactttttttttttg

SEQ ID NO: 155669 - DNA, 629 bp, Homo sapiens
gcaagtcggaggattcttgatctcctagcctgagtggaccactcactccagtgtccagttctgaacctgccaattctatagctgtgctttctctccagaaactgagtctcaaaaacatcaagaacattctccataactgcagttaatcattacagccagtaggatgagttctgccgaatgctctcacatctatgcttgtgctgggcgtgggagcaagtgtccctccctgcggtgtggcctgcctgagaggctgcggtttcaattcacagtagggcagatgtactagctggtttattcccctggggatcttagctccttcaatacctcttgttgtcttttttttttagccttacataaataagaattcacacacctcttgaattgaaaataaatacaaacaaaaaaaggaaataaaacagagatcgcccctgtggacattatgctgtatctctttgaaggtattgtgtatgcatgtttgtaggcaggtcaaaaaataggtagctagtgctatggtctgaatgtgtacccccaagattcacaccttaaaacttaattgccaataggtgaggaagccatgaggacagagcccttacaaatgggattcatcactttctaaaagatgtgtgagg

SEQ ID NO: 155670 - DNA, 266 bp, Homo sapiens
gcgagccccgcccccatcatgaatgaagcttgtgttctctgagcgacatctgttctcatccaccgcagaggaccgcagagggcagaccacccacgtctaccccgtccattcttgctcacgggaggggtgtagatgcccctgagcttgccactgggtcccggaagccatcccaagcaggatttgatactcaaacaaaagttgcctttgtgtgattcaacataaataaagcgaattcaccaagggcaacctctgctcaagggtcaaac

SEQ ID NO: 155671 - DNA, 192 bp, Homo sapiens
aaataatgttgttggtggctctgactgatgagtttatggattgttcttgctctctttttatttttgtgtgtgtttccaaaaaatttttaagttaaaagaaaaactaaaactcttttggaaaacctcagggagaatcattagtaatctaggtcaggtgtggtggcttacacctgtaatctcagtactttggga

SEQ ID NO: 155672 - DNA, 678 bp, Homo sapiens
aacatagcaaaaagttgtctccacaaaaagcacaaaaatttgctgggtgtggtggggcacagccatagtcccagctactgggagtctgaggtgggaggatcgcctgagcccaggaatttgagctgtagtgagccaagatcatgccactgcactccagcctgggaaacagagcgagaccctgtctcaaaataaataaataaataaataataaaataaaaatagaagcaactccagtgttcactgagagatgaatagataaacacaacatggtacatccgcacaagggaacactatgcagccttaaaaaggaagcaaattctgacacatgctgtaacatggattaatctcgaatccattatgctaagtgaagcatgccagtcacacacaaagaagtactgtgtgctacagaaaaatgctttagatatgagatctaggagtcaaacatatagaaacagaaagcagaatagtggttgctaggggctgcgtggggaattaattgttcagtttctttttttttattaaaagagatggggagccaggcatggtggctcatgcctgtaatcccagcactttgggaggccgaggcgggtgcatcatgaagtcagaaattcaagaccagcctggccaagatggtgaaaccccgtctttactaaaaatataaaaattagctaggcaccg

SEQ ID NO: 155673 - DNA, 677 bp, Homo sapiens
  misc_feature (644)..(644): n is a, c, g, or t
tacctgcacagttggtttagggctacggttcaatcccagaaagaatccccaagggagaggagtgattgaggcctgaggttgaagtttagacttaggacaacatccaagtctaagagagtgcaggaagagcagtagccggggcgggagcagccagagagaagagaagcaggagactgtgctgctctggaggccaaaggaggaaagagtttggaggtggaggtgggagaaggatctgagtgatctgattactggagtggtgaaaaaagaactagggagagcggcagaggattttaggtggagctcattagccagcctgtggacaggtcactttccctctctgagcctcaacttcctcatctgtaaaatgagtgcacagaagggctacagtgagatgaactgaggctccatggcaccctgatgactgtgattgtagcaattttaattcaagagaaacctaacgagaagagatgctaacctttgcagggcacctactgtgtgccaggcattttacactccccttctctgtaaccctcccagccaggatgtgaagcaggtgtaccagccccattttacacatggggaaaatggagtcttggcttgtgaggtgactgtgcatgggacggggtacgagctcgatcgacgtnttttgtctcaaaaaaaaacgacgagcaacaggg

SEQ ID NO: 155674 - DNA, 418 bp, Homo sapiens
atttcactcttgcagcccaggctggagtgcagtggcaaaatctcggctcactgcaacctccgcctcccaggttcaagccattctcctgcttcagtctcccaagtagctgggactacaggtgtgcgccaccatgcccagctaatttttgtatttttagtagaaacagcgtttcactgtagtggccagactggtcctgaactcccaacccaggtgttctgcacacctcggcctcccaaagtgctggaattacaggcatgagccaccacacctggccaatgttaatattttaaatcaactttattgagatagaatttacacaaaataggtgtacccacttcaagtatacattctggtgagttttggcaaacttacatactcatgtagccatcgtcgacgcggccgcgaatttagtagttgt

SEQ ID NO: 155675 - DNA, 659 bp, Homo sapiens
gttggccaagtcaaaggtcaataagatgacactaaggaacgtcctgtttttagagtgagatgttagttgtttactgctatttaagtgtatccccaactggtaacacttcagaccattctttttcagccttttacataataaacgtcccgcaagagagtcttcagcagtttgctaaatcttaagtatttggaattaaagtgtactttttaatttaacattaaatagaatcccttatctctacctccaccccctggccccaaataaataaagcttttccaaatcttttacgatgtgagctgctcccctcctgggaatgaaaaggatatgagacccatttgatgaattgctggcacttatatgtgtctacatttttcagtacactttttaaaaaaaaaaactagacttaagctgcctatattacatgcttcttttgtaaagatgataaagagagcaaagatttctattggcataggcctaatctatttgctttgttgtgattctttttttttctttcctttaactgttaacctatttataaatctaaatctacatacaaaggtcattggttggctgaacttaaaccattttactcagtaaatttaattaagaaaatacagtgcaactcataagcaaatgagttttttcctagttttaaacca

SEQ ID NO: 155676 - DNA, 548 bp, Homo sapiens
ccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaaacttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttattaagaattcggtgatacatgttggctttattgctgactaatgtagaggtacttctttgggctagtac

SEQ ID NO: 155677 - DNA, 170 bp, Homo sapiens
gcgaagacagaaagggcaattggaaagtcatctcacctccatttttttcctctcccttttgatggattatggttgaacccagcagtgtcctcgctaggtgagctgcacgtttactgcacgttctgcactgggaatgcgtgttctgcccatcgtgtgcccttgaattctgt

SEQ ID NO: 155678 - DNA, 308 bp, Homo sapiens
cgcgctcggctccctacggacctgatagtgaggcaaccaggcccattccccaaactcacagggctagcagatggtagcaccagcttcagctttgctgcatgtctgatgaatcactggctcttgaccaactttccccaaaactcttggaggaaaagtgcacaatgcctagtacagagggtctcagcccactcagcttgaatggggaaggttaaggtaagggttggagtccgtactgccttctcccaaggactcctctgagaaataacccctcgaaataacccccctccctccaaacacattctacttat

SEQ ID NO: 155679 - DNA, 325 bp, Homo sapiens
taagaacctctaatattcctccaacaagcttgcaaggtcatttctgcttcctaaagccaaaagaaactgaactaatacacaccccaacatattgtagtttctgtgtgagcaggaacaacgtgttcctcattatagctccaaggccagcacggtccctaatcagaactcactgaacacctgatgaatgcctgcagctcactgcactgagtgggagatgctcctcccacttagatagggattttttttttttaactctcttgccttcaaggtcctgcgcacatctgccctggccttggtctccctgtgtggtcagctacagtggcca

SEQ ID NO: 155680 - DNA, 400 bp, Homo sapiens
aactgctcaaacttgactctgaataaatccctctcccttttctcccccacctgatttaccaaccaggacagtctggtgactccttgaggacctgcctaaatggctggtgtccagggtgattgcatggccagaccccgtgtctgcaggcagggaagggtgaaacctgggactgaggacacagagaaagagaagcgcagatagacaggaagggaaagatggaagaggaaggtgagggtacaggaaaatgataacagagggaacacacagtggggaaaagagagaaaggcaatgagaaaggaaagagaacaattaagaagtttctgtgcatgttggggaaattgtgggaaagcagggagagagaaagaccaaaaacacaagtatttcagttagagaaaaggga

SEQ ID NO: 155681 - DNA, 620 bp, Homo sapiens
caagaaccctgcaaagtcactttagcaagaagcatcccctgaccctcgacatctgatcaccctccttatctaatccgttcctacactgtcccccaggtgaagatgtccggtcactgtggcctgtcttcagcaaaaatcctgttaattggtgtagccagaatctccctcacccggggtgtttcttcttagtcattttccatgtgctgacccagctcccaccgccctgctcctcagctatcatcagttcccacttgcccattcggacttgagcttaatctctctcccccactgcagaatctcattcctgtggtccctagacctagcaagacggtcctgaataaagtcttccctacagtgctttagcaaatgtcattcagtaattctttctttaacattatcagtgttaatttcctggttgtaatcatttttctgtgattgggtgcggcattcacatttggggtaactgggtgaaagacactagaattttttgttctactttttaaatcctttagtaaattgaaaaaaaaatttttttttttgagatggagtcttgccgtgtcaccaggctagagtgcagtggtgccatcttggctcaccgcaacctctgcctcctgggttca

SEQ ID NO: 155682 - DNA, 2757 bp, Homo sapiens
  misc_feature (1422)..(1422): n is a, c, g, or t
  misc_feature (1918)..(1918): n is a, c, g, or t
  misc_feature (2449)..(2449): n is a, c, g, or t
tttaacaggagaaaccattgatggtgcacctttggtaactttaataaagaacagtatttgtcctgagtgttgcatttaagtcttgtggaagtaatgaattgtagtgggaaaaaaaatttaaatttagtaatacttaacattttaaagtatcttaacagtgtttttccatacagaacttttatttccttgttcttaaattgtttctcaaaaattgtagcaaaggtgctctgcaggcatttttaatgctgaattgaaggatttcacattaccaagccccaaatgctgactgataggcagtcatcctacacagtagagaacattttagatcaaaaatgtgtttttttcttccagaagaaaataagaattgggaaatagaataagaaggtaaagataaattatagaaggcttcaaatgaggacaaggaaaaataatgacatagtgtgtttcggttagctttctctgactggaatgggttttccctttccctctgggccttggcccccaccgtctatttctaatcttctagtaaaaacaagctacacatgttacatcagctgctcaggataccttcaccctcacgtccttttactttttccttcctcactcactttgaacattgtgactcttgactgctcatcttgcctcccttccaaccagttatagacattctcttcttcaccatttattcttctctgtctctttatattgtgatcactcttcatcaccagttcatccttccattaagtgtatttactgagggcctactttgtgcccttgcccaacccaacacccctactctcatcacctctcatttgcaagagaagatgtggaggccatcaggtgtgggttctgtccatggagaaacccactccacccacagtcctctcctttgttttatagccaggctctaggaaaaggtggtctgtgtttagtctccatttttccccttcttaacccactgcagcctggccgcttcttccactgcctcactaaactgcaccaacaaataggagtgacctccttattaaaaaagccactgggtgcttttcattccttctcatttctgctttttctctggtgtttgatgctattgcagactcctttcttcttgagttctttcttctgtggcttctctggccgttatttctatctctccttggagggcccccttcctcccgctgcctctcaaacattggtatacctgtttgtcctgccctcaaaccttttctttttcactttgcatgctctctctggggttatcactcacctacacttacctggtcctagatctagaactcatatagaatcacaagttcaactttctattggacagcttcttctgcatgtctcacacacatccaaaagttgagaatttcaattacctctgcacactgaagtttgaacagccttcttttagggccnagtacaatgtctgacatcttgctctacctggctagctgcagtcagggaacttctttaagggaaacatatcagaatcaggactcagggtggcacagaggttcctcccgctgtcagtgactgtgttcatgcatacccagtaacaaaggagcattggtttaaaaaatcactgacttctgaaagcgctccagtaagcttgaaatgatttgctttgcttcttacgttgattatcatcagtttgaggtagcaagtagcaggtgcttgttcctttctttggaggtgaaaagccaaggcccagagagagtagacataatatgcccacattcaaaaagtgactccctaaggagtcagggcaaattcatttattcattcactcaacagatatttattgaaaacaattatgtttcaggcactagaaacagagtggtgaatcagacagatacagtttttggcataatgaggtatcctttttgacgatgcttcttatctcttctttgcncctattttttccatcctgattagtgataaatgataataattagcaaatgtttactataagccaggcaatattttaggactttacacatattaactcatttaatcatgatgacagcactatcaagtcattgtcgttactatcccattccacagagggggggaatgttgggcagtaggaactttctaaatgtgtcctacctagctcatactggtagtgataaggcgtgaatttgaacccaaacaatctgactctagaacccatgctgttagcgactgctttagctattctagctcttaacactgtaatacttgcttttgctcatctgtttatgatgctgtgtctgtgaagtatgacagggtagttctcagcatgccaaaattaacctgcagctttacctaacaaacatttggacttactttgctttcttgagatatttccccccttgggcatttcgttggcagtagtctcattttctaatctgaaatcaggagaaaaggaagaaaaacttgcaataaagcttaagtggttgtnacaggttgctaaataaaactggctcaactgaagttttgagattcttgagaaacactgagaatttcttacaaaggaaattttccttattataataggaaatcatgggtcattgcacagttataagtgtcttagtaaagagagaatgtggcttgaggctaagaagcctaaaatcttaatgagattatttgtgggctgctatttatgcataatttttaaactcttagaaaatatgttttctatctgtctttagtatgtcatcttaagtttccactgctttacgtaattttgaaaatctttagggttgctag

SEQ ID NO: 155683 - DNA, 867 bp, Homo sapiens
gcgggtggatcacctgaggtcagcagttcaagaccagcctggccaacatggtgaaaacctgtctctattaaaaatacaaaaactggccgggcgtggtggcatgcgcctgtaatcccagctactctggagtctgaggcaggagaatcgcttgaatccgggaggtggaggttgcagtgagctgagatggttccattgcactccagcctgggtaacagagtgagactccgtctcaaaaaaaagaaaaaaaaaatctgaaagctaccactttcctatttataaatatattcaaatttctggcaaatgaattccataaatataaagagtgtttgcatattcatcctcttggcttgggaaaaaatgactataacatcttgtgagtagaaatgatgaacctttggaaatactgcataaatcacttgacagttttcatttcttaccaaaaaaaaactatttgaacgatctgtgtacttaaatgagttattttccttcactaagaacttaaaatgttttaaagataatatttccgtctcgtctggaagtaagggaccttttcgattacttccacttacacaggagacacaggtactgtcaaatattgatagtaaaaagctaaatattgagagtggtcttaaaactctgtctacaatcaaaagtcttcagacagaaagaccaatcggttgtacataatatagaactattatcaaagaaataatgccattccatataattaattcctgagttttttctttatccttatgattaatttctagcactttaggctaaggaaacaggaatgaatatgtgtcaagatttagctaaaaagatatttgataagttatttcgatcattttctttttaatgaaaata

SEQ ID NO: 155684 - DNA, 779 bp, Homo sapiens
tacaaggttttattaaaattaagtttaacattaataacacactaatataaagataaaatttagcttctctggtataaaaatcatacaagaagcattattaaatataaaatggtgtttagctttctttggtctaaaaactaacaaaaataggtgctaaaggaagcattcattttactaaaggatcatagaagttaaagacttaaaacaaactttggcaattaagacaggataccaagatgcaaatgcctggatgaaatggatcaaatattccatctgcacgttaaacaaaagcaattgttatgcttgtgcacatggcagggcagaggctcagaatgtcccctttccactaggtggtcctccagtcgaccaggtgtgggctgcatggtagctcttttccaggattctacagcctggaataataagtcatgccaagctctctctgctatattccgaagtccctgggggcagccaccgagggccatccagcttccatctcccaacactaacttcacttcgtgtctctcacggcagggaggagacttagcattccttggagacctgaagggatgcagtgagcttaagaattttcaagagtttatcaatcagtcagcccttgctcatccccgagcggatgtgtggtggtattgcggtggacctttactggacttactggacactctgccgaataaccagaagtggcacttgtgctttagtccatttggctatccctttcaccctggcatttcatcaaccagaggaaaaaaaaaataagacatcat

SEQ ID NO: 155685 - DNA, 457 bp, Homo sapiens
gccgtcagggaagtaccgacaagcacacagagagggggccgtgtgggcgccgtcagggaagtgcggacaagcacactggagaggggtccgcgtgggcctcgtcagggaagtaccgacaagcacacagagagggggccgcgtgggcgccgtcagggaagtgcggacaagcacacggagagggggccgcgtgggcgccgtcagggaagtgcagatggaaaccacagcgaggcccctgcacactctccagggggctcagacaatcaaataaactgccggcacctcgagctgagcaggccgcggggtgggggcctcgtccacacccggccgagcaacgcggcagagccactgtggacagcttctcatcacagccaaaggtggcccagcagtcccgttcctgggtccttgctcaagagaaatgaaaacagaggctcacacataaacgcaaatgtttaccact

SEQ ID NO: 155686 - DNA, 1123 bp, Homo sapiens
ccctccccccgcactcctgcctcgccatttcccctccctggccggccggccggccttcttcgctttgcgcacgtaccttttgaggtaacggcccaaagaggtagaagcgcttttcccgcccggccgcggggcgtggctctgcgcgcagcttgatgacgacgttttggcgcggtggcggaatggcggcttccacctctgaagcgggcgacgctatgggtcccacagtggtttgctaagaaggccattttcaactctccattggaggctgctatggcgttccctcacctgcagcagcccagctttctactggccagcctgaaagctgactctataaataagccctttgcacagcagtgccaagacttgattaaagtaattgaggattttccagcaaaggagctgcacaccatcttcccatggctggtagagagcattttcggcagcctagacggtgtcctcgttggctggaacctccgctgcttacaggggcgtgtgaatcctgtggagtacagcatcgtgatggaatttctcgacactggtggcccaatgatgaagttggtttataagcttcaagctgaagactataagttcgactttcctgtctcctacctgcctggtcctgtgaaggcgtccatccaggagtgcatcctccctgacagtcctctgtaccacaacaaggtccagttcacccctactgggggccttggtctgaacctggccctgaatccattcgagtattacatattcttctttgccttgagcctcatcactcagaagccactccctgtgtccctccacgtccgtacttcagactgtgcctatttcatcctggtggacaggtacctgtcatggttcctgcccaccgaaggcagtgtgccctgccactctcctccagcccaggggggaccagcccctcaccgcctcccaggacaccaaccatgccctttgcttcctatggcctccaccacactagcctcctgaagcgacacatctctcatcagacgtctgtgaatgcagaccccgcctcccacgagatctggaggtcagacactgctccaggtttttgttgaaatgtggcttcatcactattccttggagatgtatcaaaaaatgcagtcccctc

SEQ ID NO: 155687 - DNA, 1036 bp, Homo sapiens
ccctccccccgcactcctgcctcgccatttcccctccctggccggccggccggccttcttcgctttgcgcacgtaccttttgaggtaacggcccaaagaggtagaagcgcttttcccgcccggccgcggggcgtggctctgcgcgcagcttgatgacgacgttttggcgcggtggcggaatggcggcttccacctctgaagcgggcgacgctatgggtcccacagtggtttgctaagaaggccattttcaactctccattggaggctgctatggcgttccctcacctgcagcagcccagctttctactggagctgcacaccatcttcccatggctggtagagagcattttcggcagcctagacggtgtcctcgttggctggaacctccgctgcttacaggggcgtgtgaatcctgtggagtacagcatcgtgatggaatttctcgacactggtggcccaatgatgaagttggtttataagcttcaagctgaagactataagttcgactttcctgtctcctacctgcctggtcctgtgaaggcgtccatccaggagtgcatcctccctgacagtcctctgtaccacaacaaggtccagttcacccctactgggggccttggtctgaacctggccctgaatccattcgagtattacatattcttctttgccttgagcctcatcactcagaagccactccctgtgtccctccacgtccgtacttcagactgtgcctatttcatcctggtggacaggtacctgtcatggttcctgcccaccgaaggcagtgtgccctgccactctcctccagcccaggggggaccagcccctcaccgcctcccaggacaccaaccatgccctttgcttcctatggcctccaccacactagcctcctgaagcgacacatctctcatcagacgtctgtgaatgcagaccccgcctcccacgagatctggaggtcagacactgctccaggtttttgttgaaatgtggcttcatcactattccttggagatgtatcaaaaaatgcagtcccctc

SEQ ID NO: 155688 - DNA, 1039 bp, Homo sapiens
ccctccccccgcactcctgcctcgccatttcccctccctggccggccggccggccttcttcgctttgcgcacgtaccttttgaggtaacggcccaaagaggtagaagcgcttttcccgcccggccgcggggcgtggctctgcgcgcagcttgatgacgacgttttggcgcggtggcggaatggcggcttccacctctgaagcgggcgacgctatgggtcccacaggccagcctgaaagctgactctataaataagccctttgcacagcagtgccaagacttgattaaagtaattgaggattttccagcaaaggagctgcacaccatcttcccatggctggtagagagcattttcggcagcctagacggtgtcctcgttggctggaacctccgctgcttacaggggcgtgtgaatcctgtggagtacagcatcgtgatggaatttctcgacactggtggcccaatgatgaagttggtttataagcttcaagctgaagactataagttcgactttcctgtctcctacctgcctggtcctgtgaaggcgtccatccaggagtgcatcctccctgacagtcctctgtaccacaacaaggtccagttcacccctactgggggccttggtctgaacctggccctgaatccattcgagtattacatattcttctttgccttgagcctcatcactcagaagccactccctgtgtccctccacgtccgtacttcagactgtgcctatttcatcctggtggacaggtacctgtcatggttcctgcccaccgaaggcagtgtgccctgccactctcctccagcccaggggggaccagcccctcaccgcctcccaggacaccaaccatgccctttgcttcctatggcctccaccacactagcctcctgaagcgacacatctctcatcagacgtctgtgaatgcagaccccgcctcccacgagatctggaggtcagacactgctccaggtttttgttgaaatgtggcttcatcactattccttggagatgtatcaaaaaatgcagtcccctc

SEQ ID NO: 155689 - DNA, 511 bp, Homo sapiens
ctagacggtgtcctcgttggctggaacctccgctgcttacaggggcgtgtgaatcctgtggagtacagcatcgtgatggaatttctcgacactgggtaggtaggttggtcaccggagagaggctgggtgattcctcatggtgattccacctttaaaccactctctgaatttcttaagattaagaaacaatcaaagcaagataattcacagttcatttgccctgtttttgtttgtttgttcaatttcatgttcagtggcccaatgatgaagttggtttataagcttcaagctgaagactataagttcgactttcctgtctcctacctgcctgtaagtaaaccacagtggcgagagtggtgctcggggcagtgggccttgcacagccctgtggtgatgggcaatctcctccagtcctctgagggcaaattgaggagcgattcgttccaggggtgtgagaggcaaaggaaatgggtattgcatgactgctacccttgctgtctgcagcttttta

SEQ ID NO: 155690 - DNA, 375 bp, Homo sapiens
agttgtctattttttttcctttttgttgcctgtgctttgggcgtcatatctaattaatcattgtcaaatctagtgttatgaagttttctcccatgttttcttctgagagtgtatggttttagtgcttatcctcaggttgcttacccattttgagttattttttggcgatggtgtgaaggaagggcccagcttcgctgttctgcacatggaatgagttcccagctctgcttgttggagacactgtcctttccccactggatggtctggcaccattgtcaagaatggtttgactagctaatgcttttttgcaggtttttgttgaaatgtggcttcatcactattccttggagatgtatcaaaaaatgcagtcccctc

SEQ ID NO: 155691 - DNA, 439 bp, Homo sapiens
ctcctaagcagttaggacaagtgtatgccaccgtgcccagattttttttttcttttgtagagatgggggtcttgctatgttgcctaagctggtcttgaacgcctgggctcaagcaatttgggccctctcggcctcccaaaatgctaggattacaggtgtgagccaccacgtccggctcctgtcaccttactttcctgtccactagcacagaacctgcacacttccgacgcgtgactctgctagttagcactgtgtattttaaagtacttttatgctcctgttgggcttcagtgtcagtgttgaaggggctagtaatttttgagctggcaatacgtttttaaagttattcttttgagtaacaaatatttactgaatgcttaccatgggtaagcctatttttcaggctgtgtgtgagatttaaaagtacacaactattcag

SEQ ID NO: 155692 - DNA, 387 bp, Homo sapiens
cttcaaagaaggacttgttgacccaactattgggagagctgtcagcagaaaatcttcagctgtcagcccctcgaagatcatcttggctgcagagtgccatctggcccaggctaggctcttcccaggacattacaactcctttccaggctagtgccagacaacagagatcctgggagttggctgagactgtcatcaggcctgcatctcagtttagttttccctgtgcccactcctgtttctttccagtacctcccagagtgttgatcccagggccactccccaataaacatactgcacactaacctgtcacagagtccacatccaaagaacccaacctgtgacagcaccaaatcaaaagagactcaggaggctgaggcaggactgctt

SEQ ID NO: 155693 - DNA, 451 bp, Homo sapiens
tatagggagtagggagcagttacttgaacctggagggatgaattctttatattagtcagagttcaccacagaaacagagacaactggatgtgtgtgcacacacgtagaaaaagagaaagacttattttggctcacatgattgcagaggcttggtaagtccaaaatctgcagggtagttctgtaggccagagaaccagggaagagtttcagtttgattttaaagatagtctgtggcagaattccctcttcctagaaggtcagtctttttctatgaagacattcagttgattggttgaggcccacccacataacagagggtgatctgctttactcaaagtctacaagtctactggtttaaatgttaatgtcgtctaaaaaatacctgcatagaaacatctagaataatgtttggccaaatatctgggtactggtggcctagccaatttgacac

SEQ ID NO: 155694 - DNA, 319 bp, Homo sapiens
agtgtctgttggaaagcatgaagatgacaaggctggtttagactggtgcgcaatctagaaagtcaggagactaaaccttctgggagcatgaacccatcagaggtcttgctagagggacaagttagggttaccagaccccaccaccagtatcggttaagggtgactataacaccattgctctggcatcccattgccctgagatgaatcttttaggatattgattatctaaataacaaaaaaaccacaaaacatgttcagcccctgatattaaaggtaaagaagcaccagtgaaagatctcaaaggcacacagtagaagct

SEQ ID NO: 155695 - DNA, 313 bp, Homo sapiens
ctgctgaatctggtgttataataatccacttaaatgatgtggctaaacactgcatttttaagacactaatataaaggaccatagagaccattatccagctcccatgttccccgtgtgaagctaggcccagagaaaagggtgtgccaatacacacgacccaacctcattcttaaaggttcagtgttatgacttgtaactgaacttagggcttaaggtcactaagatatctaacgactgtatttggaatcatcctagactgcagaatgtagattttaagccaaagatcatatgtatgttttaggtccctcactac

SEQ ID NO: 155696 - DNA, 688 bp, Homo sapiens
atacaattcgagctcgtcccgcattcaatatatgaacgcaggagtgggagtggaacccagggagtgggtgatgccacgggctgattgaggagtccaaggatgtcgtcttggaataccaccactgaagggctgggtagaggaagagatctgaaagggaaactttgaaggcaaatgtatataactcttcaggtaactagatggtaaatggaaagagagagagggcaggagctggaagttgcagagtggagagctttttgtatttttctgggggatattaagagtatttatagactcctttttatacctttggacaatgattccgagccagtcttgaatgaaaacattcatatgtgatgtgttgtaaacctccaggacgatcggtctcacatttcattttgtctgttctggcttctgtacacagcagctgcagactatatgtgtttttgaaacctgtttaacttcctttcttttgtgttctctaattctctgaaatattatttccaacagccctaagattgaaattaagagaacgtttgaatcttagctgcattctggcattttcaagtgcttcctgcacatttccccttggatatcccatcattgtccaagattcagcatgtccgagacttgctcctggccctttcattctggtgttacctctagaccgcttaccggtcccgagcgtgac

SEQ ID NO: 155697 - DNA, 872 bp, Homo sapiens
gctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccagcctgccctcaggttgtgaccatccacctcccaaactgccctggaatctgcctacggcctgtccactgccctccgtacccctgcctgccatctctctggtttcgcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcctcctcatcataatccccagcactgccaccctcaaccccccagcgctgaccactggaggctgcttctaaaacttcagccctgctctgccagcagcgcccctggggggtcttcgtagccctgttgcccatcacgatcccttttctcatgcagtccaggctgcaagcccccgccgagggcttgggctgacttgttgtgtagtcagtgctgtgtctctgcacccagccagaagtggtgggacagccccccggctgacgggctagaacccatcatccagggtgtgtggaaagagcacatctcccccccgacgccagccactgggtaatacattcccaggaatttccagtgcccagccccagctgagaaacaggtcttctggaaccctccagcaccctcatcaggggttcccagc

SEQ ID NO: 155698 - DNA, 594 bp, Homo sapiens
cttgtggaggggctggagccattatggtgagggaataggtagagttggtacggatgccttaacatggatggtctatgttagggcctgaagggtggcatttctgagactgagaagttctgaagtaacaatggagtcaagttactggggaaagagaaccgctatactatgaatagtccatgagtgataagtccacgagcctcaagattcagcaacatataaggcaagatgtgaaaccacagctcagagttcagctgagccattactcttctggaatttatctgaaccaagcaagagcagagcaggtagactgggggccattttcccaaatcaatggagatagataggtatctctacgcacctaaagtagacctgcattgggaaggggaatgatgggacaccctttgagatgggttcctacaaatccattctcccctacaatgagtttataggaaatttaagtttttctgagattcgtttatggagaaataaggaatctgtattctattctttccaatatgagtgggagtgtatacatcatttttttacacatacacatacacactcattcaaatatgaaaactaagaaaaggaaat

SEQ ID NO: 155699 - DNA, 295 bp, Homo sapiens
catacatactatgtctcttgccgatttacgattttgtgttctttctctctaactccagaggttgatgattattttacagactgtagtagaagctaggtatattgttgccttctttcacccactttttttttttttctgtcacccaggctggagtgcagtggcacaatcatgcttcactgccatcctgggcctcctggcctcaagccatcctctcacctgagctccccgagtagctgggactacaaatgtgtaactgttcttctttttttttttttttgttgtgttttcgaagaga

SEQ ID NO: 155700 - DNA, 534 bp, Homo sapiens
caggatttcacagaagaagtggttgatttcatgaggcccacagaagggcagtcttaggatgagaaccacatggaccagagccaggagggagccacacgtccaggaagtgacggccagggtgatgcagactctccaggtcatgattacggagtatcggagagggtggcagatggccacctcccgaatagctggggatgtaggcacacgttgccatgcccggctagataatttacaaaaacactttctaatgttcttcaattgatgaaccatcaacttaaaagttttatccattgtttttggtttcaccatcctgcccgtcaagaggctcctcctccgtctctgacccttggagtcacagttccttcttgctaccacctcatctcatttcacgcaccagtataaaaaaagctgttttttgtttgtttgtttgtttgtttgtttgtttttcccccagctttaagtacttttctgtctggagcccaatgcctatctttggctagagattgaaaattgcttttcatctctcctcctctt

SEQ ID NO: 155701 - DNA, 365 bp, Homo sapiens
cacctaggtaatcagcccagcatccattagccattcctccagatgcatgtgtgttttttattgtatgatttcctgagtgttctttatatggttttattgttttcatttctttgagttggatttgctgctctcttatcttgattattgaaatggaagctataacattgtcagtgcttctttttttataaaacatcgtttctttttgagtactcttttaggtatattacacaatatttcatttgttatatttttatcattcaattaaaatatttttacattctactgagattattttttaacccacactttatgtggaagggtatcatttaaacttatttaggaattttctttttttgacttttatt

SEQ ID NO: 155702 - DNA, 541 bp, Homo sapiens
ggaaaggccaagccaggcttggacctgggtctctactgtactctttactctactcagtcttttccaaggtggaaataatattttctctgaggctgatgtttttctgtttgttttgcattttggtaaattcatcaacatcaatatcccctttaatgctcacaaatgcccttagaaccagcttttattgttctcattttgcaaatgagaaaatggaggcttcaagagttgagtgagtttagcaaggttttcaactcttcttgggcagagcattagggttgcagacagttgggcaccctcttcaaatgaatgtgagccaacgttggccctgttgggtgtgcaaggagttcttgcagagttgatggagaccctgtttcgagtcacatgaataattaaagcgactattaaaattttctgatcttgaacaggattgtgagccaccagcacagaatatattagttctgagtcttcaggaaatatggatacgtatttgtataaatacataaaagtgtttcattccaaggctcaggtagcattcacattg

SEQ ID NO: 155703 - DNA, 587 bp, Homo sapiens
ggcagcttcaaaatatgactcaggaaagaatgtgacatggtaaacttagaaatcttagtaaaagtggctcagggctgggtgcggtggctcatgcctgtaatcccagcactttgggaggctgaaatgggcagatcacttgaggtcaggagtttgagaccagcctggccaacatggggaaaccctgtctctactaaaaatacgaaaattagccaggcatggtggcacgtgcctgtaatcccagctacttggcaggatgaggcaggagaatcttttgaatctgggaggcggaggttgcaatgagctgagatggtgccactgcactctagcctgggtgacagagccggactccgtctcaaaacaaacaaacgaaaactgaaggcagatctcatttgctggagtgttttgaatgaggattattatggtgagaagaggctggagaggtaggcaggagccaccttgcaggtcttagtccatttaatccgtgttaaaaattcagtgctttagcccaagaaccatggcagtctttcaaagggctttaagcaaggaggtggcctgattagtgtctccttgtgtaggaggatcatgcc

SEQ ID NO: 155704 - DNA, 440 bp, Homo sapiens
tttgtgagctcactgtctgtttctaaacaaaccattgggctgtgctgtatttggactaccaccatatttccatttcctcaaatcgaggaccaggggccatgtgtctggagctcactacgggaatccagaagaacaaactctgctttgattaaatcatagtctgttttaatgagttttgtaatcctttgcattcatggtataagcatttcaaaaatagccaagattaaagattccatgctgtaccagagagactagaactaccaaacttgtatttcaaaataaatgttgtagacaataacagaagattttgtggtaaaaatagggaggttctaaagcagcttttccttgcaactcaagacattgaaaatccttaaagctagtcttttggattaacgttaatgaaaaacatgtatgttagcgctttccctcccagtatcttt

SEQ ID NO: 155705 - DNA, 345 bp, Homo sapiens
ttgaaggagtttaataggatccctgggttcaacccacaagctaccagtagcacccctaccccatcgtgacaaccaacaatttcttcagatattgataaatgtccccaaggggccaagtttttcagaagcactgcatgagatgctcccgggggtctcttgagctctaacattccacatttctacttctattagaatttcaatcagttgacatcctataggagaacagagagtttggtgatactgtttataccaagaaacagacaaaatcttgtggaaaccttccctggggcttactaacctcaccgtcacaggcttgccaacctcatcctcatcctcatcttcatc

SEQ ID NO: 155706 - DNA, 571 bp, Homo sapiens
agctgctggataaatatttgtggatgaaatgaatatgcccagctcatgtatgtccctgtccccaaatccacatgcctttaaaaataaagcacctaccttcaagggggcaggcagagaggtaagggcctttcatacgtgggttctgggggatagtaacatggtaaacagatggtctgcacagagctgtcctgacccaaggtacagagtgccagaaacagctggaactgagatagggacccaggccttctctaagtcaggccatcctccagcccccaaggtcaggtccatggtccagttctctctgaaattcaccaggctgggtctaactcaagccgctcccatggatcggggaaggtgtttggagtttcctttcccctggggttaccagcagagtccctggagggagattctagacaactgagcacaggaggaccacggggagatagggaggagaccccatgcctttgctagcgagcatactcaagtctagtttcaccatccacatgtagggcccctgagtaaatttgtaaaaggcgccctcttctggtggatacagccccacaggcccagg

SEQ ID NO: 155707 - DNA, 218 bp, Homo sapiens
gctcctctgtgggcacagaggaactcttctgtgtgggtggggggacaccttgcaaagtgctggtgtgtgagttacacctatggatacttatcctgtgaccctcagcagaaggcaggatagagacttctggttcacagaagagggtctgagagccaggggggtttccagcaagactctgagagcatggagtcacacaagatcacatccgtactggcccg

SEQ ID NO: 155708 - DNA, 415 bp, Homo sapiens
cagctgcgaaccgagaggaaatcgagggaagagagattttggagcttgaatttaaggtaagtttaagctttttgaagtctattgtttttataggtatcacatttataggatcacatttgcacaagtgatccagtatgctaccctaaattccagacctttccttgagtagtaccttttacttctttggaagtgagctagaaagtctcaggatgtcagcagccagggaataaggaaagctgaactgggtctgcagatggagagatgcagaaagacacagagagcttgatctggggccccaagcaaagaacttggccaattctgatggtcagatagaaaatggtaaagaaaatgaaaatcacaagccagatccagatggggaggatagataaagaatatgaaaagacggactcgagga

SEQ ID NO: 155709 - DNA, 263 bp, Homo sapiens
cccatatcaaataaactatcatcagagtaaacaacctacagaatgggagaaaatttttactatgtattcatctgacagaggtctaatatccagagtctacaaagaacttaaacagatttacaagaaaaaaagcaaaaaaacaatcccattaaaaagtgggcaaaagacatgacagactgaaatggtctaaaacacttatagatggagttccaggagaggagagaaagggacaaaaacaatatttgaagagctactgctactgc

SEQ ID NO: 155710 - DNA, 427 bp, Homo sapiens
ttagttcctagtccattcatgtttctccttttctgatggagttatggagttgcagatatttttcttatctttactttaacccacctggctatattcctgtattcattctcgcgctctctctgtctctctccctcactgtaagctgcttcaattcctctttagaagttggtagctgttagatttagggacagatgactcacttggtagtgtatctcagtgggcaaaggttacttcatcttttactttgaaattttatttctttttgacacttctcttcatctctacttgatatttttttctcacctgtgtcctttatcagttagctctgagaaaggaataacaaaaaattaatgaaaaaggacaacacgtctgtcaatatcctgtgtttttttagctcctctgagagcattgctgttttgctgaaggt

SEQ ID NO: 155711 - DNA, 228 bp, Homo sapiens
cgtggttgacatgacagaaccaactagcagcacataaagtcacccactaaatgtcacatcagtgtgcaggactgagccatggaattattaaagccagacctacaagtggagtgggctcctttcaggtaagagcataaagggctgaacacttgcactgttaagtatgatctattaaattttctgaaacctaccgtttttgttgactcagtagatctaaagcacagagct

SEQ ID NO: 155712 - DNA, 315 bp, Homo sapiens
ttcagaggaagcggcactaatgattcacagctccctgatgaggctgcattcctaagtccgggaccaagaccagcgaaggtcgccgtgctgactgctgctgcacttccaggggagaacaccctggcgatgctctccttcctcactggggacagaggggacgtacacggcacccaaagggacggcctgaaacaggaaaacctgaaaacagccctgactctgggtgggccactccagcccaaggctctcctcccctcctgggagggccattcctactcttagcttagtcctactgcacacaggcgtgaccccaaacac

SEQ ID NO: 155713 - DNA, 580 bp, Homo sapiens
aggagagcagggaggacagctaaagctggactgtaaagggccttgaacactacactaaaggaactgggagtaatagggagcccatgaaggtttctaggaaggtgagtaacatgatctgattttagaagatccatctgttggtgataaactgcatcaactgctgcaaggttaaaaggcaatcacccaacacaaaaggccagtggatttggtaactaaaatatctgaaggtgcactgtcacagtgctattgcaactaagtggaaggagattaagtatcgactgagtatcgcttaaccaagatgtttgggagtagaagtgttttagatttcaaattttttcagatttgggaatatttgcagatacaaaattatcttgggtataggacccaagtctaaacattaaattcatttatatttaatatacaccttatatacatagcctgaaggaaattttacctttctcttagggacacggaatcaattctatgttgcatgactgcattttgactgcatttggaggtcaggagtggtgttttccacttgtggtgtcatgttgtgatcaaaaagtttctgatttggatc

SEQ ID NO: 155714 - DNA, 184 bp, Homo sapiens
tgagcccctgaccctcaactgtctcatttataaagtagaaataacaggtgctccatcagatatgacataatgtatagatagcagttagcatgagctaggtacaaggtagagaaaaagagaagggaggcggagcttgggcgcctggagtggaagacaatgaagagaaggtttctgaacagaggag

SEQ ID NO: 155715 - DNA, 400 bp, Homo sapiens
ctgccttagcctcccaagtagctgggactacaggtgtgaacaccatgcctggctaatttttgtatttctttttgtagggatgggttttgccatgttgcccaactcgaactcctgagctcaagtgatccaatcctcctgtcttggcctcccaaagttctaagattacggtgtgagccaccatgcccagcctttttccagttgttttaaaaatgtatttttacaggtggactgttcaaatcacgatccaaacaaaatccatacattgcatttggctgttgtatctaaatgcatttttaatgggaagataaagtagataaaaattttcagtgttcattgtcctgtaccatgtattatcattaatttagaataaccgcatacaacagaaacatcccttatcaag

SEQ ID NO: 155716 - DNA, 474 bp, Homo sapiens
tctcccgtccctaaacacttaggtgagcaaaacagaggaagaaatcccgaacctctgaacctgaactgctgtaagaaccagcagttggggtggacaaatctccacccacttcccactgtctccaagagatctgaattgccatctaagaatgtctgaaaccaaactcatcattgtctcttttaaaaagtaagccctcttcctgccccttttctaactgtgagtggtgtccaaagaataatccttgccccactgtattctcaccaaaacactgccaaataacccaggcctatcacgtttaccttcataatctctaccatccatacgcccaggtaagcatgcctacctgggcgtatggagacatatcatataagtaatgctagggtgagtggcaggaagttttttcataggaggtgtatgagttggtcatagcggaatcgggggtatgctgttcgaattcatacgcccaggtaggca

SEQ ID NO: 155717 - DNA, 427 bp, Homo sapiens
gtggttggactgtaaacatcctcatgggccatatgaaagagcccagacaccatcctaagggtaacagaaagcagaatggttttaaggcgagggatgttttcagatgtacatttttgcaacaaccactctggctgcttttgcatgtggggggtgtgtgctgatgtgtgctgtgtgtgcagtgatgtgtgctgggtgagtgctgacggggtgctgggtgtgcactgtgggtgtgctgggtgtgtgctgatgtgtgcgggggtgctgggtgtgctgatgtgtgctgatgtgggcacgggggtgcggggggtgtgcggatgtgtgcggggtgcggtgatgcgtgcggtgggagcgcggatgtggtgcgggggtgagtgctgatgtgtgctgtgtgtgctgtgtgttccagcgtgtgtgtgcttcagggtgt

SEQ ID NO: 155718 - DNA, 241 bp, Homo sapiens
agttcaggagagcaaaaggcagaatcatatgtcaagaaaatcatgatcctagtcactcaaacggttccaagcctcagtttccagcaaaagttacaccatcttggttccttcaatatctttcatactgctccttattcatctcatttgttttttaaagtgggtttttctcttttggtcccttaggttgtatttcttaagatttacttcttgatccccgagaacagatactgaagttagagag

SEQ ID NO: 155719 - DNA, 153 bp, Homo sapiens
ccacgtctgacaagtccatatctaaggaaggtcactccacagattccacttctggggcaggtggcaggaaaagagggacccgaggcacaagaatgttgattcatcagccaggactgggctgggagacaggcccaaatcacatgagtgattgag

SEQ ID NO: 155720 - DNA, 301 bp, Homo sapiens
acactctgttcaaatattccccacccaacattactccctgtctttgccgccagtcttgagcaggtatccttgattttcactacacagaaaaaaagtcatcagtagaactcgaattttaacttctgccccttaaaacctacaatgtcactttgcatatgcacccagacagagagcaaagaggcaggtttccttctgtagagaaccagtctcccaacaaacatggaatcccattcttgttttccagcttctatttttcacctttccctctctgctgactcaaatacaacagcatttaatacac

SEQ ID NO: 155721 - DNA, 161 bp, Homo sapiens
ctgctctagaggttcccgagagggtgggaccacggggtaggccttgggatgtggacatttgagaataagaaactcccaatgcccgcgagcgctcttgagaaggagaacagcccctcttattagaagacctcacatgaggcaggcgcttcacaatatttttt

SEQ ID NO: 155722 - DNA, 846 bp, Homo sapiens
agctccctgaaagctaccgccattgaccagatttctatcagtgcatgcagtcaagctgaaacaagttatggattggggaaatttgaaaccaggccatctgagtttgcagagaaaacgacaaacggccacaaaacagacccagattgcaaactatctgactcttgtggctctatcagcaaagctgatcattctgggagcttggatcccactaataaaggagatgcaagggaaaagaagcctgcatctcctcaggtagtaaaagaaaaagagtctactggcactgatacctcggatgccaaaaccctactgctcaatcctaaatcccaagaaagtggaggcacagaatcagctgctaatcctacaccctccccaattaggaagaaccaggagagcaccttagaagaaaacagacagaccaagacagccaccagcctgagcctgccatctgatcccatgggtgactccagcccaggttctggcaagaagaccccatctcgctccgtcaaagccagcccacgcaggcccagccgcgtcagcgagttcctcaaggagcaaaagttaaatgtgacagcagctgctgctcaggtaggactcactccaggagataagaaaaagcagcttggcgcagactccaagctccagctgaaacagtccaagcgtgtcagggacgtcgtgtgggatgagcagggaatgacctgggaagtgtatggtgcatccttggacgcagagtccctgggaatcgcgatccagaaccatttgcaaagacaaatcagggaacatgagaaattaatcaaaactcaaaatagccagacccggagatccatttcctcagatacttcttcaaat

SEQ ID NO: 155723 - DNA, 173 bp, Homo sapiens
aatgaaaaagttatttctaggttaaaatgcaaactacaactatttgctacacaggactatctcctgcatgtggaggaaagctgggtcatggtcatttcaagatggtgggatctgctctgctttcgttcaaaccttttcttccattttcctttttgtgttcatccctctccacc

SEQ ID NO: 155724 - DNA, 419 bp, Homo sapiens
agacactgggtccatctcccttcgtcatagttaaactgaaaccttaggccgagcacagtggctcacacctacagtcccagctatacgggagactgaggtggtaagatcacttgggccaggagttcgagcagcctgggcgacatagcgagaccccatcaggaagacggacggatggaagggaggaaggaaagaaggacggaccagccgggcatgatggcacacacacatagtcccaaaaggctgagggcaagagtactgcttgagcccagagttcaagaccagcctgggagatacagtaacatccccacctccaaaaaaaaacaaaacaaaacccaatctctcttacccccaaaccaactccccttcctgactttcctgtctctattaatgacaatagcatccttctagtttcatttgag

SEQ ID NO: 155725 - DNA, 117 bp, Homo sapiens
taccaacctattttatccagggcaaatatttagtcgccttatcttgtatgataaatttcaagcctatgttcaatatcacgtctcctaatgtgacttcaaccacattcccactgagtg

SEQ ID NO: 155726 - DNA, 376 bp, Homo sapiens
cccagctccctgcactgtgcccagggcttccccttccctgtgggactccagccactctcttcccacgcaagctctccttggcccttctcccttccagctgcccactccaccccagggtgcgcttctgttctctcctaccaacaactttacttactttcttctaccagttcctctttgagtagtccttttccagaagcttctctactctcatcctcactccctgcctttggcattctgttcttttctctcatatcctttgtctccttcttttgttcctttaaactttccctgtcacgtccatgcagacaaggttggccaatgacaagagggcagccagtgacattcatggcttgctctacctcagacacatccagcc

SEQ ID NO: 155727 - DNA, 762 bp, Homo sapiens
ataccaaagcttgctctgtgaaaattcccgcataaccactgaagtttgcgacaccctaaccctgcacaccttactcctggtatcagagagcccagttgaacataaactgtgtagaggtgttagactcagtctaccctagtaggcccaacctccgagaccaaccttaaacatcagtagactgcgagctgtatgtggataggagcagtttcgccaacccctgcaaagtgactctgaaaaagacgacaagccctgctccagtcgcacccggaagctgactggtccacgcacggccaaaacatgaggaaactcatcgcgggactcattttccttaaaatttggacttgtatagtaaggacttcaactgaccttcctcagactgaaggctgtttccagtatatacatcaagtcactgaagtaggacaaaagattgctacagtcctattattttatagttattatgaatgcctaggaactccaaaaggaacctgtttgtataataacacccaatacaaagtatgtaatccaggaagtgaccagcccgatgtgtgctatgacccctttgaacctcctatgatcacagtctttgaagtaggactgagaactggtcattctctaagtgacacaagtaaagtaatagctagaacagaagaaaaaggggtcccaaaaatgtaaccttaaaatttgacgcttgtgccactattgatagtaagcagcatggaataggatgcggttctctaaattggaaaaaaaagttacacggta

SEQ ID NO: 155728 - DNA, 477 bp, Homo sapiens
gaaactggtttagggattatctctctatgaattttcttcaagctaggtaaatatttttgttcccttgtttcaatttccctggattttgttggaacatcatttttgttgtatatctcacatgcagttttgattttgtttctataaacttaaaaaaaatttaaatcggccaggcatggtggttcacgcctgtaatcccagcactttgggaggctgaggtgggcagatcatcaggtcaggagattgagaccatcctggctaacatggtgaaaccccgtctctactaaaaatacaaaaaattagccgggcgtggtggcgggcgcctgtagtcccagctactcgggaggctgaggcaggagaatggcatgcaggagaatggcgtgaaccctggaggcggagcttgcagtaagccgagattgtgctactgcactccagcctgggtgacacagcaagactctgtctcaaaaaaaaaaaaaaaaa

SEQ ID NO: 155729 - DNA, 558 bp, Homo sapiens
taaacagtggttattaggaggaaggtgggaagtagagaaaatggaagatgtagttcaaatgctacaatgtaggatgaataagtctagagatctaatgtacaaaatgaggactatagttgataattgtgtattgctttggagatgtttgctaaatgagtagactgtagctgctcttgccacacaaaatgtgagtgccacacacgatgtgagatgatggatatgttaatttacttcactataggaaccattttactatctatatgtatttcacaaaatcatatgctttaaatatacacaataagaattatttttaaaagatttcggtaccccactttcaataattgataaaacgaagactttagcaacactatcattaactgatatttataaaacactccactgaatgacttcagagtactcattcttttcaagtgcacatgtaacattctccaggatagactatgtgatagagcccaaaacaagtctcagtaaaatttttaaaaagattgtgattgtacaaagcatgtgctctgaccacaatggaatttagagatctat

SEQ ID NO: 155730 - DNA, 587 bp, Homo sapiens
agggacaaagagtgtcatgtggcatggggccaatgccaggctgctcctggctcatacctggccctgcgaagatgctcctggctcacacctggccctgggaggatgctcctggctcacacctggccctgggaggatgctcctggctcacacctggccgtgggtggtggtccaggctcacacctggctgtgagtgctggtccaggctcacacctggccatgggtggtggttcaaattcacagctgaccgtgggtggtggtccaggctcacacctggccctgggtggtggtccaggctcacacatgaccctgtgaggatgaccctggcttacacctggccctgggaggatgatcctggctcacacctggccatgggtggtggtctagacccacagctggccgtgagtggtggttcaggctcataccttggctctgggtgctggtccaggctcacacctggccctgggtggtggtccaggctcacacctggccgtgggtgctggtccaggctcacacctggccgtgggtgctggtccaggctcacacctggccgtgggtgctggtccaggctcacacctggccctgggtgc

SEQ ID NO: 155731 - DNA, 381 bp, Homo sapiens
attttccctattgttcataattatttactggttagatgtttgccctttggccatctggccctcaaactaggcatggtctctgcatttttagcatctagcatatgtatgttcctacttcacaaacaaaggtttgaaggagttgctggtgtctgaagaccctcatcagaagctagcaatgttatcatcatttgctgcacatttgacggtgtaccagcctttcccctacttccttttaacatctgtattttctctgctgccttggaggcaagggatcggactccggcactttgcctgcttagttaaattaattgtttaaaaataagtgaaggctgagtgctgtggctcacacctgtaatcggaacactctgggaggtgaggtgg

SEQ ID NO: 155732 - DNA, 146 bp, Homo sapiens
ctggtgggtgagaaccagtgccacatctaagccctgtgaaaaggcctggcagcgtcaggctggggagcaatgacaacaaagccagaggtgggacacagactggaagaatgttttaaaagcactgaatttttcagaaaaatccatca

SEQ ID NO: 155733 - DNA, 351 bp, Homo sapiens
atacgttaattttacgtaaaacaagggatttgactttgactcatttccaaaaggccccttgcagggaaaattgtcttttaaattgttttaaataatctcattttcagcaggaagaagtagaaaggataaaatggatcctgcaccacgggaacctcacagcacctcactccttgtggcttttcctgtttgatactctgctttctgaaagatgcaattttctgcctccatttctgttgccgacgtgccaggatttctagcaaagtgggcctagagttttgctggaggttacttttccttggaagcaattcaaatacaatcatcattctgtttctcccttttcattcgacattt

SEQ ID NO: 155734 - DNA, 274 bp, Homo sapiens
tacagtatgtggaatttccacgcaagcacggctccctttcctcggatggctgactctttgtgctgctgtggtcctgcatgttccaggagcttcacccagtgaggaccaggctgggagagaggctgcaggccatgctgtgcctccctgtggacactagggggcagaaccatccctagcccaggcagggttggccctttgcacagagggtgcattctcacaaaggaggcggtggcccaagaaacacctgcactcctgtttgcttttcatttcatgc

SEQ ID NO: 155735 - DNA, 240 bp, Homo sapiens
ggtgcctatctccccagctggcctgtgggctgggtgcctggcagatggggctcccagggaggtgcccccatagacttgggctccacagcaggctgtggggctggcattaatgtggctgggagagcctggctgtctttttagccatttgtttcggaggccctgggggtcatacttgtgcttcctcgtgtatttttagatctcttatcaccgtacacaccacctccctatcagagggctgtc

SEQ ID NO: 155736 - DNA, 752 bp, Homo sapiens
  misc_feature (122)..(122): n is a, c, g, or t
gcgggtgttcggctacgtcactggggcgctacggttcctggagctgggcagtcttctcgtcagagtggggactggtaagagcgacctccccgccaggtcctgtgtgttgccggctgaagaanggatgatgattattccccaccttctaagagacaaagaccagcgagccaccacagccaccagtcccagaacccgccaatgctggggaatggaaaatgagggagttcaactctggccctcacaatccagtggaggagacgaaactcatctgcctctgtccctctgggcacacctcatgccaggtgcatctgtggacaggggccatgctcctgggcttccaaagttggagaaagctgccaggctcagacccacctaagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatcccactcagcacccatagtccaggcatggggacctcaacacacctgagccccagacatcacctttcattgtgagtagctctgagatgacacttctgctgttcccaattccagcattaattggattagatagttattttatgaagaattttcatatgccacaatcctgaccatatcttcaagtgaacagaaaaattctattaaaaagtcaaccttctgtc

SEQ ID NO: 155737 - DNA, 360 bp, Homo sapiens
tagttgggattacaggcacctgccaccactcccggctaatttttgtatttttagtagagacgaggtttcaccatgttgaccaggatggtctcgatctcctgacctcgtgatccgcccactgtggcctcccaaagtgctgtgattacaggcgtgagccactgtgtccggccaagatgtctttttaagattgccttctaaagcatttctgtttgtggacacaaggtgacgatcagttcgtgccgtcagagcctcatgccatctgttgagcaaatggatggtgcatgaccaccgggttcttccagctaagcccccaaggcatacagagccgggtcagctctgctcccagtggcactctgacgg

SEQ ID NO: 155738 - DNA, 317 bp, Homo sapiens
tcccagccaagcccccccgccccaaatgctaaacgttcccagtgatgctttagacaccaagtgttacggaacaggtaatccaccacttttcacagaaagctttttagctcctaactaggccactgtacctgatattgggaaacgtttttgaaggatatcaaggagatggaggagttccaagggagagcagcatgaatcgcaaaggtccgggaaggtgagcccacatggaaaggtctaggaggttaacttaaaagacctcagagcattgagtcatgagattgaaaagggggcggcccctggctcggcgggtaccgagc

SEQ ID NO: 155739 - DNA, 369 bp, Homo sapiens
cagatgcagaagctgaggctgagagagggtaaggagccatgagatgcaggactcagtccagactgtctgacccaggagcacccagtgaccaagcacactgccactccctggtgtctcaccgctgtgtccctggcttgtagtaggggcccatgtttgatgagtgaatttgtgagtgaggggcacccaagagcaggcagacactgtttttcacccatacattgtgcctcattaccacagagtttgttgtgcctcatgcattgtcactagggtaggggactttgcacagctggctacccactctcccccatgaccagcaccctcatttcagtatgacctcccctgattcagtcacctgaagaacagagcagc

SEQ ID NO: 155740 - DNA, 523 bp, Homo sapiens
gttttccacaggcaaacaaatcagctctgttgcctgggcaacacgtttctttcctgtgttcatccagttccagataggggtccattttaaccataagtaaagctatgtagattatatcccctaatgaatgatagagattttatcaaatgtgagtaatgaaaattgcctctaggagaaattgctctttatagagcaattgagtttagggttgagatgcaggattacatgaacataatctctccatacctattgaacattcattaggaaacattctctgagcacataagtaatgtgtgatgtatacagaaagatacagatccatgctctccaagaattcatggtaagagggggagatgagcaagaaaataaaaaggggaaagctgataatactttctcataagaaaatgataagtattctgttttcctattacaacgggccacagtggtatgagacagttaattctcatctctagcatgtggtctactcaccaaagccatgtctatatatacctgtggaaaagta

SEQ ID NO: 155741 - DNA, 710 bp, Homo sapiens
ggagacctctcctcatctgtgcatggacggatgaccaactctggggcccaggctgttgcttcccagtataatgatgaatccgccatagtctggtgagtgtagaggctgactctggagcccaggctgtaccttctcggtctggtgatgaatcctcaatcgtgtgatggagtctcgctctgtcacccaggctggagtgcagtgcagtggtgcgaactcggctcattgctggatcttacgtgtgaagcactctccccaccccgctggtcatgtgaagatgtgcttgcttcccttttgccttcaaccatggttttctgtatcttctaagaggagcacttaggccatttacagctatgactcaaacagacagctcagcgtatggaggcttgcattaggaattttagttccagaacaacttcaggaataaatcaggaatcctgagaggacccacagaccctctgaaggaagtggactgcttgtacaggacccaggagcaccccaaatactctaagaggcgggtaacctggagcaagttctcagctctgcttgcctactgtctggaaacagacttggcgctgttcggaaggggcacggtggaagtgagaccagcctttcggattgcgtgggagctgggttgaccataaaacagcctcaggcgggtacttcagaaggtattccagaagaaggcattgagctatcacaggaaatgatag

SEQ ID NO: 155742 - DNA, 176 bp, Homo sapiens
cgaagtcatatcatgtgcgagggccaaaatctcccagaatcttcaggaaggtagcacatcaccattaaggagacatgtgctgatatcctctggctcctctgaaatcatctggtgatagcactagcgctcactagggaccactaaattcagctgtgcttttgcaacaacgataataa

SEQ ID NO: 155743 - DNA, 420 bp, Homo sapiens
tgcacaaccacaccaccacatacatacacacctgcctgccattcttgaaataactcccagctcttatgtctagtgtcattatcattggcatactttcaagtgctgtttgaagccacctcttgcctgaaagtagactcaatgcagaaaggtccccaataacacggcattcctaagagctaaactagagtggtggtcacaaaaatctacttagagagggacagaaagaggatgggcaaggtggctggagacgagagaattatgctgtctcatgcgcaatttattttcagagatgctaaactgtcaggtcacaaagacttgtaggaggggtggtgaaccaacatttatcacagtggtgagagcgttaaccctttctttacaatcacctattttaaacgcatgtaaatactgcatgcgtggcat

SEQ ID NO: 155744 - DNA, 183 bp, Homo sapiens
gatctgtagatgcttgaactcaatctgtccataaatgagctcatccatctgccctcccaaacctcccaggcttcctttcactgagtagcagccagatcctcccagaagtctgggcactgggcttgatgtttgcctctccccattcaatcaactcacagagattctcctcctcaaccgccatac

SEQ ID NO: 155745 - DNA, 349 bp, Homo sapiens
tgatttgaaaactttatcaaaatccaatcaaatgtcaattaaccatttaattgtggatgagtaaggagactattttgaccaaaacatgttagaacaattaccacttatagaaataatctatgttttaatgttttagttgaattaaacaatcttttatattctgtccaggcacagtgctgggattacaggcatgagccaccatgcctgaccatttttaaatattaatttttatgaaatattttcaaacacattggaaaagtcaatcatgatttgaaaactttatcaaaatccaatcaaatgtcagttaaccacttaattgtggatgagtaaggagactattttgaccaaa

SEQ ID NO: 155746 - DNA, 279 bp, Homo sapiens
ggctgcatctgcatgtgtgttgggggaggttggtaagatgctcctctcaggagcgcagtggcagaggaggaggccttagaaaccaaggccagaatgtgaagggccttgcaagctggggaaggggatatggactctgtcctggaaaaagagggagaccatggaggttgccagactgggctgtgaccaggtcagagccctgcagcttcagccgtgccgaggcctggcggagagaggctgaggctgggagtcaagggggaggccgggcagttgttgcacgtg

SEQ ID NO: 155747 - DNA, 219 bp, Homo sapiens
aaaatattttaattttttccctcttgggctacaaaagcccttaactttatattgtttccatgagagaataagttctcaggtacgtcctagctttcaaaatgttgtgatgaactactgttctatacaatagcatcgataaatctcaaagactgatactgagtgaaagaagccacagagaagaatatattcaactatggttccatgtatatgaaggttagg

SEQ ID NO: 155748 - DNA, 443 bp, Homo sapiens
tcagttgtctttgaaacttccctcctcttctccatccaaaccatcaccaactcttgtctatttcagtagtcaaaacaattaatagcagcaacggttattaaagcattcactatgtgccaggtactcttgtgatgcatatacagcattattaactcattcgattttcataacaacttcacatcatggctcctatgattattttcatttaacggtggcataggaaaattaatttgcccaaggtcatacagctagtaagagaggaagttagtactataacccagtcattctggcttcagaacacacacttttagccatgacactctatccaagataatccccaatccattcaccttactcgttttccactgtctcattttagttcaagctcactgattttagtcattgctcactctagcaacagcaaaggtctcccaagtggtcgt

SEQ ID NO: 155749 - DNA, 365 bp, Homo sapiens
aaggtgattgcatcatcctacccattcattaatctaactccctacaggatactttcctaggagacactgacaggtctgttttctgaaatccagagaaaggcagcaatggggaggggtgcagtgtatgtatgtcatacctgtgcttggtatatctgagttgcctgtgtatgatagcagctggggaatcaaatcatagataaattgttctcatacaggtttgtcctatgactacctattcttattaaacaattggctatattgaccctttttggttttggaaaaataataataatttttttaagagagaaaaagaaacaattggctacccttcaacagtgatgttaaaaccatttcacattctttag

SEQ ID NO: 155750 - DNA, 395 bp, Homo sapiens
agcagggaatagggaggcattatagcctattgatttgtttggaattaaatgtggcaatactatatatagaaatgtctaagaaataaaatatggtagcaaggaaactgggcatgtgactactgtagtaatctaggggtgaagaaacctgaacagcaatagtggcaggagaatggaggtgaaagaataaatttaagatatttcaaaggaaaaagttgttgaatatcatgatgggttggataaaagggaggtgtaaaagattatacattttctatactggaagacaatggagttaccaatgaaagaaaggagaatcgcttgaacctgggcagtggaggctgcagtgagccgagatcatgccactgcactccagcctgggtgacagagtgactctgtca

SEQ ID NO: 155751 - DNA, 718 bp, Homo sapiens
ctaaaaggctttttctcccttaaatgagtcctagcattaggtatccctgattacagtaagcagttcactcttccattaaaaaaaacaaccttcattatacaaacacagactaatggagacaacgccctagtgcctgtgatcattcttcttacgctggaaaatacctgctttgcctccagcctgtgttctgtggccaggacagctgtcttggtagaggcttcttgtgttttcatcctggtgtccctctttatggggctgctccacctcagcactccttctaaaaaccaaagtgctgggctacatgcgtgagccactgtggctggccaaaagagatttcttaatctaccttccttcttgtgtacaaaagggccacaaagctattaaaataaatcataattatgtctgttccaagtccattacttgaacatgacaaatcagtaagagacactcattttcttctagagaagtaggtatcttcaagggccctgggctcaccacaagttcacaaatgcatagcttcttggacatgtctggccttagctgacagtaaatactaaaatatacttcagatacaaaacatctactacatctaactcaagctagcaatgtctgattaccttggtcttaacatctaaaaggctttttcttcccttaaatgagtcctagcattaggtatccctgattacagtaagcagttcactcttccattaaaaaaaaa

SEQ ID NO: 155752 - DNA, 621 bp, Homo sapiens
ctggccagatttggcccgtgagctatagtttgctgatccctagactagagttcaaagtgcaggccccaatctcagagcattatgagttctgtttgtgatgcctgtggggttttgttttattattgtctttgtatttattttggtcattcaagaaatattaaaccatagccaaatccttatcctaagtgaactatccccagtagtgaagaaaacatgattcgtgcacacagaagtttaatcttgtaacttttaagaaacagtgcaaccatagaagatatatgatggcaaataaatacacaaaaagatattaacatcactagccattagggaaatgcacattaaaaccagaataaaatactacatacttactagaatggcaaaaattaaaaatactgattattcaaatgctggcaagtgtgcagagaaactggatctcttctacattactggtgggaatgtaaaatgatacagctactctataactcagtctggcagtttcttaaaaaaatagaaaaaaaaagaaactaccattaatcacctagcatttatattcctgggcatttatcctggggaaatgtaacttatgttcacacaaaaacctgtacacaaatgttcacagct

SEQ ID NO: 155753 - DNA, 509 bp, Homo sapiens
aaaaagtttgcctatttaacatgtttgctgtctgtctcttctacaacataaagctccatgaaggctttttgcctgtgctgttcagaatagtgtctgggacaccacagaggctcaatatttgtagaatgaagaaactgttgttctctaataaatattttacagaatgttaagggcaggtaagatttcagagttgggattatggccgggcaccgtggctcatcccagcacttggggaggtcaaggccggaggatcacttgaggccaggagttcgagaccagcctggccaacattataaaccccatctctactaaaaatccaaaaattagctgggcttggtggcacacgcctgtaatcccagctacttgggaggctgaggcgggagaatcacttgagcccaggagatcaaagctgcagtgagccgtgatcacacccctccactccagcctcagtgacaagatcctgtctcaaaaaagaaaaacttccagagacaaagggaaacacgggtacc

SEQ ID NO: 155754 - DNA, 325 bp, Homo sapiens
aacgggtgatgcggttgcagactcagggccttgagcactgttctttctcatcttcgtggtgggggattatggggtggaaatgcactctcccggtcggatcacatcccactactcaccagcgttatatcccatcgcggcttcacatatattacttacctggcccgggtggcattttactttgcatccttgattgggagtctcaggggctacgaacaaacgttttacccccgggtagcaggcgggtcaggagcgagtattcgcggagcgggataagtggggatgtcgctgcgccctcgtcccttcatctccgggggacggccactct

SEQ ID NO: 155755 - DNA, 405 bp, Homo sapiens
gtgtccatcccccttcgtgtgtccatcccccttcgtgtataattcccatagatctagaagcatacctctgttggagcacttctcatgcgccatcataatcattttctcatgtccatctcccccaaaaaaatgtttctcgaggagtaggctaagcggttcattctacaacttcttcagtaaatacagggctcggagtcctgatgctgccatttacaagtcgggggaatatctaaaggtccctaacatctttgatcctcagcttcctgatacacgaggaggggcagtgatagaatataattcataatgttgttatgaacaataaatacaataagagaagtaaagaccttaatagaatgcttatatatagttaatgctgggtgatggctattatcattatatgattac

SEQ ID NO: 155756 - DNA, 137 bp, Homo sapiens
ttattatcaataatttaacacgagaagagcctagcccttagcaaatatttaatttcaaaacatacctactgatttactcagatacagcatacatactatattacaaatatattgcaggaagccaaatgccaataaag

SEQ ID NO: 155757 - DNA, 493 bp, Homo sapiens
tctgcttggtctgcagtgcagtagagtcaataaagccaatctaagacaaccttcattcttgagatgtatgctggaaaaaaattgtttagaccctatttctgggggtctacacatactcactctattcgtatgtcacagggtccaaattgatgaaagctggccgatgctactttgaattctaaaaccccagttcataacactgtgtaaaatatgctcatcagcctcacccacagggcccatacttttggataagaaatatccaggttggatcaattaaaggtcattataaaatgtggattttactaccttctcttacatacaacctccagatggttgttacaacgtcgtattccccttcctgtttgtctatgctttttatgagcaggacaggaaaaggacaggaaggcagctggggatttggcagtcaagtgagcatacttgatgctcacaccctctcttttcatgctcccagtactgtttgttgagtccacat

SEQ ID NO: 155758 - DNA, 316 bp, Homo sapiens
  misc_feature (86)..(86): n is a, c, g, or t
cccgggtcagtacggatgtggtgggaagacctagagaggttatggtccaccttagcactagctctctgagctataaggcctcaggntctgtggcattccctactcactgaaaagaagggaatttaaaacatgagttccaccacccagaaatgaaacagtgttcatttccagaatccagccatatagaacttatttctcttccaactacatgtcctttcatctcatttatacatgttgactaatgtggtgccctattcctggagtgctcagcctttcatctccacatagccaaagtgtgcacatccgtactggcccg

SEQ ID NO: 155759 - DNA, 291 bp, Homo sapiens
taatctgtaaatttatcctatgtattgacttatgctaaaaatatttaaattcagactaaaatgatctatataaaaaatttaaaatgtacacaaaatgatctttatagatggcaagtataaaaaatataaacagaagtgaccttattatcacgaaatactgaaaactgctttatgatatttccgtggtatttgtaaactgttgtcttgttttttatggctctcagaaatcacttagttttaatttattcaaccagtatgttgagcgctttttttttttttttgagacagagt

SEQ ID NO: 155760 - DNA, 278 bp, Homo sapiens
ggtgcacagtgccctggagtgagatttgaaataaacaattaaataaatgtgatccaaactattttccttaaagataggctttataaatctgtgtgtttgtcagacttttaaaaagaggcatctttcttcctgggggtagagctgaaggccaacctgataggtcctgtttggcagctggccctagtctagagatagaccagaaagagagaagttggagctcaggaagtaccagtcatacactaaaggttcttcactaatcatatattcacagtggaaaa

SEQ ID NO: 155761 - DNA, 916 bp, Homo sapiens
aactcctggcatcaagtgatctgtctgcctcagcctcccaaagtactgggattacaggcatgagccactgtgcccagctggaaatatattttttttttaaaaagggaaaagtttgtactgtattatcaaagaagaaatggttttggttgagataaaagataaaccatgtatagaacaaatatgtaataaaaagccaagattgacaacacaggaagatcatatcttctattaggcaagataaagtatatttagaagtatactccctaccacacaggatatgccgagtgcacagagagaggtacaaaggcggtgctcagagcatggagggaggggagttggcgtatgactttccccctgtgtctcccctagaagacaaaagctttattttgggacgggagcaagattacaagctagattcaggactgtgttagaggaaagggcgggattattgaaggattggcaggatcactgaaaatgccatttccttggtttctggggataaactgccttgcccaggactgaggcttaatcagaataagagaacaacctccgaccctcattccctactacaaggctgacaagcatggattgacaagtaatatgcaggaaagagactttctctgagacatggtgcacaggaaagactgaagtctgagagtgcagcagtcactggaaaatagacttggcaatcagcccttgccctgaacacagggtatcactagaggaatgtgaggctggcaggtcactgagagtaaccacagagacaacaaacctccaagtcagcccaactcctagttagatcaactcaaacccttacactagacacctagcagaactagcagaaggaaagatgtgcccatttccaggcattaaaatgtatttacccccatctttattctcccacactttcaatata

SEQ ID NO: 155762 - DNA, 400 bp, Homo sapiens
tgaattttgtgggggatgaacatttagtccatagcaacataaagtagaacataagattatagtcagttactgattgcagggcaactaaaataccagttttccattgggaagatgatttgtcttgaaactaagacaaaggattaagagagtaatggctttctttgttttccatcaggaatactcgcctgttactagtagtacaacatttgtatcgtaggtttagtactgtgctccctctgcctaccccagaggtcattcctgtcattctccccttgctcactagtaggtccagccacaggagctttcttgagggctttgaacttgccccttttattctgaaatagaccttccttcataatcttgactaccctgtgtaaattaactcatttccattccaacc

SEQ ID NO: 155763 - DNA, 564 bp, Homo sapiens
ccgcgtgtacagcctggatgtgctatcccatcatgcggtgatcgagagctgcgggagagaaatgtccctcttctctgcgactgaatttcctgaaagcagctgctgagagggtaccacgcgccatctccctcttgtgtggtcagcctgcttcacacccacacagctgagtcccgggctgttgtcctgtcagagcatcacccccttctggatgattgactgctgtcagccttcaagccccacatctggacaacccgctaagaaagctgggcttcctcctccaccctgccgttctctcacgccactcttgggctggccttggagcctgccccaatctccctaaaagcctcactacatggggaataaaccttttcctccctccttgtgtgtgtgtgtgtgtgtgtgtgtgtgtgtgtgtgtgtgtgtggcatggccagtctcaatatgtaaaccaagcttaagtggagcgtccttccagcaacaacaccccctccattcctcagaccaacagatcttttccttacatcccattcttagggggcttagaaactggactctgatctctaa

SEQ ID NO: 155764 - DNA, 3165 bp, Homo sapiens
  misc_feature (1433)..(1433): n is a, c, g, or t
  misc_feature (1620)..(1620): n is a, c, g, or t
  misc_feature (1754)..(1754): n is a, c, g, or t
  misc_feature (2427)..(2427): n is a, c, g, or t
atgattgtaccactgcactccagcctcaaaacaaaatgaagagatgtctatacaaggcaggaaaatgctagagacagagtaagagattcaggcacatctggttagttgtccagtctttttcttttttaaaaatatcaggccaggtaaatctcccttggatgtcaaattggccattttggcacattaactgggccaggcaagaatcctaaatccaaaccctcttacccattaacactgaggagaagcatacttttctttgataaggaattctaatttacatgggtatttgcatgtttaccactaattaatcccctttatctatagtgcagaaagggcttaaccttatgctggaacctgggggacagaggctaacgaaaaattttgaacatagctagacccaaaagaagtctaaatcttcacattccaaagatgccttatctaccctttgacccattctttgagacaaggaattaagccagtaaaggtgggagaggtggataacattcaggcttctctggagttgatagttatcctacatgagatacttctatgttgaagatattcctacttctatgttgaaatatatgctgtaataatttaagtaaaattactttcttttgtggaaatgtagaacagctgctcactgaaatggatatttcttcatatccttgaaaactgttgagtcacccttagtattctcttcttagatataataagttctaatttttccttacttggctcatttttaacccttttatctttttattattctgaaatctctccaaggccctcacatgtcctcaagttgtagagtcttaaattggacaacactttaattacagcctgaaggttaggtagttgttattccatttatatatcttagtatttgagtttacttttgaaatataaagtcttagtgactaatttagcatgtggttctctgccactcccttcctgaccacccaccacccctcattcttatcttctttttttaccttgtttgtacaaaaaccagttgttgcctattttatttcttctgtccataccctgtctgtctatgcatttaaaaacagagaactcattccttataaaacagacaaaccagggataattgtcaacatcaaaaaagaattctttaaatcactgcaggcttcctttaaataggtgtttcctgtggtggttttaagtgtttttatataggtcatcaactgcttgatataaagaaactaaagataaagggttaagaggcagtgccagttgaagaacagttagaaattgggataaaacagtagttcttaggtaaacagtaaaatacattcagattcacagaaaaaaaatatgtatatatatattttttgagatggagtctcacagtgttgtccaggctggagtgcagtggcgtgatctcagctcactgcaatctctgcctcccnggttcaagcgatcctcctgcctcagcttcccgagtagctgggactacaagcgtggcaccaccatacccggctaatttttgtatttttagtagagacggggtttcaccacgttggccaggctggtttcgaactcctgagctcaagtgatctgcctgcctcggcctcccaaagtgctgggattacaggngtaagccactgtacctggcctgatttatgtattacttttcaagagaatgttataccaataatattttttgtctagatacagtgaacttttcatcatctgtactaatggaggcatgtacattttaattttgttangcatttttgttgtaacatttaaatatagggatgtctaatcataaaatttaaaaatatttcataatttcatcatactgaagactcaggaagatctgaaaagaaacagaaagagtaccagacctggaatagaaacctgacttctaaaattggctatatagctagctataggaccttagttgaattgcttcaccattttaggcctgttttctgaactatacaatgagggatttcgactaaatgagggattttgaccaaatgatctctgaggtatcttaaatctctagctttttatgatttcccacccttgccaaggagttgagtaaacattggaggtgatgccaccaaaaaagtgaaagcacaatttttcctttatatgatggagtttgctgtagtgtagttttctctttcagaaatgaacgattatcctgattagattttgtttgcccacatcctgttatatcaagtcatgagtatacccccattgaaactcagagttgatttggtttacagttgttctaattgtatcctaagtcttctagctaaaattttaaaatgaagtagtcaccccatggcgttatttatttattttttgagagggaatcttgctctgtcgctcaggccagagtgcagtggtgtgatcttggctcactgcaacctgtgcctcccaggttcnagcgattctcctgcctcagcctccagagtagctgggactacaggggcatgccaccacgcccggctaatttttgtatttttagtagaagcggggtttcaccatattggccaggctggtctcaaactcctgaccgtatgatctgcccacctcgacctcccaaagtgctgggattgattacaggtgtgagccactacgcccagcccccatggagctatttttatttaaaacacatacattataactctattgatctgattacaaaagtgcctattttgttaaaatgttttattgtgataaaaattcaaaaattattaatgttagccaacaaaattcaagcaaaacataaatgtgtaaagtaaaaagtgaaagatttttccttagtccctctcaccactcccattctccaagaataacttaatttggtgtgtgtcttcccagatgttgttctgtttgtgtttatatattaatatacacatatatacatatatgaatacccacacatttgtatataggttttttttaaatgaaatgggatattatatgtactgttttgcaacttttttcactttgcattgtattctggacctcctcttgcattaatacatggaaatttacctcatttaaaaaatgactgcataacatttcatggtatggttgtatcacaatttaatgattcacctattgatgcaaatttgtctccaatcattcactattataaataatgctacatataacctt

SEQ ID NO: 155765 - DNA, 1262 bp, Homo sapiens
atgattgtaccactgcactccagcctcaaaacaaaatgaagagatgtctatacaaggcaggaaaatgctagagacagagtaagagattcaggcacatctggttagttgtccagtctttttcttttttaaaaatatcaggccaggtaaatctcccttggatgtcaaattggccattttggcacattaactgggccaggcaagaatcctaaatccaaaccctcttacccattaacactgaggagaagcatacttttctttgataaggaattctaatttacatgggtatttgcatgtttaccactaattaatcccctttatctatagtgcagaaagggcttaaccttatgctggaacctgggggacagaggctaacgaaaaattttgaacatagctagacccaaaagaagtctaaatcttcacattccaaagatgccttatctaccctttgacccattctttgagacaaggaattaagccagtaaaggtgggagaggtggataacattcaggcttctctggagttgatagttatcctacatgagatacttctatgttgaagatattcctacttctatgttgaaatatatgctgtaataatttaagtaaaattactttcttttgtggaaatgtagaacagctgctcactgaaatggatatttcttcatatccttgaaaactgttgagtcacccttagtattctcttcttagatataataagttctaatttttccttacttggctcatttttaacccttttatctttttattattctgaaatctctccaaggccctcacatgtcctcaagttgtagagtcttaaattggacaacactttaattacagcctgaaggttaggtagttgttattccatttatatatcttagtatttgagtttacttttgaaatataaagtcttagtgactaatttagcatgtggttctctgccactcccttcctgaccacccacactccttcagggcgcatgagaccatattaaattcctatttacctattttggttggacaaaaaaaacacaacacacccaacagagaacacaccaacatgacacgacaccgacataaacgactaaactaaaaaaaggggggcgggggccaaaaaaaacactcccggggggcccgcgtcggccacccggttttttgtaaaaagggcccccagaaggggggcttaaaaaaaagaggcggggcggtaaaacaggccggcgaaaagccgcgggtgtggaaagccccctggcggggactgccc

SEQ ID NO: 155766 - DNA, 2367 bp, Homo sapiens
  misc_feature (1433)..(1433): n is a, c, g, or t
  misc_feature (1620)..(1620): n is a, c, g, or t
  misc_feature (1754)..(1754): n is a, c, g, or t
atgattgtaccactgcactccagcctcaaaacaaaatgaagagatgtctatacaaggcaggaaaatgctagagacagagtaagagattcaggcacatctggttagttgtccagtctttttcttttttaaaaatatcaggccaggtaaatctcccttggatgtcaaattggccattttggcacattaactgggccaggcaagaatcctaaatccaaaccctcttacccattaacactgaggagaagcatacttttctttgataaggaattctaatttacatgggtatttgcatgtttaccactaattaatcccctttatctatagtgcagaaagggcttaaccttatgctggaacctgggggacagaggctaacgaaaaattttgaacatagctagacccaaaagaagtctaaatcttcacattccaaagatgccttatctaccctttgacccattctttgagacaaggaattaagccagtaaaggtgggagaggtggataacattcaggcttctctggagttgatagttatcctacatgagatacttctatgttgaagatattcctacttctatgttgaaatatatgctgtaataatttaagtaaaattactttcttttgtggaaatgtagaacagctgctcactgaaatggatatttcttcatatccttgaaaactgttgagtcacccttagtattctcttcttagatataataagttctaatttttccttacttggctcatttttaacccttttatctttttattattctgaaatctctccaaggccctcacatgtcctcaagttgtagagtcttaaattggacaacactttaattacagcctgaaggttaggtagttgttattccatttatatatcttagtatttgagtttacttttgaaatataaagtcttagtgactaatttagcatgtggttctctgccactcccttcctgaccacccaccacccctcattcttatcttctttttttaccttgtttgtacaaaaaccagttgttgcctattttatttcttctgtccataccctgtctgtctatgcatttaaaaacagagaactcattccttataaaacagacaaaccagggataattgtcaacatcaaaaaagaattctttaaatcactgcaggcttcctttaaataggtgtttcctgtggtggttttaagtgtttttatataggtcatcaactgcttgatataaagaaactaaagataaagggttaagaggcagtgccagttgaagaacagttagaaattgggataaaacagtagttcttaggtaaacagtaaaatacattcagattcacagaaaaaaaatatgtatatatatattttttgagatggagtctcacagtgttgtccaggctggagtgcagtggcgtgatctcagctcactgcaatctctgcctcccnggttcaagcgatcctcctgcctcagcttcccgagtagctgggactacaagcgtggcaccaccatacccggctaatttttgtatttttagtagagacggggtttcaccacgttggccaggctggtttcgaactcctgagctcaagtgatctgcctgcctcggcctcccaaagtgctgggattacaggngtaagccactgtacctggcctgatttatgtattacttttcaagagaatgttataccaataatattttttgtctagatacagtgaacttttcatcatctgtactaatggaggcatgtacattttaattttgttangcatttttgttgtaacatttaaatatagggatgtctaatcataaaatttaaaaatatttcataatttcatcatactgaagactcaggaagatctgaaaagaaacagaaagagtaccagacctggaatagaaacctgacttctaaaattggctatatagctagctataggaccttagttgaattgcttcaccattttaggcctgttttctgaactatacaatgagggatttcgactaaatgagggattttgaccaaatgatctctgaggtatcttaaatctctagctttttatgatttcccacccttgccaaggagttgagtaaacattggaggtgatgccaccaaaaaagtgaaagcacaatttttcctttatatgatggagtttgctgtagtgtagttttctctttcagaaatgaacgattatcctgattagattttgtttgcccacatcctgttatatcaagtcatgagtatacccccattgaaactcagagttgatttggtttacagttgttctaattgtatcctaagtcttctagctaaaattttaaaatgaagtagtcaccccactgcactccaggctgggcaacaagagcaaaactctacctcaaaa

SEQ ID NO: 155767 - DNA, 469 bp, Homo sapiens
  misc_feature (1)..(1): n is a, c, g, or t
  misc_feature (3)..(3): n is a, c, g, or t
nanggagaagattcattcattcatccatcggacagcagccacctcctgccctctgggagcctggcctgcaggtgtgggatccaggtgtgcaatctcaccttaactcattctctgtgtgtgctagccaggccttggacaggggaggggcctgcccctgcagtctgttcttcaggacacagaccgtggttgtgcatctgtgaagtccggtggtttgggtagataagtactatgggaccagggcccagccacctgtgccccagcatccctctgtgtgttggtccaatcttgcttttctgctccctgtgttccttgcattttgccacaaaagtgagactgatgctacccagcacgtcccacgaccccagccccctctgtccttctcacctccttgtgaagaagctgagccgaaggtgcgtgatggggcccagagcccctatgctgggctcagccctgtgttcccgggaccctc

SEQ ID NO: 155768 - DNA, 1083 bp, Homo sapiens
tgacatgtaaatagaattgtggtttttctcactgccacattgtgtgggtggagggagattctaaagggttttaggaatcggaaaattagggagaatcaaatcatgggtgcttaaggcctcagtgaaacactgtaaattatactgctgacggcgaggaacctgcttggcaatgtggcaaggggattttatccactcaaccaacacgtctgagtatttccgaataggttttattaccaggtgcttaaagaatgtgtggtgacataaatgggttttatttggggttctgttagtacaaacggtaactttttgctattttgattgttttaattatttaaaaatatgtagtattacagagttttgaaagaggaagagctagatctcaaccatttatagaagtctcgtttgttttttccatttgttttttatatagttattttaactgtcagtgaaaaaatatgtgttgagtttatttagtggccagactcagcaaactggaagtagccaagacagacatagctcctgccttcatggagtttacagtccaaacagaggataaccattgagctaattatcactatgtaaaattaccaagtacatttacttgtttacttgtgcatgtatcccctccctagaatataaggtcgcaggcggcagggatcttgcatgtttcaccctctatccctgtgtataaaaggctctcaatatttgaccaagtaaacaattctggtattaaaaccgttaagatggaaaatcgccggctgctgtggaaacgcttgcctttccgcctggtttgggatatcagagaaggtttttctgaagaagtgacatttaagatgagacttgaaaccactgggcaaagaatgatacaagcagaggaagttatgtgaaaaggctccgaagctgagacgttctaaaaatctctgaaagctagtgtggctggccctcagacaactgaggcaggatgtggaagcagaggacagatgccatagaacagaagaaggaatgggaagccctaggaggatttcaagtgggttgtatcctttttttttctttttttcacttcatgtagcctattattatatg

SEQ ID NO: 155769 - DNA, 498 bp, Homo sapiens
gacagataagaaatatagccagcaggacaccagtctcacaagagaacgaagaatagacagtaggtagtaaactatggatataatttcctggctttgaggaaacaggtatgggggggaaagcaatgttcaagacacattaacaatgccacaagttcctacaaaaagtcccggagctcttacaaattttcagttttaaaaaaagatggcagtgcagggcgcggtggctcatgcctataatcacagcactttgggaggccgaggcggcctgaaatgctcatgacctcagaggtcctgaggtcagagtttgagactagcctgacaacatggtgaaaccctgtctctaccaaaaatacaaaaattagctgggagtggtggctcacgtctataatcccagctactcaggaggctgaggaagaagaatcacttgaaccaggaggcgggggttgcagtgagccaagattatgccattgcactttggcctgggtgacaagagcaaga

SEQ ID NO: 155770 - DNA, 524 bp, Homo sapiens
ttctacctgcttgtttgcttgcttgtttttgagacccccagatgcagaaggtggagttaatcatacttttatcctattgtagcatattttcatcaccaatctgtgcaaggttcccaggtcactttgttgtctaagcatttgtttccatttatccccacctccaactttcatttcctcccctacccatttacgcaaggattttgttctgatcgcatgtagttgcttcttatgttggtgttcttacaaaataggtattgtggtggccgggcgcagtggctcacctctgtaatcccagcactttgggagaccaaggcaggtggatcacctgaggtcgggagttcgagactaccctgattaacatggagaaaccctgtctctactaaaaaatacaaaattagccaggcgtggtggcacatgcctgtaatcccagctacttgggaggctgaggcaggagaatcgcttgaacctggaaggcagaggttgtggtgagccgagatcgcgccattgctctccagcctgggcaa

SEQ ID NO: 155771 - DNA, 596 bp, Homo sapiens
caaacaaacatttagggagcatgtgggaaaagggatactagccaaggaggctagagaaaagtagtcagaagtaggtggataatgagaggtgttgacaatagctgtgtcacttctcaaggcatggggtgtcccaaggcaatgcagagacttaattctgattccagaggcactgacttcctcctcggtgttacacatgatatcaggaagagctgaaatgacacgtatgcaaaggttctcagatgacaagggaagtggtgagcagcagacaagaaggcaaaagaagccaggaggaggcctgtcctggagggcttcatatgcttaattgcaaaatccacccaaaaggaagaaaaacgaatcaacagcgtcagtgtattccagctcatggcagaaacaggaaactcaatctgaacaagagtaattggctcatgttaattttctccactttcattttatcacgttgtgagtcaaagaggtaatttacagaaagggctataaagcattgtgtatgttatgtggagtctattatgcatcattattacttcatttatatcctaaagtaccaatttcaacaaagtaatcaggttccattatctctc

SEQ ID NO: 155772 - DNA, 360 bp, Homo sapiens
cagctcatcagtgtatttcatgtgtagcccaagacaactcttcttcttccaatgtggcccagggaagccacaagattggaaactcctcatctaagccttgggctcacacacttcggtgtaacagtctggaagccctcaagtcagaggtaccccatgtaaaaatcctggctctactgttagcagccgttcttcctcaaatgaaaatgcagagaacacctaccacacctggtgataattaccaagatatgtatggaaaagggcttagcacaaagtaggcacaaaacactattccttcaccctcagttcttgctccagcctaccctccacactgctcctggagaggtgtggttacccattctg

SEQ ID NO: 155773 - DNA, 545 bp, Homo sapiens
ctgtctacctcttccaacaccctctgtgtactcatttcaacagcactggccttcttttttccaacaaagtgagctcaagacatctgacttccttttcctgtatctggctgtctcctccaagcggcattccctacctgaccctctaatggaaagtagtcctgtcccagtcagtcactttctcatctattgctttgtagcagacaactgtaagaaattattcatttactacttgtcttctcacccacaaagaagaatgtcagcacgatatgtacaagggcaatgtcaatccttgtgtgcttactatactgcaaagaaccttccacagagaaaaacattgtgaccctgaggaaaacattcaaagtggagcaaaatgcaacctaatatgattctaaggatttttatactacgcaaaatagccaaacagacacgtttataaaaggcttagcttttcttcctactgacaattgaaggctcttacttgaacccttgataatcaacaagattagaatgactaatgaagggtattcttgaggaaaaaaaaaaac

SEQ ID NO: 155774 - DNA, 288 bp, Homo sapiens
acctgtctcgcagagttgctgtgggcgtaaaatgtgacaagggatttaaagctcagcacagttcctggcacagagtaagctctggacacgccatagctctggttgtttattaccggtgataaaacagatgggtcctggtgacccagtggactggaggagatgcagggacaaacgcggccaagtctgaagtttcagatcaggaccaaagcccgggtctctgcagctggtatctgagcacagaccaggtctccaggtgctctcttccctgctgaccctaagggctggggc

SEQ ID NO: 155775 - DNA, 383 bp, Homo sapiens
agttcgacggagactctcttcacatcccagcctcatgcccttgtcttcctctcatctcctgctggggtggaagagaggatggagaagcagggagaggggatccggaggggcccacgccaggaaaccaggctgtgtctaggtgcagctgttcttgccgagtctctcctgtctgcaaagtgagggtgataaacgcctgtcccacgtatgtcctggggctgttgtaaaaatcagctgagaagctggatgctggcgacgtgtgttcacggcgctgttctctgccagagtaagggataattgttgctgttgataaacactcactgggtcctcaccacgaactgagtcttttcacatcctcagttctgctgggagtctctaacctctgg

SEQ ID NO: 155776 - DNA, 259 bp, Homo sapiens
ctacaaaaattcatttgacctcattaactgtaaataacatctagaaggagcatctttgtgacatactgatttgaagatctgggtttaacttcaattgatttcggtgttttgtcatagctgaaaaagataccatacaaagatgtttagatccaaataaaaatagtatatcattgattatgctaaataaattacaaaagttattttaaaatgtcttccatcagtcatgcaaaggtgttattttaaaatttggtcagcaaat

SEQ ID NO: 155777 - DNA, 670 bp, Homo sapiens
  misc_feature (535)..(535): n is a, c, g, or t
tgccatgaggactagaaacctggaaacctacgtttcccagctactccatctccccacaccgcaggctttctgttatgttctgatgatgaactactgcaggaacatatcaggaaagccaagagaatccacagaccctttgaagaactgtaccacccctgcagactccctgagatgccaaaaactgtgaatctgcttgctttctcaactgggaggctcatggtctgggcttaactcccacttataagtgaaaatacgtaatggtctccaactccatccaggtgtctgtgaatgccattatttcattcctttatataggttccccagtgaggattgtcaggcctctgagcccaagctaagccatcatatcccctgtgacctgcacgtatacatccagatggcctgaagcaactgaagatccacagaagaagtgaaaatagccagttcctgccttaactgatgacattccaccattgtaatttgttcctgccccaccctaactgatcaattgactttgtgacaatacaccctcccttanccttgcggtaatgtaatttgtgatattccctcacccttgtgaaggtactttgtactatacaccctccccacccttgagaaggtactttgtaatattctcccctgcccttaggaatgtactttgtaagatccaccc

SEQ ID NO: 155778 - DNA, 374 bp, Homo sapiens
aatcaggcagcaaaatttaagaaaaagcattattcttccccttccatccatcaggggacatgggatcattttcctcccactgggggtctgagttcattatgtggctttactatatgccctattcacaagccaatatagggtaacttctcttccaatgagacaatcagattactcattgggcaggacttcctggctcatcaagggctctattagagaggatagtagaaaatcatctatttgttaataaatacctagtcaaaatagctttctccctgcaaggacagttgctgtagtattgatgtttttatgtatttcacaatacagtcttgctttcagtctcattactataatgctgtgtttgtaccttccatcat

SEQ ID NO: 155779 - DNA, 522 bp, Homo sapiens
agtagtcagttgtcctttgtgccacatttcatttatccatttatctttctatccactcatctgctgatgaacatctgaatggtttccagtgggtctttcttttgggctgggggtcgggggaatcccgggaggctattatgagtaatactgctaccagcattcatacacaagtcttgtgtgggcatgttttcatttctcttgggtggatcccggaattgctaggtcacagggttggtgtatattttccaaaagtcccagggaaatgtgaaaaagcggccatgtttcagcctgacctttgagctccaagaaggtattacaaagcactgcgtgttgcacagtcgagtggtaggaacaaaagcatagaaatgcctatccgcgaatttcaattcttttaactcaccaccctccatctactttttccttcttcttttcaaggcaacaatccttggtagcaccaaataatgtgaaactttaactccttatttatctgatgccatcaggaaacaaggttgtccaaacaag

SEQ ID NO: 155780 - DNA, 421 bp, Homo sapiens
aaaggaaaaagaggaaaagaaaagaaaacttatatcgtgttccagagtaaaataattacttggggtttatctgttactaccctcccacattagaataataattgagaattaactacagttcagttacaactaattatataaatccttataggttactgtgaataccagcggaacacagaattgtttatagtattagtatttcaggattcaaattggttcagaaagaaggcttggaaatctatttgttatatgtatttctttattatatatttaatatgtaattattgagataaaatctgtttattatagggaaattgggttattagcccctcatattctagtctggagctgtttctaaccatagatttttaaaattacagtaaaactccgtgtctccaattactgtgaaaccatataatga

SEQ ID NO: 155781 - DNA, 270 bp, Homo sapiens
aacagtaggggtgcatatgtagaatgagctatgacaattttttaggttaaattgatttctctagaaagtagccatccaaattaaataaaagttaatgccaaaagccacacctctggcaatacaatccagggacctggtccaaatgtggaaaatttcccccagtttcacgtggttaaaagtgacttattaaagaatattttacaatacaaactcccttttggggcttagggtattaagaggaaaaaaattttttaaggaaaatattacaag

SEQ ID NO: 155782 - DNA, 177 bp, Homo sapiens
tctcactctctctctcccttccatcttccttgggtgtgtgttttgttccttgtcctcccctctagttcccctcatctccttcctcctctctgagtgtcagtgtctgcctctgcccagccctcaagctttcatttgaacaacaacaaacactactggatagtaaacagggtccttttg

SEQ ID NO: 155783 - DNA, 235 bp, Homo sapiens
atttttcttcataaaaggtttacaagtaaaaccagtcaaaagaatagtgaaaataaattccttccccatacatagatcattttggtctggtcaataattcaactgtcttagataacaaaactgtaaaataaaaacttttaaaaagcaattttaaagattgttgctggaaagtaagttttttagtttacattgaacagaaataggcaaatgtctcatattgcaggtggcttaaaaa

SEQ ID NO: 155784 - DNA, 220 bp, Homo sapiens
ataaaggataagcacaaataaatatgagttcacatggattcaatcaccatgatacctgtacagaagtcatacttctgttcaaataattcctaatcacatacatcacttagaacagagtcaggcatttagtaagtactctgtgtatgtttgttaaagaaataaacagaacacaattactatgaaatggatgaaaaatcatttcacaagtgcatgccaccta

SEQ ID NO: 155785 - DNA, 513 bp, Homo sapiens
tatatatactttaagtgggggtgggaggagggtgagggatgagaaattacctgatgagtacaatgtacactattcaggtgatggttacactaaaaagccagaccactgctatgctatatatccaaaactgtaccccctaaatctataaaaattaaaaaataaaatagtttaagatgaagaaatgcctatttttccagaaggctccttgaaactgttgcatttaaattatcttaaatgtttcattacctctcatcttttaaatagttcatgataagtttttggttttttttttttttagtttttttgagacagagtttcactcttgttgcccaggctggagtgcaatgacgcgatctcggctcaatgcaacctccgcctcccagattcaagcgattctcctgcgtcagcctcccaagtaggaagattgcttgagccgggaaggcagagattgcgtgagccaagatcgcaccactgcacactccagcctggacaacagacaaagaccctgtctcc

SEQ ID NO: 155786 - DNA, 136 bp, Homo sapiens
aaaaaaaatatatatatatgtatacttgaggcaagtacaagtcaagtacccatctctctctatttttaaaattcatgctttctctgctatcataacattcggtctataaaacgttgatttcattaccaaggcaaag

SEQ ID NO: 155787 - DNA, 609 bp, Homo sapiens
ttctctccccaccccctccaagccaaaatgtcagaaaagggcctggtttccctttatggagtgcaaaataaacagatcctcagcagcaggagaggggcccagttccccagcccataatgccagagctgggggtgggggtgctgtggggaaaagcagttattcttctgtctggttagtatttggcattgactttcattttctccaacctctgttttctagaagcctgcctgtacgggaagtacaggaataaagagaagctgatcgtgggggttttcttgccagacttcaaaggaggtggatttttgatttttgatagtttggagagctagttccaaaagtaaaagctgctttggggacttgaacctagacactgggatcttagccgtgtgcccatcagagccgctgctctgctcctgatggaatggagtgctctgggcttcccactctcctctcccagtccaggagggctggagctctgggcatctcagggtcagctgcggtgagcctggccacagggctctgcattccttctgggctttgcttggtttgagtgggtgtgaccgccagtttactctggagaaaactgagacaaagagtctaaattgggca

SEQ ID NO: 155788 - DNA, 465 bp, Homo sapiens
agatgcaccaatacttactgttgtgttccaactgcctctagtattcagtacagtaacatactgtacaggtttgtggcctatgagtaataggctataccatatagcctaggtgtgtagtaggctatactatctaggtttgtgtaagaacacactatgatgttcacacaatgaaatcacctaatgttgaatttctgagaacatatccccagagttaagcaacatatgactgtattaaaaacccattgacttgtacacttcaagtgggtgaattttattgtatgtggaaaatatctcaataaagctccttttaaaagtgggagatgtctagagctgagcaaaaattaaatgcagagatataaaaagaccttcaggttcaagtcaaacccctgatagaaagacttcattcacaaagaggagatctatggcaacagaacctgggtttcttcactaaagacaaaggcacct

SEQ ID NO: 155789 - DNA, 506 bp, Homo sapiens
ttactatatgccaggcagggaagagggtcagagaggcaagcaatacacagaaaacaggtacagaaagaggccttcactgagaccttcactgagacttgatctcagctaaagaaaggcacttcccccaaatcaccgcaccttcccaggtaacctacatccaactacttggtggggagagagagggggtataaagactcagcccctttgacccaatttgggagtacttggaaaggttagcctaggtccagagctccttgctggactgggtaagccctttgttatagctgcaacacagttcaatttctccctctgccccaatccagcttcctgcatgcaaatatccatcttcacagtctgcttcctggggggaacttgacaagtgagggagaggatgaaccgttttcttttcttttcttttttttttttttttaagagatggggtctcattatgttgcccagtttggcctcaaacttctgggctcaagcgatcttctttcctcagcctc

SEQ ID NO: 155790 - DNA, 726 bp, Homo sapiens
ggcacagaatgaggcttgacacagactatgtcactaacttaagacaaaattaaaaaagaaaatcaacaaaggagtggaagctacagtcagtttttatgtggatttcccctttggtagaagaaaatgtcgatttctccgatgtgttctgaacagtggtttcaggttatcccgagttgttctcctcctatggtgatttttttcttccctatgtatgtgtcatttatgtgggttttgggcacagtgaaattcaacctaagaccctttagggagttcatttgtggtttgactggttgagtttccccagtcaggattcatagaagggccgagtaagtcgcagctgtgccctcacccagccacttcccaacataagattaccctgcatgctctctggtaggaatgctgctgatcattaattggagctcttttaggctcatttcttgagacttctatttttctagctgagctcccagcacgtggccttgtaaatgtgaaaggtcgtggcagggtctctagcggtctctggagcaactgtgggcacccatgaatgggctgcctttctgtccccctttgacttcctctccccacctcagcttggattttggaacgtcaggctcatgcttggtgtactctgaactgtgcagttgacatgttcccagggcctttgtcctgggctgtgagggttaaccttgctgctttatttatattccgaagccggttgttattaat

SEQ ID NO: 155791 - DNA, 291 bp, Homo sapiens
cttgcacccaggaggtggaggtttcaatgagctgagatggtgccactgaactccagccgtaggcacagaagaagactccatcccaaaaatcaatcagtcagcctaagggcttaaaattttgtgtgtgaatacttttaggcaccatcagagagaaggcctgtactcttcaaagattacggataccaccatttgtctgacatcttacacactgaagacttagcattttacctgcattgcctctaggaatttgagtttgtaactcctagttcagacccttatcaaatggccact

SEQ ID NO: 155792 - DNA, 446 bp, Homo sapiens
ttagtgtccttatttataaaataaagtctttggactagacatctcaaaatccccagccagggcaatcctttcaaaatcctttgtagctagccgcagtttaggcaatagatggaaaagcactttgagaagtggttaaaagctcttaacacatttcaaaaggtgttatttttgcagagcagagcatgaaattatacatatagaaaaagaaaaaagaactttgaaattttagtagctcaaacttaaatgtaaaaatgttcattttaagtgtccctcctctctctccttcttatcttcaacaaagagggcctattttaatgtacacagataatttaagtattcacacctatcctgtgtttaaccacaccagagctttggtaaggtctaaaatagtgcatggatcttacccctttgtttgccttctccattgataagagttgttaagagtc

SEQ ID NO: 155793 - DNA, 453 bp, Homo sapiens
aggaagctcatcctgatttttaccctcaatccaggccacacagctctgtggtttgaatgaagttgtaggcagcagaacagagtgtgctgcttgtctgtccctcacatgctgtgtggtcttgggaggattactttacgtctctttatccttagtttcttcacataaaaaaattcagattactcttctaatggcctagcttactactctgttgagtctgctttgtaaactggtgtacactgggggtgggaaaggagggagaaattgacacagacagctatgtaactgtcatggacataacagactggccagcagcacagggaaccctcagtacatcagtctgggttgctaaggtttctagacatctgagggtttacacttttaagcaaataacactttttaaaaataaaaacaaacatcttaaacagaaaactttataaaacatattacacaaga

SEQ ID NO: 155794 - DNA, 187 bp, Homo sapiens
agcctttacatattattcattcttatttgaaattcactctctgaatgtccaactgctgggattacaggcatgagcttggcctaattgacatttttataacacttgacccagcagctgtagaatgaagaaaatctgccaaaaagtaccacattctgggtcataacaaatcttaacaaatttaaaagaa

SEQ ID NO: 155795 - DNA, 129 bp, Homo sapiens
agttaatgcaaagcagtctggaggactcctaaaatatctttttaaggatggtttaaggagctaagtaaatattttaaaaatttttttaaaggaggtggacattcaatttcagtcaaagaatctaccaac

SEQ ID NO: 155796 - DNA, 441 bp, Homo sapiens
gctcgtaactgctacctgggcgtatgcgactacagacacatgccactgtatgtctaatttttttttttgggtagagacagggtctcaccattgttgcccaggttgaatctcgaactcccggcctcaacgattctcctgcctcagcctcctgagtagctgggattacaggcactcatcaccacgcctggctaatttgtgtatttttactagagatggggttttaccatgttgcccaggctggtcttgaactcctgacctcaggtgatccacctgcctcggcctcccaaagtgctgggattgcaggtgtgagccactgtaccaggctagaatggtaacttttgaaacccatttttgttattctaaagtcttcacggtgtggtgttgggaaggctgggttgctgtgtcagatgggtaccctcaccccagttatggctgttctca

SEQ ID NO: 155797 - DNA, 239 bp, Homo sapiens
gtgtgtgcttggaaaaaagaaggaggagaaatatagcagggagtggtatagagaagtcatcagattctgcttgaagccaccttgaggccccacagcctggcagcagttagtgcttgtgtcagcccacctgttcatcctttgttctctggaagcagctgtcttatcccatgatcctccatgggccctgattttgcactttgggaagttcggagttgtccattaccctcacttgtcacatc

SEQ ID NO: 155798 - DNA, 228 bp, Homo sapiens
catggacttatttgatgttacttcagactcgggaatgtgtagttttatatcttttcgctaaatttgagaaggtccagccattacttcttcaaatactttaaacacctctttcccctccttctgatgttacaaatgttagttcttttgttattgccccactttccaaatactgagagaaccaaactacatcccattccctcctgccttccggctctgtctaagctacca

SEQ ID NO: 155799 - DNA, 529 bp, Homo sapiens
ggcagcctgcagggccctcggaggcactccttctgactcaccattagagatcactgtccagagatggaggaggagatggcatatagcatagtcctgagaagttgtcttactgatgtcatctttaatattagcctgtgttctatgacagcagggggctttattcctaattcagtgggtcttaagcagagggattatgtgagctgattcgggctttggaaagattaatgaccacaaggtagtctgcttcaactatggctgacccacttatcccagacccttctctgccctcactaccctcttccagaccctgcaagacagaatctggggtgattgcctgttcacttcagacaccatttttcctacttgttcagggcaaataccaccatccgacacagtgaagccatacctgtagccaccttgacaaagtgctcctcgtgacctggtccagccagaaatcgattttgctatgacttggtccacatctgtcattcttgaccactgccccaaattgcagacctttgcttgcact

SEQ ID NO: 155800 - DNA, 139 bp, Homo sapiens
tttgggagactgcgtctgctgttgatctttccaggtcttccctctcctttaggaggcggcctcatccttctactggcacatctgacacttctgacagttggagctctgacgaaaagctctcatggtgggccacgtggct

SEQ ID NO: 155801 - DNA, 172 bp, Homo sapiens
tgtaagtattgctacctatagatggaacctcagatttactgtattccccaagcctggactgtaaacaagacttctcatcccttcctctatggccatcttctcatttcacctcacatttggttatgacagccccatcactgtctatgaagtgctggctgtaaactcgtcatct

SEQ ID NO: 155802 - DNA, 293 bp, Homo sapiens
tgatgtgtgctttcacttcacagagttgaaactttctttttattgagcaatttggaaacagtctttttgtggaatctgcaaatggatatttggagcactttgaggcctatggtgaaaaaggaaatatctcacatgaaccctagacagaagtattctgagaaacttctttgtcttgtgtccattcatctcacagagttgaacctttctttggattgagcagtttggaaacagtcttattgtagaatctgtgaaaaatatttttgagccctttatggcccatggtgaaacaggaa

SEQ ID NO: 155803 - DNA, 680 bp, Homo sapiens
caaacaaaatccaaattcatagtttaaagttgttttccatataatgtaggatacaatgcaactaaacttcctgccactacgtaacacaaatcccctttcctcctgtttccaataacatgtatcctcatttcctttcaagtcctcaccaacaatgcttttaatgtctatatttctatcaaaagtttgtttatgaagatctaggtattaagtccatggtaggttttctccactgtgctcatttccttttaacctccacgggcagtctttaacttccaaatttctactaagagtctgttcaaggtaatctaggctttttataaagcatgctcctcaaaactcctctagtctctatgcattaccctactcaaaagccactttcacatttttaggtattggttacagcagcaccccacacttcctggtaccaaattctttgtgaatttcctgaagttaccttaacaaattaccacaaactgcatgacttattttatcacagctttagaagccaaaagttggaaatcagttttactaagctaaaatcaaggtactggccttccttctggaggctgcctgcgtttctggacttgaggccctcctccatcttcagtgtacttcattccagcctctgcttccattgtcccatttcctttttctgcctttgaccttcttgccactttttt

SEQ ID NO: 155804 - DNA, 197 bp, Homo sapiens
gcaccagcctgcacattgcctctccatacggcagccctttatttggaaacttcctaaatcactttgctgtgtgtgtttacacgggtgggttttgctttacttgccctgagagcacacgggagtgcagcacacaccccaacccacatcaactgccattaaagaaaagaaatttcagcccagaatttcatgtccagcaa

SEQ ID NO: 155805 - DNA, 266 bp, Homo sapiens
tcagaaccctggggtttgagaaacaatgctgcagaatatctttcagtcttgtccttcatcactctatttactgaatcaatttggcctagaggatatctggtgccagggttgataaaagctgtcttgggatttttacagctgtctggtcagaagacatgcttatgccataacagctccagctccttctctcactctctctctctctctctcacacacacacacacacacacacacacacacacacgaacagcactagaatgtgcttt

SEQ ID NO: 155806 - DNA, 341 bp, Homo sapiens
atctgtctgtccccagcaaacctgtctcatttgtacttcagtctcgtaatcatggtatctgtctctgtgcctttattttcatacttttctaccaatgccccaggaaaactatattttctcacaaaaccagcgaagattttctacaaaagtcagtggtcaagcgtgcaatgttagttgaacatcaaaagagcagtgtgccagtctactatggggaaagctaaataaaagaaaagaaaagaaagaaatatccaccatttcaaggatcccaggtgaaggccactttcttgcaatgtttccaagatttgaaagagttagttttgaaggacattttgttacatttt

SEQ ID NO: 155807 - DNA, 110 bp, Homo sapiens
gtagtgtgataggatgctagacatggggactccgtcagcagtgatttatttttattgggacttttggtgcatttatgtgccaaaccaatgagtttatagtttactgtagg

SEQ ID NO: 155808 - DNA, 581 bp, Homo sapiens
catgcttttttttatggcaacgaagtattccatggtacaacacattttctttatccaacctggcactgatgggcacctgggttgactccgtgtctttgctattgtgaacagtgctgtgatgaacatatgagggcatgtatatttttggtagggtgatttcttctcctttggatatacctctcatgccttctgccttctctctacctcgttaatccttaagcaatggccatctggcttctgcttccaccagccactgaaacctctttcaaagaccatatactgacactcctgtcttcacgctcttcattcatctagccactgtggctcatattctcctcagtctgtccctccccttcttgggttcctcatcctgctcttctaaatgtcgagatgcctgcagcagttacgcttatctctggccactatctctgcttttatctcctttcttaaaagtcttcaatgtctctaggctggtgtgtaaagtcctctatcttcagttactacacccttttcaccttcaaaatcctatgcgcacctcaaactcagcaagtgttaactgaattagtcatctttgctgccat

SEQ ID NO: 155809 - DNA, 650 bp, Homo sapiens
agaccccttatcatcatttttatttgttctagcagtagaaggggttaaatagatgattgatagggctgtggcaatgggtttgatctcaggtttctagttcggggatgagttagagcatttatctatccttcaatttgtggatgatactctttatttatttccagtaatggaaacagaagtaattacctttgtgagacttcttagatgctttgaagtaatatttggtctgaaaattaactactccaaaaggtctttaattggttccggctctctgggaggcggaagttgcagtgagctgtgatcgtgccactgcactccagcctggttgacagagcaacatgctatctctaaaacaaacaaacaaacaaaaactcaggttcccacaccctctaaaccctgcctcctctcaggctacagagacctctccaggaggctgaagtgcccttaccccgaccatctgaccagccaccgccccatgcccgtgccccaccgagggcggaggctgctcactgctctgttttatctctggcctctgatcctgcattcttgtgccagggcttagacccagggcaaggtcttagacccagggcaggggtagggttaaaggctttcaacccaggggccagtgccttaattcatgcaacaaatgt

SEQ ID NO: 155810 - DNA, 593 bp, Homo sapiens
aaggggagctgggagatcccatggcaagaggcagtgagagtgacaagggacaagcttctttaaacagccagcctcttgtgtgaactaacagtgagaacccactcattaccatggggagggctccaagctattcattacagatctacccccatgacctaaaacctcctaccaggccccacctccaactttggggatcacattttaatatgaaatttgaaagggacaaacatccaaactatatcagcacttaccttttaggattgctgtgaggcttaagtgagataataaatgtaaagtttctagaatagtgaatggatcacataacctcctgtctaaattttagctattattattgatgctgttgtttttgaataccttaaaggttatatgttaaacaaaattgtaaattgaaacacagaagccctagagatactactggtcaaagaatatttaggtaggtgttttgttttttcttcaacctaggtattcttttgcaacgcacatcagtctccctcaatttcatttattttgtaaattaagagtttcctataccaggtgttctgaaaactaggtatctccttttttcaaaaatg

SEQ ID NO: 155811 - DNA, 604 bp, Homo sapiens
tgtgttcagaggaactggttgtttagagaagttttcttttgcctagaggaactggttgtttgacctaatgttagcagtctcctagtccagcagtttctaaactttgctgcaaattggcatcaactgtgaggtctctaatgacgatggatgcttctgggtttcacccccagacattctgatttaataggtatggggtctgacctgggcatcgggatttttaaaggatcctatggtaggctgaataatggcctcccaaagaataatggtctcccacttcctaatcctggagcctgtaaatatgttaagttacatggcagagtgaagttacggaaaccgatggaactaaagttgttaatcagttgaccttaaaacaagggagatgcgcctggattatccaggtgagcacactgtaatcaagggtcttttaactgaggaagagggaggcagaagagtctatgtgaaagtaatgtgacttgagaaagacttgatcagccactgctagctttgaagaagaaagaggtctatgagtcaattaatgcaggtggcctttagaagctggggaaggcacgaaaatggattctccctcagagcctgtagggaagaa

SEQ ID NO: 155812 - DNA, 343 bp, Homo sapiens
atgaggatgtgtggtgacactgatgaactgagtattcaggaaccaagtcccgtttaggtagaagccagcagatctcaggactgcttggcctgacgtccgttccgcggaaggtcttctggtgacatcggtgtctgggatcataacccttgaggcattcattgcagaaacctgtgctgtcttctgaatcgccacagacagatgacattatggacaggctggtttcagtattaaggtttttagtattttaacgttttgaaaatcgccaggatgtgtgtggcgtggatggaacctactatctagactctgccagaacattctcttccatgattgtcttaatgggctg

SEQ ID NO: 155813 - DNA, 417 bp, Homo sapiens
aagatgcgctgggaccagcagccactcgctgtaaagagctgggggcttacttattcttaatacaaaaaaacaaaaaaaatttaggtgggcacagtggcaggtgcctataatctcagctacttgggaggctgaggcaggagaatcgcttgaacctgggaggcggaggttgcaatgagccaagagcatgccattgcactacatcctgggagacagatcaagactctgtctcaaaaaaaacaaaacaaacaaacacctcgggaatttctggctcaagcctctgatcctcaccaccactatcaccaggggatcttttgctgttcacccaagtccagccttcatcccctaaactcctggggaaatgcgaccagactctccccatctccattccgggagtttgcctcaagccaatcttgttct

SEQ ID NO: 155814 - DNA, 537 bp, Homo sapiens
ttgaggccaggagtttgagagcaacctggtcaacatagcgagatcccatctcttaaaaaagatacatacacaaacatacacacacacacacacacatctgtcttaaagtttgagttcagctaaggggtcagttatgtttcaggaatgtccatgcagaagaaaagtgatttatgtattgaaaatctgtgtctggtcaacatgagaagatcgtttgaagcttgaatggtgtgttcttctgtctaccttgaaaaacttgtcccaaagtgagttttcaagatacaggatgtatgactgtctaatgcttgtgaggagcttagcaagaatgaccagcgaattgcttatgagtctcattagctcatttacagttgccttaaaacatagctgcattgggctaacccaaatgcctcatcaacatacctgtagagattcaaatatatgagaagtcttccctctagagagtgagcccttgcttagtgctgcctttacagcactgtgcatcttctggattgttccattcagtggaagagaagcaatgac

SEQ ID NO: 155815 - DNA, 387 bp, Homo sapiens
cacctccaccacctccttctgttgcttggataaagctgaggcatgtggcactgttgtgagattcttagaagatacaggcaagtagtcctggctaggaccctacaattgagtttgcaccatgaggctctaaatctcagcctctctaggtcctggtactgtatctttggaagacacacacaggaaggacttagataccttctgaaaaagatgggacaaagaaagcttatactcctcctctcccctcctcttgcttggaagatcatttaagattaagagatgaagtgacttttcccactgaaggggacacagggcaatgctatgattcggagtgtccagaggcctgtgttccagccatggttcccctatgtcctcaccttgggacccagc

SEQ ID NO: 155816 - DNA, 542 bp, Homo sapiens
aagctaatgcttacaagaagcaacctataattaagcttttattcctgttttggtttacagagttagaagatcatagaacattagggtctgaagggactttagcagtaatcgagtccaattttggtcattttaaagacgtggctgcgtcactgaaagtagatttaaacaatgagtccctaaatgcactctctccttcccatgagtccacaccacaccacaccagggtaggaggcactgaaatgaaagcaatgccgagaaactaggaagtgatgctcctggctgacacttgccaggccctgatgataggaggtccaactctgggcgctgaggttctctgggttcctggcctaagctgggggtgggcagggagagacatgggaaggagggaggctaataaagagaatggactcacaagaatgctgccgggctctcacccttcaaaattgtcaagatcagatgacatcttctggtcctgtccaactctattattctacatcaaccagagaccacagggccaggaagaggccgtttagcctggagct

SEQ ID NO: 155817 - DNA, 274 bp, Homo sapiens
attgtggaaaataggttaaagtatgtatttttgaactgttcataatggcactaaaaagtccaggttaatattctgaactacgtcttcccaatctgtgcatatataaaaatatattacacaaaactatctttatatgctcttattaaacaattcatctgccacttggtatttaggttgtttccaattctttattattctaaatgcgattaacaggttttactggccaggcccagtggcacaggctgtaatcccagtgtactcggagaattgcttg

SEQ ID NO: 155818 - DNA, 293 bp, Homo sapiens
gcttttccctatgcctcccactaagtacaattaaaaaccctgagcattttatataatgcaaacataagactttgaaagatcaggagaagaaagcagaacagctagagtccttgagacctgaggaacaacccagttttatgttccctgggatttctttttgttcccagagttggtgctggagaagctagcaacccagaagcacaaaccagcaaaaacaaaaaacaaaaactaagaaaagcctgtcctctctagccaaatgaccaggaaagggaccgcctatcagacaggaaacc

SEQ ID NO: 155819 - DNA, 426 bp, Homo sapiens
atagctcctaaactggcggtcgatttataacagaggtaataggtgatactaatacatgtgactgtggaccaccaagataaaaaagtacattcttgtcttggaagactttaaaaagacattacaaggactagaacaaataatttcatgcccatacaccaggcaagtactgggcaaatactgtatgatgctgcttaagattacaccaccattgagtacttggacagtattcttatcccattcaaaaccccttaaaatttttctgactggtacattgaacttttctaaataaatagcatatcctcaggtttcagtactagtcatgagtcagtagggaatggttggtaaatctgaatctgtaatagtaattggaaaaaaatcagttcatgtagtttgttaaaatataggtgtgttgggtcggattaatac

SEQ ID NO: 155820 - DNA, 540 bp, Homo sapiens
gacactcgagtcggtacctaggggatccttattaaaaatttttatttaatcctacacataactaatagaatctcttttttcccctgtggaaataaaaaaactgcttattaaaaatgcagagccccagacgaacagtacactttgagagaatttcagtgagtctggaataggcctgcaaatcagcattttgatgattttgatggaggttgtgcactgtgagaaacattgctctgtttcttattacctccagaggcataaatatgtaggtgctgtctacataaaataaattaggaatggtatgcttccagcttgaaaatgaacaaataaatgtacatcagaactccatgtatgttggtgtatgtttcacataggaactgaagatgatattagcacagatgtcagataaagggacaaacctaccatccacaggttacaagtgtttagtattacagaaaacattttaataaggatcccctaggaatttttaataaggatccccctaggggatccttattaaaaatgcacgttggccaggtgtag

SEQ ID NO: 155821 - DNA, 638 bp, Homo sapiens
gacactcgagtcggtacctaggggatccttattaaaaatttttatttaatcctacacataactaatagaatctcttttttcccctgtggaaataaaaaaactgcttattaaaaatgcagagccccagacgaacagtacactttgagagaatttcagtgagtctggaataggcctgcaaatcagcattttgatgattttgatggaggttgtgcactgtgagaaacattgctctgtttcttattacctccagaggcataaatatgtaggtgctgtctacataaaataaattaggaatggtatgcttccagcttgaaaatgaacaaataaatgtacatcagaactccatgtatgttggtgtatgtttcacataggaactgaagatgatattagcacagatgtcagataaagggacaaacctaccatccacaggttacaagtgtttagtattacagaaaacattttaataaattacctaggggatccattattaaatataattgttgtttgactgccttctagtcttctgtttcctatactaatattctctcttgttgatattacagaaagtagagtatttgaatatcctacaatatattgtattgctctctttgtgtgatcagggggatgctctagagctg

SEQ ID NO: 155822 - DNA, 364 bp, Homo sapiens
ctgggggcttcttgttcactagagcccagggtctggtcatcagctctgtgaatggaaaactggactttccctgaggtgaccaacaggtcttagtgctgttaagtcatgggacatgggaatgcgtcatgggacattcctcctgtgatctggaatggacacgcccctcactagggatcacctgggttcctcccatcaggatacctgggaaaccagattaaccagatgaacaaccccatgccttgtacaagtagaagcagagcaaatcatgataaacagaaggcagtagactttattgagcccttacatgtgccaggccctgcgtcagccactttacatgaatgatctcatttggtcctcattgtaa

SEQ ID NO: 155823 - DNA, 370 bp, Homo sapiens
cagcattcctcaccacgagggcctcgctggtaccctcagaccctgccattaatgggggtttctttaaaagtgaagctggagagaggagcttcagcagacagggatcttccagccaaaaggaaggctggaagggagccgctgtgagctaatcccctgcagggctgtccttccaagaaaggaacccagacaacacagaaaaagttcttgagcaattcccaggcggtccagctccacagagccccagggtaggggccgcaggaaaagttccccaaaggcgtcttctcagctgggaggaaggccgtcttctcagctgggaggaaggccgcagtgagctctgttcccactgtgcggcaggaaggtgctgaatagg

SEQ ID NO: 155824 - DNA, 530 bp, Homo sapiens
tttgttattttcttgtaaatttgtttgagttctttgtagattctggatattagcccttcgtcagatgagtaggctgcaaaaattttctcccattctgtaagctgcctgttcactctgatagtagtttcttttgctgtgcagaagctctttagtttaattagatcccatttgtcaattttggcttttgttgccattgcttttggtgttttagacatgaagtccttgcccatgcctatgtcctgaatgagatattgcctaggttttcttctagggtttttatggttttaggtctaacatttaagtctttaatccatcttgaattaatttttgtataaggtgtaaggaggggatccagtttcagctttctacatatggctagccagacaaaactgtactttaaattcaattttagagttctgttttatttgactgctagttttgcaaggtgtcttgtttcgtaaattctttggaaatgtgtactaattcagctacattacgtgttgatcagatgactggcctaagaaggtaaa

SEQ ID NO: 155825 - DNA, 525 bp, Homo sapiens
gagactgggagatggaggttgaggtgagccgagatcgtgccactgcactccagcctaggctagagagtgagaccctctcaaaaacaaacaaaaaaactggaaataggtaaatttctttttctgtacagagaacttctttctatgttaaaggtagaatttcctattaaacagataggttactgtattaaagttttctgataccttagttacatgactttaagttgggtctagacagcaacatgttgaatgtcactcattcttatcacttatgccctactccatcaaaagtatacttgaatacagccatcacgaacctaaaaacagaacaacaaccctaatccaaagatcagtgagcttaactatgtaaaatttgaatacaaacttactgacttacgggaggcgggggtggggggaccatttaaacagacagatctggacattagccttatgctcaatcttcaagttaaaaagacacatcagaggtcatttagagatcaatttagtattcaaatatattgctcactt

SEQ ID NO: 155826 - DNA, 234 bp, Homo sapiens
  misc_feature (45)..(45): n is a, c, g, or t
  misc_feature (212)..(212): n is a, c, g, or t
agcatccccctctaggggactccttattaaaatactgtttttttntactgtacttaatgccacttcactgtacacttaaaacattattaaaatggtaaaatgtatgttacatgtatttaccacaataaaaaaaaacatttttaaaaggaagtagtaaagtgttgaccctattaaaaaggaggagggcagtattttgggatttttaataagancccctagggtccgaactgagtg

SEQ ID NO: 155827 - DNA, 363 bp, Homo sapiens
gccatttactaatgtttttttactgtacttaatgccacttcactgtacacttaaaacattattaaaatggtaaaatgtatgttacatgtatttaccacaataaaaaaaaacatttttaaaaggaagtagtaaagtgttgaccctattaaaaaggaggagggcagtattttgggatttttaactaggggatccttattaaaaatacaaaaattggctgggcgtgccggtctgtgcctgtaattttagctactcgagaggctgaggcgggagcatcgcttgaacacaggagttggaagttgcagtgagcacgccactgcactccagcctggcaatagagtgagactctgtctcaaaaaaaaaaaa

SEQ ID NO: 155828 - DNA, 335 bp, Homo sapiens
gcctcagcctcccaagtagctgggactacaggcgcccgccaccacgcccggctaagttttgtatttttagtagagatggggtttcactgtgtcggccaaaaaaacccctggatccacggcggctctcatggccggcattcttgggcagcggcgctgccctcgggggaagagccccaggacggaagatggcccctgcaaggcccggcggtggctaaggacctcggcgtcctgagactcttcctgcaacaccttggaaccgttttcgactccggttttcgagagagggagctgggacccagagaggagaacctgctcatctgaggtcacacagcgat

SEQ ID NO: 155829 - DNA, 284 bp, Homo sapiens
atgagtttagaatgacccatggcagatgatccagcaaaatttttccctttcatagcaactcttagcaaccccaaactagcaactgtagcttagagtggccagaatccaaacttgatgcagtgccagcatctgtcccaaaaactttcattttagctatttttcattacagttaaaaataagaaggggattgtatatttagcttgtttctcattttacattttgttgtatattcagtgagccagctctacaggagctggttctatcattgtatattttactggtaa

SEQ ID NO: 155830 - DNA, 703 bp, Homo sapiens
attctaactctgtgacatgcagtctgtgacactgagagttacttgcaccttcctctggactggagatcctttctagtgcagacattttataattctattctgtatcgtgttcatttaagtagtctgctttatcattacattaacatttatgaaagacttgctggtatcattggcttagcgattatttttccatctagatgctttttttaaagaaatgaagagaatatgtaatgttttaaatgtacattttagttttgatttaaattttaatcaaggatttttattttatacattacatactgatcactgttttatgttaactctggtcctaataaacagaaaataacaatttggaatatctacaacaatgagagctcgaggtaaaatatagcataaataagacatatatgtgtatgaactgagatatatagaaataattaaatgtaacacatcttttggaccataagcctcaggaagctataaggattatttgcattcttacacctgggcactcttcctttttgctgaataccagtttttcaatcttttctatttttgaaataggtaagaaaagaaaataattttctagaatttgaagaaaaatcttaaaacatttgaaattctttgttatgatgactaatataacgaatagcactcaggtttatcaaatattaacatttttccatatttgttatagaatttt

SEQ ID NO: 155831 - DNA, 676 bp, Homo sapiens
gacctgaagagctcaggacaccaaagaccacactgtgcagttcataaataatcaaattttagaacttttgagtaaacgattaggtaagttggccagccagtgaatcagcctttggtgaatggattttcagcagccttcctagaaccaactcctacaaatggccatacgatactcatgtataggtcacaaaagcttcatttgttcaaagacactaatttttaggaaaacatcagatcatttgaatggctctcaaagactcctccaatgtttagctgagggtctcatggagcagaggcatagttaagagaagaagaggatggaggggatagacgagttcagggaggagtgatagccgaaggtggactgagtaagtattttatcaaagtctatgtggggacctgggcaaaagccagagtgatgcacattcagctttggcgaagagggagaaacccagcattgatctgaaataagtaaaatggtatctagctgagctgccggcaattttagccattcgttgttactcttctgtatcacagaaatgcgtacgttgagagcctttgtcctttgcctagtatttagaattaagattttatttatcatatgttattcattgggatgatgtcagttaattaaagtctagagaaatgtgggtcaatgttggtaattcattgacttt

SEQ ID NO: 155832 - DNA, 203 bp, Homo sapiens
ttctaggggatgatcccacaaatatattcaaatgtgtgagaggtgttcaggattatttgacatagcaaaagactattaaaactgtttttcagtgctacactaatggttaattaaatgatgtaacatctataccacagagatgaaaaataatattgtagatgtatgtataatgaaacaaaataataaaaaagctatgttgttga

SEQ ID NO: 155833 - DNA, 547 bp, Homo sapiens
tgtctagaggatccctcgctattcatcggcaccatctcagattcctgaggcagcatgatcttttctccactccttgggatgcctgacaatttgtaaatccacgaggaagtgtttgttgcaagggccttccttaacaatctcatgcaaacagcatgaagtgatcaaaagaaataagtcttgtgttagatttgccttgtccagttctgtggggtggcagaaccagtacctcaaacacctttgagaaatggtgttcagggctggaaattgggcgaggtgagagaagcttttgccctgggcaccaaatttaagaggagacccaaaacctcaggaatcaagataaatgatagtttcatgcaatattttcaaactatcaaaataaaatattttcaaaataatcaaaatttaaaaaatccaggatgaacagaatgtcataattttaagtgaagacagtataaatattgatttcaaagctgacatttaagtactgaattcactaggggtggaaacaatgaggacaccaggaaactagcagctgtagccatgggtg

SEQ ID NO: 155834 - DNA, 249 bp, Homo sapiens
caaagcacacagagcagagaggcaggagaacggctttccagggcagccctaggatccctctctgtgtgaggacagggagctgggcgggaaatagtcgcccagggccccttagaagatgcccaatagggctggaaagacaatcgctttttgtcttaaatacttgaaaagttaaaagaaccaaaatgtaagcccgacagtgcccttgacttacatttaagcaattctggatgctattgagcaaccaccaaa

SEQ ID NO: 155835 - DNA, 678 bp, Homo sapiens
tacatgtagctagtggcaattatatttgctggggcgggtagagaccatttaatcaacacagagagttctagggacagtgctggcctccaatgacccccaggtcctgaggataacgctattaaccattgcaagggaggtaccgccccatttcacagactgaggaagctgatgatcagatgactgaccggctttgtcgaaatcatagcaggagaggtagggcctggatttgaatccagattcggccgactgtccaactgaggctctctgcagaacaccatgccaccatctcttccccatgcctctagctgaatgcaattccctgtctccatgaaacagggggcgaggtcatcagtgaaaaacgagacggggcagggaaaccgttgtggctgagtctcaaaatagtcctgccactgccaaaaggaatagctctgatctcatctgcgctggtaaaaatgttttcctcctaaagtatttgtttcagaaataagcctttaatttgaatgctttcagagccaacatttctgtctgctgaaaatatttatttctattgtttggcaggaatcaatttgttagggcaccagccattctggcaagggctcccttccccttcgcgaggagaacactggcagggaagccacccgcgggcctgtggctcactccctgttggggtttctcagc

SEQ ID NO: 155836 - DNA, 520 bp, Homo sapiens
aaagcacagtctcatatccttgttgggtttctgaactgagaaatgatctttggaccttacagagggtagttgatcattttagggttcagaataaactgagttcagtctatagactgaatagactgcagccaatagagcttactcttccttggtctaatgaaaataatagaggaatatgccatgtttctccttttgttgatacatctgatgaattctaatgttttaagaaattcttcaaaggtattgtaacatgtattccctggttaccatatagattggtggaggtggatagtgaatcatacatagtgggtacttagtatttcatttaaggtttgctttgaattctcagaattcaattattttagttgaagaaatcgatagttttctccaagaagtaccaaatgttataagtagtctcattagaaaagaaacttcatctttaggaaaaatatgttcattttattttgtaaaatgttgattatcaataaagagacctcaccctttaaagagataaaattca

SEQ ID NO: 155837 - DNA, 603 bp, Homo sapiens
atttgagatgcagttaaatcatcaccaactccagggaggcttttctcagtcctcttctcctccttctgcagttaggggcagacacctaccctctcccactcccttagcagttctgtacttacatctccaggtacttaacatctccagattgcagtgaaccatttgtcatttttcttttctagcttatgtctttcatctccgtattctcagtgcttggcacattgtaataacattcatttcttcgttcacttattcaagaggagctctgttaacaagttagatccatctcctattcttacagaccttataatctttttaaaaataattttatttcatttattttttgagacagtctcactctgtcacccaaggtggagtccagtggtgcaatctcagctcacagcaacctctgcctcctgggctcaagcaatccttgaacctcagcctcccaagtagctgggactatagatgcaccctaacatgcccagataacttttgtatttttagtagacatggggttttgccatgttgcccaggctggttcaaacttctgatctcataatctgtcgcctcggctctcaagtgtgggatacggatgagcat

SEQ ID NO: 155838 - DNA, 249 bp, Homo sapiens
aagtgagaaggggagggagtgcctaagtctgtgctctaagttcaaggttatgatgttcacagtgaaaccagccaagttgatactggtttctgaaggtttttaccccaaaacatcaactttcttattatgctatccctactccctaaaatctatcctttcttgcttcccctccctctcttcccccatactccccgccgactcctttttcccgctccctttactcacccttctctagccattctttccatc

SEQ ID NO: 155839 - DNA, 439 bp, Homo sapiens
cctcggacctcgatgggcaggtgtagtgatacatactaggcaggagatgggaagaattggcgtcgaaagattctcccatctcatctacagcctttttcgtcactattgaaaatgattttaaacttcgaaaaataaatctaatttatttagttagtataaataatctaatggcctggaccctctctgtcactgcctgccccataccaggattaccacttttctgaatttcatcaccgttgataaatgtttttatctgttcttgaacttcttttacatattattattaatattacatagtacatatcattattgatcgtacatagcacatatcatgtcaaataattccagtcaacatgcgtatcaccaccattagatcacgagcttaattaccatgccgcgtgaaaccagcaacccgcttggcagggagagagggtccagg

SEQ ID NO: 155840 - DNA, 289 bp, Homo sapiens
gggagttcaaggatgcagtgggccatgattgcactattgcactccagcctgggtgacagagcaagaccttgtcttgatttttttttcaaaaagaatcacaatataccttggttcacaagtcatacaagctttttagaatgggatgctttaaatttcaagtttattttgatcattaaaaagtaataggcaaaattactgttgggtaaatgcaacagaattcccgcaaggatgttgtctctgctctgtagtcacagtggaatgttaagcacatgggctttgaagttaaatg

SEQ ID NO: 155841 - DNA, 246 bp, Homo sapiens
ctactgggctggtgacaccttgtggggacttccgtattggcctgaggccttggtgccactcagctggtaggtcaggctagctgtggactggccaggaccacaggaagccctccacccatgctggggacacctgtgcttgagctgagaatgtccagggggaagactggcaatcaaaaacataccaggaacacgcacagggcatcagatggaagagaggaaagcaggcaggcaaaggaggatgtcaga

SEQ ID NO: 155842 - DNA, 782 bp, Homo sapiens
ttcatcagcaattttatgggattgattttccacacttctttctctgtgtgatttcttcagtactttccagtttcctggggatctccttttttgtattcccccaagaaagctgggttttattgaccctgctctgttgttcactcccacaactgcgtccgcattcagggccaagtgcttggaggacagagagaaaaggccaatggggatttgccccaccttttggtactattgctcctctgattagagaagaacattcccctccctaacagttttaggtgtctggggccccctttgccaccatggtctaccaggacacctgtttacagttcctgaaacttggaacactgcactgatgcccacttctcctctctccaccccttcactctttccaccccactaaggccaggcaaggttattctggagtttaaacaaaatggtaagctctccactggtttggtggtgcttcgagagctgatcctcctccccagtccttttctgtttttcagagttcctaagttgcattctgttcaagttttataactatattcagtgggggagagccagaggggtcttgcttatgtcattttccctagaactggaaccccactacccagaaatcaacactgccaatattttggagtctttttgtccagtgtatattctggacacacacactcactgttgaaatcacaccctatgtacagtttagtcatttacttctttcaatatcattgtgagaagtttccaaaatattattaaaatatgaataaaatattttaaat

SEQ ID NO: 155843 - DNA, 255 bp, Homo sapiens
tgctgggattacaggcgtgagtcaccaggccgggccgggctctcacctttctatggggagtagacccagagcacacttcagcttcagcctagcctttcccagcagtttggccaaagaatctaggcagatgctccggaagctcacggtcaggagtctttgtctgtagacccaccccatcatcctgtgctttcctattttcctttctggtttctattaaactcagtaacaattaggggtggcattctttaaattcag

SEQ ID NO: 155844 - DNA, 563 bp, Homo sapiens
caggagtttgagaccagcctggttaacatggcaaaaccccttctctacttaaaaaatacaaaaattagctgggcatggtggcacacatctgtaatcccagcttctcaggaggctgaggcacgaaaatcacttgaacccgagaggtggaggctacaataagccaagatcacgccactgtactcccgcctgggcgacagacagagcgagaccctgtcttaaaaaaagaaagaaaaaacaaatggaatttgtgggcatttttaggctaccagagatcacaatcttttttcacattttaaaaggctcattcttgctgctgggtaaagagtgactgggaaggggccagagaggagcagttagattgtcatcctttaggcttccccagcatcctgtgggtgtctttatcaatgcgtagcacacagttttgcagttatttgttttgcatgtctgttttctccactggactgaacttctgaagataaagactctctctcatctccatacccccaaaacctggcatctcattactagatgcttaataaatttgtttttttttttttttttca

SEQ ID NO: 155845 - DNA, 450 bp, Homo sapiens
tacattattattaactaaagtccatagtttacatctggtttgctttttgccttgtacagctcagtgggttttgacaaatgtatcatgtcttggatccaccattacagtgtcacagaatagtttaattgcccccaaaatcccctgtgtcccacctattcacctcttcctccatccacctgaatccctggaaaccactaatctgtttatttactgtttctgtagtatttccttttcaagaatgttgtatatttgatattattagtctttcttttacctaacaatgtacagttaaagttcctctgtgtctttcaatagtttgacagtttatttctttttaattgctgataaataatcaatttatggatttactacaatttatccatttacctatgaaagggcatcttggttgtttccacattttggcaattataaataaagctactatcaaca

SEQ ID NO: 155846 - DNA, 492 bp, Homo sapiens
ccctcctccactcccactcctcaaagaaccagtgggatatatattagttctgttctagattactacttatggactatttcattgctttataaaagtcgttaggctctctttctagcgtgttgaaagggttaataggggttgcttcaatggctagaaaaaggtatgcaattcaaataactgctttccaaaagaacttctaacatgtacccggtgtatatggtggtggtaataccacaggctttctgggtcaggcccactttgccacttctccatttaagcccgttacttaacctctctgtgctgtttcctcctgggtaagtgagggtgatggcagtacctcccccaaaaggttattaggaaaattaagcaggttaatactgtatatgtaaaacacattaaacaatgtctggtgcagagttaagtgcttaataagcattagtgatgaccatgatgcagcaaaattcatttcttttttccaaaatgaaaagaaga

SEQ ID NO: 155847 - DNA, 318 bp, Homo sapiens
agtgataatgaggtttattttctctttcaacaaattattgagagcctttgtgcttgaggcataaccccaatcctggcatgtggcatgatttgtcaggacagagttccctcaattgccccaggcctgtagctgtcagttgactcctccaagcccgtggactgatgtggtcagtgctctgatggagattcccaggtggaagaagagacggcagtcgggaggctctcagaggaagaaattctgaaacttgtgggtagctgagggaagccttccaggcagaagaacagtatgtgtgaaggccccagcgggggaggaagtggc

SEQ ID NO: 155848 - DNA, 276 bp, Homo sapiens
aaagcagatcagtggttgccagggccagcagtggaagaaagaaatttactataaagggataagagggaacttttgggggtgatgaaaatgttctatattatgatggtggttacattactatatatgtcaaaactcacctacttgtacactgaaaattgtgtggatttaatgaatgtaagttcaataaaactgcttgagatcacacagctgattagttatatgcattaggtaatttaaggaatgtgaagctaaataaaactattttaaatgaaacga

SEQ ID NO: 155849 - DNA, 441 bp, Homo sapiens
tccaacatgcatccagtatcagtatcactgtggtagcctgggggaatcactgaactgccaccatattaccggtggcttcacataacccagctactttagctccacataacccagctattttagctccttttcttgaggtttagcatgagccaaggatacacaaggccatctaggactctttatgttttgttatagaaaagtttaaacatgtaggaaaatagatggctgggtgcagtggctcatgcctgtaatcccaacactttgggaggccaagataggtggattgcttgagctcatgagttcgagaccagcctaggcaacatggcaaaaccccatctctacaaaaagttaaaaaattagccgggcatggtggtgcacacctgtaagtcccagctactcaggaggctgaggtgagaggatggcttgagcctgggaggcaga

SEQ ID NO: 155850 - DNA, 224 bp, Homo sapiens
agctttaaaaatttctctctttgtactctttccctttatttctcagactggctgacacttagggaaaatagaaaaggactcacgttgaattatcaggggcgggttcccccgacatcattgaagatatgtagaagaactacgttgtaatttcagaactagaaattacaataactaagtaaaaaactcaatgggtgaactcaatagcagaatggagatacaacaga

SEQ ID NO: 155851 - DNA, 382 bp, Homo sapiens
aatataaaagactgttttggttgccacacacaaaaagtatggaatgcttgagacttttggaaatctagaataaactctccagtttccaggctcaggaaatcttgtttgccactattatgcatataaaagccacattaaaaaacattctgattaaacattttggcttatacttactatcacatcactacatgaactgggagtgtgaatgcagctcaagatgagcagtttccatcagggacaagtttacgataagaattggactgttattatttctttaaaaaaaaaatcacatttacagccaggcaccggtggctcatgcctgtaatcccagcactgtgggaggctgaggcgggtggatcacctgaggtccggagtttgagac

SEQ ID NO: 155852 - DNA, 265 bp, Homo sapiens
gccgtgtgtagcatgcaggctgctggtgatgggaattgagcagattaaagtcaatgtttggttttgtgataatatcttgatgatctattcctggtgatattttctgggcttttgttttctagaaattaattggtttaaaaatggccattatccataaaagaatttattttgtatatgaacatgggccaaaccattttctccttcttatctatggaaaatagtcagctttaaggagccggtattttaaaggcattttgtatgaata

SEQ ID NO: 155853 - DNA, 412 bp, Homo sapiens
gaaagctcataatcttagtcagcctcttctatgctccccaggccactgctttgctgagtcattctactatgcagcccctcagacacaaagcccggcggccacctgcccacagaggcacagagggccagccaactgcaagcacggaacttcaggatcttgcttttcgggttattttcactactgtaatttttttgtccttaggtaaaaaggataataattgtggaaaattatgtccttaggttaaaaagatcctggatcatgccagatattaaaatatggataaaattggcatgatcttggaatctgaacagaaaagaagctgcttttagctgttttcaactgtttttagcttttctgtctaaacagctgtttattctgtttcacaaactctcttagcagaatatttaggcaa

SEQ ID NO: 155854 - DNA, 420 bp, Homo sapiens
cttggaaagcaaaggcagggatgtcctcctacgcggactgctggtctcccaggaaaagaatctgtggctcttacttgtcctgagtgatgctaagaccctgctaagtcaaagaagctgctataggcacagagccagtacccatggtcatagcagacagtgggcaatagaatacaaaaggccgaggtgtccagaggtaaaggtggactgtgtgttccctagtctcagactcttgtgtcttcagcatgctcctgagggttctgaggcacaccctccacgtggctttttttgtttgtttgtttgtttttgttgttgttgttgtttttgagacgtggtctcactgtgattcaggctggagtgcagtggtgtgatttcggctcaatgcagcgtcaaccttccaggttcaagcagttctctcacctc

SEQ ID NO: 155855 - DNA, 622 bp, Homo sapiens
agagccaaattcctataagttaatctttaaagtccaatattaaaatttggggacttatgggcaacgttggtttaattcatcttcaattgactcaaggaatacaacccattttctaactgctaaggagcttgggggaacttatctccaaatgaccataaaatttccaggaaattctaacttgacctaggagttaacaataataatctctgacaaaaggataatgcaggtttaataacacagaagttgcagtttgcttgtggacttctgctgggttatgtcctagaattactgcagaggactacactcccttaatttatgccatttggtcaacactaggggtaatatggtttggctgtgtccccacccaaatctcatctttaattgtagctcccataattcccacatattgtgggagggacccagtgggagataattgaattgtgggggccgtttcctccatactgtcctcgtggtaatgaaagtcttacgagatctgatggttttataaggggaaacccctttctcttggttctcattctctctcttgcctgtcagcacataagaaatgcctttccccttccaccatgattgtgaggtctccccagacacttgcagtccagag

SEQ ID NO: 155856 - DNA, 253 bp, Homo sapiens
atcccccacaaaagcacaggcaggcactcacacacacatgcgtgcacacacatacacactcatacccccacataggtacaggcaggcgctcactcacacatgcgcacacacacactcatacccccacataggcacaggcaggcgctcacacacacatgcgtgcacacacacacacactcatacccccacataggcacaggcaggcgctcacacacacatgcgtgcacacacacacacacactcatacccccac

SEQ ID NO: 155857 - DNA, 489 bp, Homo sapiens
acgatcagaattgcttccatgctgcagggctgatttactgtgaaggggtagggttgttgcaggactggtttcccaggctctctggaacgcctggtctctggccaggaggcagcctggagcctcagtgcaaggaggatccctcccctaccccaggtagggccactcccacacatgtgcacacccacactcataccccacataggcacaggcaggcttactcccacctatgctcacacacacactcatacccccacaaaggcacaggcaggcgctcacacaccccatgcgcgcacacacactcatacccccacataggcacaggcaggctctactcccacccgtgcgcacacacactcatacccctcacataggcacaggcaggtgctcacacacacgtgcacacacacacacactcatacccccacataggcacaggcaggcgctcacacacacatgcgtgcacacacacacacacactcatacccccac

SEQ ID NO: 155858 - DNA, 358 bp, Homo sapiens
ctaatcaggatcacagggaaggagtgaaggaaatgtgtgcaacttctgggtcatgctctttgaagcaggatagaattcaggagctccactaatttggggggaagggggcagaattacctctttattttcactaatctctaacagaaattcagcattttcttcaattaggaatataggcaaactatagttttcatgcttacaaatttgtcaccaacagaaaccacaggtatattatcacattgcagttttgttggtttattttgttgaggcagggtctccccatgttgctcaggctggaatgcagtggcacaatcacagctcactgcagcctcaaaatcctgggcttaagggaccctct

SEQ ID NO: 155859 - DNA, 109 bp, Homo sapiens
gatcatatgcataaagtctttttagaccttctaagatactctttcaatcctccctcttttactcaaaagtaataacctttttactttcttgccctgctatagtgcactg

SEQ ID NO: 155860 - DNA, 148 bp, Homo sapiens
agtatttctagaaattcttttcatgaaaggaaatttcagttcacaaagatcctgggaatatttattttgactgcaatcagcatgaatctgcgaagtttaaggaaacccagagcatccttcctaagccatggtaaagaggcaagagcca

SEQ ID NO: 155861 - DNA, 561 bp, Homo sapiens
gctggctccaaagtccatgctgaatgctacctgtgactcaagccaggagaaaaaaaggagttgctcaaataaagcgtccctggcagtaacgaatcattaactttcagcccactccaaggaatgggtggcctgagggtcacgtgctaaagaggaaaccctgagtgagtcaatcatgaacacatgactgttcttagttccttataggtttgcttcctcaaatagccttcctggagtgctgagccaagagatggattgggaccagtttcagttctgggaaaggggctgaaccccatctagccaatgcctgcacccacgcttcagctctgtgcatgctggtggccgaatctaacacaggccacagggacttcctcaaactgggaaatgcctgctcatgttgtcaagagtcctcagcaacagcttgtttgccgactaaacaaggctgccacctcacacaggcagcctcagaaagatcagggagttaatagttacatgaagacagctcagagaacagctcaagtgacagtccagacaaatgcagatcgtataatgggtacctggtta

SEQ ID NO: 155862 - DNA, 609 bp, Homo sapiens
gctctagaggatctcggtgttcctttgtctttggctgtttttgtgcacaatggtacagctacaaaaattaacagtgtagctggactcagatggctcacacctgcaatcccaacacttgggaaggccaaggcaagaggatcatctgagcccaggagttcgagaccacactgggcaacttaaatgagacccccatgtctactaaaaataatgaaaaaaaaaacagcggggctcggtggctcacacctgtaatctcagcactttgggaggcagaggcaggaggttggcttgaggccaggggttggagaccatcctagccaacagagtgaaacctcgcctctactaaaaatacaaaaattaccgggtgtggtggcgcatgcctgtaatcccatgcctgtaatgccagctactcaggaggctaaggcagaagaatcacttgaacccgggaggcgtaggttgcagtgagccgagattgtgccactgcactctagcctgggcgacagagcaaggctctgtctccaaaaaagaaaaagactcaaccctaagtcagctccaggacgtatgtgcctactctacatgtgtgagtccgaggggaaaaaacatcatatgacc

SEQ ID NO: 155863 - DNA, 115 bp, Homo sapiens
ttcctctggatacttctcagagtcaccctgcccccacacctacttccctctgctaaggaccttgtccagcctccattcctgacaccctctctgaaaggatatcacttctgttaga

SEQ ID NO: 155864 - DNA, 368 bp, Homo sapiens
tcccaacttattgctctttctataactctctttacatatattctgtcttaaaccacttttggacctatctagtctgtgtcctttcctagatggcttttgtgtttcctcctcacttagcaatgacaccctccatcaccatttccaaacacacacacacacacacacacacacacacacacacaaatgaggtatataaagggtctcctaaaatgtcatctgatatttgttatttcatattctcagatttttaatccatttaggtaggtctattttagatagccttgtctgaaacagagctgggacctgatgagtgaaaatgagctcaccagaagaaaaatcaaacaggcatttcagagattgaggccaag

SEQ ID NO: 155865 - DNA, 366 bp, Homo sapiens
ccaggctggagtgcagtggcatgatcttagctcactgcaacctctgccttctgggttcaagcgattctccgcctcagcctcctgagtagctgggactacaggtgcccaccaccacgcctggctaattttttttttggtattttttagtagagacagggtttcaccatgttggccaagcgggtctcaaactcctgacctcatgatccacctgcgtgggcctcccaaagtgctgggattacaggtgtgagccaccatgcctgaccgcctttttttcccttcaatatctttggcccctttcccacatcagctaaggcctcagtcatccagaactatttttaatttcactccatgcctcatcggggtatc

SEQ ID NO: 155866 - DNA, 443 bp, Homo sapiens
gaggctggggacacaccagctcctgattcttggccaccatgaaaccacaggccaggctcaggtggggccttgaccccaggcctcagtttcctcatgggacacttgtgaggatttaacagattaatacaggaaaaactctgggagcagggtcaggccagagggagtggacaggaactatcaggtatggttcttagcttttttcttttgagatggagtgttgctctgtctcccaggctggagtgcagtggcgcgatcctgatccactgcaacctctacctcccgggctcaagcaattctccctctcacctcagccttctgagtagctgggactagagacatccgccaccatgcccatgcctggcaaattttcacacctttagcagagacggggtttcaccatgttggccaggctggtctcaaactccaaactcaagtgatctgtc

SEQ ID NO: 155867 - DNA, 216 bp, Homo sapiens
ggctctgagcaatactaacaagaacctgcgtgcctgggcttggctgtcggggatggtgctgacatggggctggttcctggggttggggtgttccaggggttctctagaggctggttctggcttggctgccaggaagccgtgcaccagagcaaaccgtccacgggcctcctgcttgcttctggtgacactgagaccccacatgtctgtattcctcac

SEQ ID NO: 155868 - DNA, 289 bp, Homo sapiens
ccctcagatattggagcccctgattctgggacttaccccagtgccgcctgtcccccaaccctacaccattctcgagcctttaaagccctggactgggagttccaccacgggctctcctggctctcagcccttcagactcagactgaattacaccacaggctttctggttctccagcttgcagatggtgtgtctgggatttcctggcctccatcatcacgctattagagtaggtagacagacaggtgtgagtggggcaagacaggccccaaggaatgtccaggtggcctc

SEQ ID NO: 155869 - DNA, 547 bp, Homo sapiens
  misc_feature (505)..(505): n is a, c, g, or t
gctttcttcaacaagatgtgattgttgcatcccaactccctgccagggtctttcctgttcactcctcctttttggccaacacacaaagaggagaaagcaggccaaggtattgtacttgtttcaactgtgtccctggcttagggagctctcattcaaccaaggaagggctctgcatttccaacaacactcaccacccactcgcttgtttcttgtgacctcttagcaaggccttaatatcatacttttaaattgtttttattgaatcgggttgtcttagattctgtaccttttccttcccctacaagcttctgtcatcatcattaaactgggtccttttgaaaaaaaaatcatattttaaaataactgaacaaatttggataatgcaggagatatcatgatttaccttcttgagacagaaattgtaaaatatatttttgtaatcctgagtaatgctttttatgtttgactgacatgtagggcttatactctagaacatacgacgacnaagaagattttgatgaagttcacattagagtcagcgggctca

SEQ ID NO: 155870 - DNA, 365 bp, Homo sapiens
ttactgcctctctttctgtactcctactgcttgggatttctttcagattcataaaaataaaaagaaagtatagttataccacatattccacagacagttattacaagatcacagtgtgcaaacaagtctactgggtaatggggaaattatgaaatagcttaaatataactatatttgactttggaatcttgccaggatgagtaagaccaaatgacttacacattctatatttatcacacgaaaacaagcaccagtaaacacagtgtaaaattttgacccactgatggagattgtggattgatgaagtgactagagatggcacagttcataaaggaaaacatttctaaggcagtgaaatctgaaca

SEQ ID NO: 155871 - DNA, 293 bp, Homo sapiens
atggtggcatgtacttgtattccctgctacttgtgtgactgaggtgggaaaatcacttgagcttgggaggcagaggttgcagtgagctgagatcgtgccactgcactccagcctgggtgaaagagtgagaccctgcctcaaaaaaaaagaaaaagaagaaaagaaagaaagaaaatcattctctctctccctcttcctcttcaccctctcagttctgtctctctggagagctctgactaatacaagggttttaaagaggtataggctgtgtatccaaggagtagaggtggtgg

SEQ ID NO: 155872 - DNA, 394 bp, Homo sapiens
cttctgactgagtaaggtctcaggtgtcagataagcccatgctggtgttaaaatagactatttaaggtgattgccagctaatctacggacgaagttgggccagcctacgatgtggtttggaccctccagatttggaataaagaaggtgctgagcatatgtggcacatactgttccaacaacttgtaaacccttttttgtcttgaggttcagttttctgagtgggtagtacaataaagtggtttcattactggtgagcaattaatgggttgacatcaactaagagggagagtctagggacatatcacaagattttttttcttgtttataccctcagttttttttttttttttgagacggcgtctcactctgttgccaggctggagtgcagtggtg

SEQ ID NO: 155873 - DNA, 324 bp, Homo sapiens
  misc_feature (76)..(76): n is a, c, g, or t
  misc_feature (93)..(93): n is a, c, g, or t
  misc_feature (292)..(292): n is a, c, g, or t
  misc_feature (310)..(310): n is a, c, g, or t
  misc_feature (312)..(312): n is a, c, g, or t
attggctgagcggggctggaaacaggcgtcgaccaatcagcagccagccccccgcccgccccgccgcgagcagaangccggttccggccgganctcggagacaaacaagagagatgggggacgggaggggcctgggcgctgcgggccgggcctcggctttgcagccttcaacccgagtcacagcgcggccgggaatccccggcgaacatcgccccgcggcctctccagcggcctgaccctgcgaggctggggctccggctccgcgtcccggcccccagcggactccccccangaagccgccgggccaccnangcgcccccagcc

SEQ ID NO: 155874 - DNA, 283 bp, Homo sapiens
tgtctttttggtaatagccatttatttggtaatatgtgtcttctctcttgtttcttgatcagtttagcctataggcttaccagttttattggtcattttattgagtcagcttttattgatttctctattatttaagtatctgttccattggtttctgttctttattatttctttgcttctactttggggtttaatttcttaaaatggggacttaggtcactaattttagattttcccccctatataagcatttaaaactataaatttcctctaaaacactact

SEQ ID NO: 155875 - DNA, 408 bp, Homo sapiens
cactttctccctacactccggttcaggcttccgggatgatcacatttcactgaatgcaagggacctgaacagccagcaactgaacccccagcctcaataactttctcccctctgatttcaaaggagctagggatgtttcctggttaaagcaaaggggccttttgttggcagcttaggcttgggaaggatctggcaacagggtggcagttttgtccccctctatgccagagagggagttggtgtgggtttccctcgttttttgcctggagcgtgcatgcatcatttcccttctgtggtggcaaagaggacacctgggcttcatgatgtgaacagaaagatagcaccagacataaaattatgaagtctttaagatgtgcttacaataaaaagatgttaattttttccagg

SEQ ID NO: 155876 - DNA, 215 bp, Homo sapiens
gtacaaatatgctctatgatgttcacttgatgacgcatttcttagaatgaatccctgtcattaagtaacacatgcatatataattcctaggactgcattttccaaatttttgtttcaacagtctacaccactgctttcctattttgataccttaggtcctttttctaatgcctagaaaagaacagcagtaatattaataattttcatgatttgag

SEQ ID NO: 155877 - DNA, 128 bp, Homo sapiens
atagtaagagtttgcccttttctgacagttgacagtgtgggaaaaagaaaagcattataatttataatttttgtaggaattcctttgagaaaactatggtgaagttgttgaacaaatcaggtaatgat

SEQ ID NO: 155878 - DNA, 518 bp, Homo sapiens
cctgtttggggtatctgctggaggctatgtttctcagcctgtcaaaatggccaacttgcaggctataaccctttataagaaataaagtttcttttccaaatttatagatatcataatttttttcagttgacacatataacctatccacatcctcccatatattttaaatcatcattaggttatttataatacctaaaacaatgtgaatactatgtaaatagttgttatagtgtattgtttcttatttgtattattttttttgctgtactgttaccttaagctcctagccttaaaaagatccccctgcctcagcctcccaaataactaggattacaggcatgcactaccatacctgtcctgtatttttaattattgctgcctggggccaatttatatttctgctggtgaagaaatgctaatttgcaaaaatcaggatcacaattatattccaatacataaaactgggtttatggatacattcattatcttgattatggtaatggtttactgggcatata

SEQ ID NO: 155879 - DNA, 187 bp, Homo sapiens
cactaattgttctaaagaattgcatactccacactattggcactctgtagatgtcaaataataactccttggggagtaggagaggtcttttgttaaaatggagtgcaatgttcattgccatttgagatatatgttccttgataaatggcccagatatttgcagttgtcttttatcaagcattcatag

SEQ ID NO: 155880 - DNA, 249 bp, Homo sapiens
ccagggccaccagctagtaggcagcaagcgtccagtacacagacgtaggtcttttaatttccagaccagtgctgtttttcttcttgtgaaattgtcaattttagattggttttattttggagagtataagccttcttaagaaatgctttttagctgttgtgatcgataatagcataagtcctaaggtccatctgtgtaaacataaaaaccaaatagtctgttagtaaataaatcctacccccctttccc

SEQ ID NO: 155881 - DNA, 391 bp, Homo sapiens
gcctagcaggacctgccaagcactcttttcttcattccaatcagattataagcatcctgagggtaaaactcttgattatacttattcacattcttcacaatgcctagtactgcagtgaacatgcagcagacacctaacaaatacttgtttgttcttaaaagagataaaggagtatgacacaaggagcattttaaaaacaaacaaaaaagagataataaaggtgaaaataatgtttgccacattataggtaatcaatacatgcttattgtacctgaatggataatttctctactcaaaattaacaaatcataaaagaaataatcaaccactcactggcagagaaggtaagagcaacagaagaaaatgctaatttgaagaaaagagtgcttgg

SEQ ID NO: 155882 - DNA, 279 bp, Homo sapiens
  misc_feature (207)..(207): n is a, c, g, or t
gactgtatctcccattccagccccatcctataaacccccatgctgaagaggccctgccctaattcaaaatgagtatagttcttaaacactccctaaatgaaaagcacaggatgttagagcaaatacttgttaattcgtattggaaaacctaaagaataaaaagggcagccggatgcagtgggctcgcacctgtaattctaacacgtntgagagaggccgggacaggaggatcacttcaggccaggagtacaagaacaccctgagcaacataacagagcg

SEQ ID NO: 155883 - DNA, 295 bp, Homo sapiens
aaggtcactactgtcatggagtttagaactagtgggaaaacagaaacaaatgtaaaatgggattctgctgaaggttacaaagaagaggtacgaagagctgaatcaggaagatcagagaaggtgcccttaagaaatttaggagtttagaactagtgggaaaacagaaacaaatgtaaaatgggatcctgctgaaggttacaaagaagaagcatgaagagctgaatcgggaagataagagaaggtgctcctaaagaaattgacactgatatggactatgagaagtagaagatgacga

SEQ ID NO: 155884 - DNA, 687 bp, Homo sapiens
agatgatgcagagtatacccctcctaagatgcttcccgtggtccactacatatttaattgtagtattcccaaccccatcactctgtcattttaccccattttaattttactgatagcacataaaatgttacacaacatgttgatttttatttctttatccaattatttgttatctgttcctttcactagactgtaagttccatgagggcagaaacttggcctttgttgttcatgttacctttacattttctagtaaaataaatggagcatagtaggtgctcagtaaataaacaatgattaagtaaaaggtctcaacatttctgataagcataatagaaataactatcttccaacactgtcttcaaggggccagtactctaaactgccatgcaaatgtcaggtgtagtttattttgtccgtgttgagtcaaacgaactgagaccaaaaagtggtccttggagacaacaaatagacagagaagttctctttttttctgtgctggcaattttccactgagctaaaaagagataagttcatagtgactgccactaactttttagaatcctggggtgcaacacctctgcatttcttgccccattgcctctgcccttgtcctgccttgccctcacccccaagaaaagcatgcacccactcttccttgacagttagggttcattgttttcctca

SEQ ID NO: 155885 - DNA, 269 bp, Homo sapiens
catggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggagctgaccaccag

SEQ ID NO: 155886 - DNA, 381 bp, Homo sapiens
gtttgcaaaaggaagagcttgaattagatgttcttcacaatgctttccaggctccaattccttctactctaagattctaatattccttggtgaaggctcattccctcattggcacattacttgcctgtgctacttgacctgcagcttagaaattagagtaggttctaataaaggctagtgccaggtttatgcaagatgtggcctccagggagctggtttcataaacctgaggctgttgacctactccctttcctgaggttatgaagcttctttatgggcttacttgtagggcccgttcctctcttgtagctttcagagcaacattccctggtggcttccaggtgtagaactctacagtgtatgtcagtattgtccagaaat

SEQ ID NO: 155887 - DNA, 403 bp, Homo sapiens
gacccctctggggctatgtgggggacagactggagggagaaactagaagccagggagaagcctaaagtcagggtccaggtaggagagcaggagcccagagcctgcctgagccctcaggacagagaagaggggtggagtggagactcagcaggcaggagggatctggctaagagactgatgcgctgttggggaagaggggacaagatggagctttgacctcatgactagatagatggtggggctgcctcagatgaggaaaccaggtgagagaatttggggacatcagaggaaactgcagaggccactgggtgtgcacctgcaaccaggcactgcagacccagatctgactgtcaggatcccaggctcagtgcctcctcctctggggcctccgctcctcgggccc

SEQ ID NO: 155888 - DNA, 269 bp, Homo sapiens
tcctgctccatttactcttgtaaattagttcactggtttgcaggtgtgttttctcatcttcaatcagagtcaatgctgaccttcctcacaaggctgttgtgatgctccggtaaatgtgtacatatgaaaacaatttcaaaatcgtaagaagccatgcaaatgtcaggatgctgatgatgatggcggaagaagagcagcaaaaggaaaatggggaaaaagaagaggaggaagggaaagggtcaaatagcagaccactggtctgtgtgcaa

SEQ ID NO: 155889 - DNA, 604 bp, Homo sapiens
gggggagggtttgcgtgtgtgtctggaatggaagatgtgatggaatatttttgcatgtggatgggaagcgtccaacagagggagcaagaatgacaggagatggagggcgggactgaggaagccaggtcctcaagcggccatgagaagaaatggaggggctgggctttgaaacagaaagggatgattcctgctaaaagtgaaaaggagacaacggtgaaggagacacaggcgggtttaaagactgagaggcaggaaggttgagggagttcacgtcttagaacctactttttatggaggtgtcaggcaaggtcgatggctgagcaggagggagatgtggggtttgaggacagagattattcaacagaattctttctgaacgtgagaacatgggcttctaggggaagcaaagcaggaacatgcagccgtggtgtgtggttataaacttgtcaactcagtgatttttctcctgcaagctttttttttttttagacagagtctcactctgttatccaggctggggtgcagtggcgcaatctcggctcactgcaacctccaccgcctgggttcaagcgattctcctgccttggactcccaagtagctggg

SEQ ID NO: 155890 - DNA, 121 bp, Homo sapiens
caggctgtttgtgacctctaatctatgccagttattttatttatttgtttacttttattttctttcagctgacaaaatgatgtatattatgaataataaatttcagtctacattatttaca

SEQ ID NO: 155891 - DNA, 930 bp, Homo sapiens
gccaactggttagcatcttaaggactgaggcagtggtgcttgctattgaaacatattttctgtatgttttactatcaatcccataagggttattgcacgccatggcgcctgtcctttcctgaccctggacctcaaaggccgacccttacctgccacagcaaccagacgcacgaggagctccaggggccacgactccatggcacctccctaagtgggctcagtactgccgctgggctctaaaatgttggcccaggccttctcctctgggatttacttcctccctggctccacctccactcacactggtgcaaatttccagactgtggggcttggcttgctgattgacatctgcctgccctcctctgtgctgccctggagcctggcgcttccaggttcctagcagagcttcacctgccatatgaagggccccgatcagcccattccctggtgctagccttggctgaggccccacataaggagtcctagccacagctgtcatgccggcccctgcttcgtgacaatcctgctgagcactgcacatctctcatccaggtaattgccccgacgacaccatggaggggtaactggcgtgctcgcttcattcataaggaaaccgaggcacagagaggttgaatgatctcccaagggctaggggcgagccagggtccaagcccgggcacattggcagcagagccccagatacaaccttctttatgcctagccccttccactgcccactccagccccaaaccacctttcccatgaggactgtgacttggtttcccctcctctaggcctctcctcatttccaaactgccaagagcaaatcccatcctcatgggctcataggcaaggcataactgctattttaggtgaaatagctctctataaataaaaatcaagaagccgcaaagacgagctttacataaa

SEQ ID NO: 155892 - DNA, 390 bp, Homo sapiens
tgcccagctaattttttgttattttttttttagtagagacggggtttcaccgtgttagccaggatgatctcgatatcctgacctcgtgatccgcctgcctcagcctcccaaagtgctgggattacaggtgtgagccactgcgcctggcctgtaaaaatagttttaaaatgaaattatatacattaaatggttacattttatgatatgtaatttgtaccttatgttttcacatatcatagtgcaatgagggttgggggaatctctgctaaagtcaatcattcagagacccatgtttacagagtctgttgctttcagtatatgattctgatagatttcttatgttgaaatccagcttgcaaatggtggatgggagagacagtggaagttata

SEQ ID NO: 155893 - DNA, 135 bp, Homo sapiens
cacctacattgacaagaaatgccccttcactggtgatgtctccattcgagggcggatcctctctggcgtggtgaccaagatgaagacgcagaggaccactgtcatccgccgagactacctgcactacatccgcaa

SEQ ID NO: 155894 - DNA, 433 bp, Homo sapiens
caacatggtgaaaccctgtgtctaccaaaaatacaaaaattagccaggcgtggtgtcgcatgcttgtagtcctagctacttgggaggctgaggcacgagaatcacttgaacttaggaagcagaagttgcagagagccaacttctggagttccagtgcactccagactgggaaacagagcaagactctgtcaagaaagaaaaagaaagaaagaaaaagaaagaaaggaagaaaaagaaagaaaggaagaaaggaagaaaggaaggaaggaaggagagggagaagaagaagaagaaggagaaggagaagaagaagaagaagaagaaggagaaggagaagaaaaagaagaagaagaagaagaagagaaggaaggaaggaaggaaggaaggaaggaaggaaggaaggaaagtaggaaggaacttcccgagactgcag

SEQ ID NO: 155895 - DNA, 387 bp, Homo sapiens
cgaaggacaagcaagctatagaactttatgtctgcaaggaaaacatgaacatagacaacaattgctgtcagagctgcattctttcagaaacttggtattaacttctctcactggaggtcacatagcaagctggcgtctgagccaaacttccacgtgtttggagccattttgatattcaccttgccttcccccccaatccccatttgttcagtttggaaacacacttatgcacacaagccccatggatactaagtggtgagcagcactttgtctctcccgttggctggcctgcaatgcctattccagcccacgtggctttgtcattaggcccaaaggccctgcatgatgtgcctgtaggcggctgctcccttgcttctagctggctcc

SEQ ID NO: 155896 - DNA, 521 bp, Homo sapiens
tgtaatatgtatagcatcaagtgcgtgatgcacagatccacagcataggtaccaacagaaagcacctttcaaatacagactcccagcccctccccagacctactgggtcagaatctgcattttaacgagacctaggatttatttacaccttacagtttgaggaccccaagtgtatagaacccacaaattctcccattctgatagacagcatagtttactttcttactttaataagctgcatcacatacctgcacactagaggaaattatacagcaataaagcataattaggttttgctcctaaatgaattaaatattagcttttacaaattgcctatcaaatcacaggagaatcaaagtgcttttttgagtccctagaaagaacagatacacaaaagtgtactacaaaagtgggatgaaggccgggtgcagtggctcacgcctgtaatcccagcactttgggaggccacggtgggcggatcacctgaggtcgggagtttgagatcagtctgagcaacatgg

SEQ ID NO: 155897 - DNA, 227 bp, Homo sapiens
aagtggtcttgcaagactagcagtgatttaatgtgggaaaatgttggccttggactcctggagaaaatgcaatgactgttttcccctatgtttcatgtgcggcatggccacagagcagtgtatcactggaatctgattcattggtatttggagcacctacagcatggagcgattggcgtgaggccatgacagaattgatcaaaactgaatttgctctgagaaacgac

SEQ ID NO: 155898 - DNA, 298 bp, Homo sapiens
ataaatcagagatcaaggtagaataacaaattaagatgaagtggccaatccttcaaagttgaagcagggcgagaacacgggagtgagagcaggaatgtatgttttgtatttatatgggaagtggctcccaatcttgctgctgtagggtggattaatggtgaaagtcactcacggaagcctgaagctctgagaataactcggcaaattctctgacttggaaagaaaaaactaagtggggagtgagaaagcattttctcaaaaactaagtgggagtgagaaagcattcacttcgacacag

SEQ ID NO: 155899 - DNA, 448 bp, Homo sapiens
actctacaggaccttacgtaatatgtaacatgggagacctagtcattgtcatctctgtgttttcagcagcgtttaatacagggccttaccgctagtaagcatgtaagattatctaatgatggattgagggtagggcaggttccgatggtcagatgtcccatagaaggtggtccctaacaagaatatacattgtaatgttccaggtttgtctattctgatactgtgcaaaacgtagatcttatagccaagatcaaggcatcgaaagtctgtggacctaagcctgtgctttcactgagtgaagtttgtgtttcggagtacatctgaggtgtttctttccgtgtagtttcacttgtgttggagaagcaggtggctgtggtctttgcagggtgtgagaggggaggagattagtgttgagctccagctaatgttacataactctactgtagtc

SEQ ID NO: 155900 - DNA, 416 bp, Homo sapiens
ttcaaggagaaaaagcagctgtgcaaagctctggaacaagcgggcttggccagaggaaactacaacagccaaggccctggggcagaaggaactggacatgatggaagacagaaaagagaggagcctgcagccacagaaaagagtttggttttattctaagtgcccttgggcctgcctacttaacactcattctgtctttaaggcacagttccatgctgcctcccccatgaagccttccttgaatgcttgtctcgcccttccttgccaaccactagggccctctggcagtcaccccactctggccctctctcccctgctgtcctagagaatttgtcaggaagccaccctcctcaggaccccctctcatcttctcaaggggatccctgatttatagcaacagggtcagcagccccttg

SEQ ID NO: 155901 - DNA, 345 bp, Homo sapiens
tcggtacccttcaagttctcgtttgaatatttgtactaccaccaagatcctgatgggcagacgctctcagtcttcgtcccatcagtaagttatttatagagaaaggcgttccttatctggcagctcaggtggttgatctttactttcttgtgccccgtggaggctgggacatgatgtagtagatctgatgtcagcgccacagaaatctcttgcagccttctcttcagagtctcagtgggaagaggtctgctggctttcctctttatagtgaacacacatttgggaagcttgtgctcagttcttaacatctgatatagccaagtaacttttcagttgctccacaca

SEQ ID NO: 155902 - DNA, 466 bp, Homo sapiens
gcacaggaatcattgaagaagtcttctcaacagaaataatgtaaacctaactttgatctgaaggaagaaattttataaaagaaaggaaactttcagtcttcagggattcacaaagtctgataaaaattggtgtattagtctattctcgtgctgctatgaagaaacacccaagactgggtaatttataaagaaaagaggtttaattgactcacagttctgcatggccagggagacctcaggaaacttacaattatggcagaaagggaagcaaacatgtcctttctcacatgatggcaggagagagaagtgccccttataaaaccatcagatctcatgagaactcactcactatcatgagaacagcatgggagaaactgtcgctatgattcagttatctccacctggtcctgtccttcacatgggtattattacaactcaaggtgagatttgggtagggacacagagc

SEQ ID NO: 155903 - DNA, 268 bp, Homo sapiens
gtggaaagattttcaaggaggaggaagtggtcaataccaccaaaagttaggtaagagctgaaaaatggccactagatgaacaattctggtgttaatggtgaacaaatccacagtatactgatcttattctactgggggatcgggggggcagataaattggcaaatatgagaggattatagaaagaagtttgttgggggcacaaaagttggagtggccagtaatgttagggagagatatcagaaaacatttaattaatgaaatacttat

SEQ ID NO: 155904 - DNA, 561 bp, Homo sapiens
tagtgcagcttgccagccacgcttaaggtttgtgccgctcctttccaaaagcattcaaggtggatttcaatgtttaaaagttgcagtgtttgactcttaaggaataaaacctgagagattcatccagaaattcaaaatgagtaattacaatgacattgaatttggccacgaagttcctgagcagacaagacagcgatgggccacgcaggttttattttctgtcccagcagagcatgtggccacttgagccgttctctgtgtcatgctgtttagatagccctgaggacagcgctgttcactctccagtctcagggcccttctcaagggaggaggtgctgggtgtgggtatcacagtggcctgaggactgggggttgcttggcgtgattggtggcccgttagactaagttattgtgaacggcctgtcactgctcagctactgccaatctaattactttttctcttttcttcttgtattctcgtttttgtttgttctccacctggattctgtagtataagtctgtgtttaggtcctactcccaggattccgactccccaccacc

SEQ ID NO: 155905 - DNA, 574 bp, Homo sapiens
catggagccacctccaaactggcacctctcaggccgtgcgacgccctaccaggctggcggctgtggcaggtgctatatgtgacttagccacaggactctcgggtcctgtcccctgacatggtctttgctgtgaggctggtgttctggtcacaacgcaccaccctgaggcaccccatgctggtggactagaccttccatagccacagagagtgatgctgcctgaggatctgcaggtgggacaggcagactcagacccagaggatatgcccatgcctgttggagccgtcagcgtgctgcccagcgcccacaggcgggcctccctgggaatggtgtcttgtgggccgatcacattggcatctcctgctggcaggctggacactcagtagcaacagcgactgcatcagcctttggtaagtcagagactgtgctgttgaggcccctctggccagccctgggtggccagcgaccaccagccatctctcaaagctgttcagtgccccctccatggcggatgctctcaggtggacattaatgtgagacagcaacctgcacgcttcccattcctccacccacc

SEQ ID NO: 155906 - DNA, 513 bp, Homo sapiens
gaaaatagaaatgattgtcatcccccaactccacagataaatctcaatctgtgggctaagatacagaaaggaaatatgtgaagattaaagtggcgacctggaaatgcaagctgagtgatcctccaggatacagtgcaaaataagaagtaataaagtgatggggaaaaggttaagagacaaagaaaatagagaacacaagtccactgaaaccctagcagaagttgtgaggagaaactcatagcagatacatcttactgaaatttttgatgagaataaagaagttttcactacatgttctcacttataagtgggagctgaacaatgagagcacatggacacagggaggggaacaacacacaatggggcctgccggcggttgcagggccagagagagccccaggaaaaatagttaatgcatgctgggcttaatacctagatgaggggttgacaggtgcagcaaaccaccatagcacacatttacctattaacaaacttgcacgtcctgcacatgta

SEQ ID NO: 155907 - DNA, 570 bp, Homo sapiens
taagatggtctctctctcagtctctctctttctctcgtgtttctggtgctatgttcagtactcgctctctgttcccattgaggttgcagcttctctgctgaatcactgctttgtattcagccagggaccgtggagtattcccagtgtatttattttctgttcctgagctgaatgctgggtgcttctttgtcctgatgccttctgcaaaggagtttaggaggtgggggatggaggggaaaaagaggaggagggataggaaagccaataaagctttctctatcccccagaggaatgtgtgcaaacatctttaacattgctttcctcagtgttctcctctctgccacccttgctcttaattggatctagactctagagaaaacaactttgttaatgggatggttaaagaaaaagagaggtggatgttggctgtgctcagttctggcatcgtgtcctctttgggaataaaagtctcagatgcctgatctgaggaaggaatccactttcttgatcatgaggaaataccattttccttctgttgcaagtttttattcccctcttaaaatgaaagat

SEQ ID NO: 155908 - DNA, 170 bp, Homo sapiens
acattcctggctggtgacttcaggaagccctgccagaagtagaagaaagaagggcgtgcagacaggggaggttattccaggtccccctggaaattcctgttctacccttcgaaaacctgtgcggaagctcccctccttgaggaagccttcctcaatgaactctcgaatga

SEQ ID NO: 155909 - DNA, 266 bp, Homo sapiens
aaaaaaacaaaaaaaaaacttattattgaacactacatgttctcatttatactctgcatcacttaagaaaagattttagtttgattgacataaagtcaggtgatattttcccccatacattggtagctaagacctcaaaatgagatgaagtttctatgctttatgagatacctaagtggaaagaatatcagatttttgtgtcagttgtgtgactgcttcagctgggaaggacccagcataaaccttaatttttctgaatctctttg

SEQ ID NO: 155910 - DNA, 655 bp, Homo sapiens
ttcaggctgatcccagacatggtggggtctcccttgtagcacagacccaatgaactggtgcggctgagcctgctcagaccagggatggaacatggtttaggcaccacccccggttccttccagagaacgatatgcaagtgggaaaaataaagggggagggaaaagcggggaggagaaagagaaaagaaaagcctgaaaaaacagtgagtatggaatagccttccataggagtgcatgtctctattagcaaatttgtctgaaggtgaaagcctggaaaataatttcatgttttgtgtatgaagacactgggcgtgaaacggtactgaacaccaatcctgcaatgcaggggaattttcctccgtgggattcagaaatgagaggatcaccaccaggacaacacctgaagatggtgttagctgaaggcagacattggggacctgaagtctgtctgcatcaagaccttgagtaattggccacagctgtacccaaggagttcctgggctggggagacccttcatttctcttctccagcttcagctaaaggcctagagacatggagaaggaagcagaatacagtacttcaattgtcttcctactgaggagccattctcatttagacctggcggttctcaggtctggatagtgtcattgtgcg

SEQ ID NO: 155911 - DNA, 608 bp, Homo sapiens
ttcaggctgatcccagacatggtggggtctcccttgtagcacagacccaatgaactggtgcggctgagcctgctcagaccagggatggaacatggtttaggcaccacccccggttccttccagagaacgatatgcaagtgggaaaaataaagggggagggaaaagcggggaggagaaagagaaaagaaaagcctgaaaaaacagtgagtatggaatagccttccataggagtgcatgtctctattagcaaatttgtctgaaggtgaaagcctggaaaataatttcatgttttgtgtatgaagacactgggcgtgaaacggtactgaacaccaatcctgcaatgcaggggaattttcctccgtgggattcagaaatgagaggatcaccaccaggacaacacctgaagatggtgttagctgaaggcagacattggggacctgaagtctgtctgcatcaagaccttgagtaattggccacagctgtacccaaggagttccttcgcacaatgacactatccagacctgagaaccgccaggtctaaatgagaatggctcctcagtagaacaattgaagtactgtattctgcttcctctccatgtcttagctat

SEQ ID NO: 155912 - DNA, 442 bp, Homo sapiens
taagagctgtgtagtcaggcaggaggtgagacctagaaggaaatccatggcagaatgaactgatggagggtcagggaagaggtgagtgagggtgctccagggaaggggtacaagcactgccaggagctgtgggtggcagcaaatgggttgcaagggaagtgaggctggatgagcagggtcacactgtcagattctagaggtttaggaaccaggcaggagatcagccctgacaggacaggacaccaagaagagttctgtagcaggaaaagggtgatgagagccatcatgaaggaagattagcctggctgtggtgtgcaaaggactgaagtcagaggctagtgtgctgcagtctacaaataaatgatcacatcacacagtagggtggaggcaacaggaatggagaaagaggaaggaaagatccttttctcggagagaggctccg

SEQ ID NO: 155913 - DNA, 441 bp, Homo sapiens
cacacatacacatcactgtgcacacacgatgactccctgaagggcctggagccagcgggaggcagccatccccagctccacccactcaaggggaacgcagggctgaggctgcactgcgagctgtgctgaggcagaggccgacctgagcacagcccgttccagctgcagatgtcagaggccgacctgagcacagccctttccagctgcagatgtcagaggccgacctgagcacagcccgttccagctgcagatgtgaaacctgaacctggcagcacggaagtcacaagggccgacccaacgcccccaggtagctgcatctgtccccactgtgacaacagcaagggcttcaggggaatttggtgttcaaaggtatgaggttctgtcttgtccagagagtattttagatgtcctgagtagaactcagaacacagaaaacgctgt

SEQ ID NO: 155914 - DNA, 406 bp, Homo sapiens
ggtggtctgtgcgtggacactcgccaggggacgtggccagggcgtgtctgggatcttgcgccactgaagaggctcccagtcgtcaaatagagtgagggatgggatccaaaggacggcgagaaagcccgtggttgtctaaacgtccctggctccccgagaagcagtttcctcggggccttcctgccttttggatgaatggagatgctgtgtctgggtcactgccagagccggggcaggagaggacagaggcttcccggagcggcagggcccgtcgctagagggcggggcccgcagtcgggggcgggactttggcggcgctgtgcatggggattggcttttcgcaccgcccctccgctcgagtgggccaatcggagacggccccacctcctgccccgccgcgcgtatt

SEQ ID NO: 155915 - DNA, 561 bp, Homo sapiens
ggtgggtctactgttttgtcattgtattggcatggaattgtatgagaataatggcggagaaggcagtgacctctcctgctaggaggatatcaccaatatcgatttggttgccatggagactgtgaggagggaagcactctcttcccacaggccacaggcagtgaaactgaggcccaagggaggggggataagatacagtagtagcctaggcagaaaaaggccacttaaccccatcaggaccctctggggaggggacttactgcagctgcctttggggtcaagaaacccaagcttcttgggagaggaggggggactgtgctggctccgtatgtggctgggacctcatccgggagatgctaaagccctgcctgctccttaggaactgttattgagctgatggagaagcccagctgctgtaggagggaaatctgaaccttctaagggagccacccctcccagccagcatccccggagtccctccctcctcttccctgcttcttcttggtggggtgtttgtgtgtgtaaaggggtggggagaggcctacagagccaatgagccac

SEQ ID NO: 155916 - DNA, 668 bp, Homo sapiens
atcatgtgggaaattttttaagaagaagaatacaatataatgcatacaaaattaggtttagggtcttggaagaaacatttatagatcagtggtcataaagttgaagctttatcagcttcgtggtcaatccacctctggttaaaagttgaaggtctggatgtgtggatgtgaaaagctttgcttttggaaaagggagctaccagcgatttataatttccatttatcttagatctgttcagagaacatctttttaatgacctagcaggagagatgaattttcttgtctaccatggtccttcatttactcaacaaatatttgttgagtgactactttatggtgggcactgtggatatggtgatgaacaagatagacttgatacttgccctcatagaatttagatttagtgggaaagacagatgttaacacacaatttgtgtggctattggagtacataatgagtgaatgagggacggtttattcataattagcatatgagtaatcttgaggtctttcattcatctctatacgttgctactaaattctgtttacttatttttttgacgcagggtctcactgtgtcactaaggtgggatctcagctcactgtaacttctgcctccccagctcaggtgatcctcccatctcagcctcctgagtagttgggactg

SEQ ID NO: 155917 - DNA, 406 bp, Homo sapiens
attttattttaacatttacctattatcctggtgttgtttacaagcgtgccctcgctcaagaatgtaaactccaatgagagcaggaactataccataattatcatctctatatcctgagtacccagtacaatgtctgctacttttagggcacacactagaggttcattatgatgactaatggatataaatgtgttgtattagttaggaccctttgttcaagtgatagaaacccaactcaaactggcataaacaaaataattggttgcctcataatactggggtaagcttggatcgagtggctggatcgagtgtttcaaagaatatcatagggaattttgttttttatctcttgattttgcttttctttgagttcctttgacgctctgcccatgtagagtagcacctg

SEQ ID NO: 155918 - DNA, 416 bp, Homo sapiens
tctggcctgccatgcacacaagcataacaattgttttgtttaacgtgtggatggaatatttgatccattccaaccaggcatttgcatcttggtatcctgtcttaattgccaaagtttgttttaagtctttaacttctatgatcctctagtaaaatgaatgtatgattttaggaaattacaaaaaccggttggggcagtccatccttgctctttagtggtccgcagaacgttggaccaactatggcataaaagctctacatcggggggcaagactcctggttgacactggggtctgtattgaaatgctgaatttgatattatttacttaataaaatttaagttggatgtcttcatgttcagagaaagcagaatgcctccacctatgcagttcaaagtctgacttctttgaatctatc

SEQ ID NO: 155919 - DNA, 352 bp, Homo sapiens
aggatggatgtgaaggtaagaggggtgtgctctctgaggaataattggggtggcgtggggtacagtcctcatcccagagcagaggtgccctcagaaatgaaagcatacaagcccaacaggtttcagcaggcagggggctagtgggtgagtttgcctctccttccctgtcatttccttttctctctttcacaatctcttccttttctttctgtcctttccttaaatgtctcttctccaaatagctagtttttcttaaaatggtcattattagagataaggccattatttaaggtagaagtatctttaaaattaacctttgcattgatttattcaactactcccttatttttaa

SEQ ID NO: 155920 - DNA, 550 bp, Homo sapiens
caacttcctagcgatctcattctaccaataattccctctcacgtgggtctctcagtatttaaaatatccaaatctcttccatcctaaaataaataaaaataatcttcatgaactcaattccctctttacttaacaccatctctctcccattctcttcttaggaaagctacctaaaaaagtattctgtattttcttgtctctattatcttcacacctctacctgttttgatttggcctctttcttaccattccactaaaactaagtaaaggtgaccagacaaagtgagggaattcttgttcataactctatttttccaataaagaagaaaattagattgttaacataatagaagtgatgggtagggggatgctgatgagttgaaagatattgtgagagatcatctatcacctcttccttcacagtctcactcattcagcaaacactcataaatgtccacttgtaccattaacaggcattggttatacaaccatcctcatggagcttacagtctaatgacagaaacaccatggagaagagctcaagggttgt

SEQ ID NO: 155921 - DNA, 477 bp, Homo sapiens
aaattctagtgacaaaagtattcctggaagaatgagcagaacacaggcatagctgtatagaatgtcacttcctcttttatcatagagaaagaagcttggacttcaacaaaattaagtgcatggtgccactctgtttcaggcatctgtgggctaatttgtgtagtcccatagagtctctatgaaagataaattgtctacgagcagttatggctctcccacaaccatttaaaaacttgtctttactatattttatgccataaactaatttaattccacaaatacttaactttggcatcaccgtgaggtgttgaatttggacttctaagaacataggaactggactctccattcaacttattatgacttgagggaggatcagagaaaaatctacttccaaagaaagagttcctaagccagattcgcctgtgttgggcagtggagataattactaggacattttattccaggttctgacag

SEQ ID NO: 155922 - DNA, 215 bp, Homo sapiens
tccaggctcaatattctttattgataagcattagtgaaccccttgccctgggagctcagccagtcctgctctcagattcctggccttaggtgggagagcatcttttcctcatggatcaactgtccatgtctgactgtgcctaacttgccagatcatgggtcagggagacaggcagcaggagcaatgggctctcgcttctgtcctgaggttcttgg

SEQ ID NO: 155923 - DNA, 576 bp, Homo sapiens
gtgctagacatgagagatacaaaaatgaaaaggaacatggtctctgtcgtacaggaatttaccagctagacagaagagacagggaaagaaactggcgttgatcatactgaacgccatcatgaaggaggtttgagatactgctttttcctctctgtgaagtcctgagtccatggaaaggccgaggggagaaacatcggcagcaacatggcagctctattagtgatggaaactggattgggaaatgcgatatcacatctgtcacctagaggttttggcaacaatatttcggcctagaattcagcccagcacattcagtgtactgtgcttacccagcctctggcagagtgggacagctgaagcttcctggaaaggaagaagctcttgttacccggtggaaagcagatcgcaatggatacttcctgcagtcagtcaagcttctgaaagtagagaatcagggaggagctaagaaaagcagcggtcaagataaactaagccccttatccccagcccacaaataaaatgcttcagtctttcttccatgggaatgaagtcagggatacagaaagaaaccaaata

SEQ ID NO: 155924 - DNA, 248 bp, Homo sapiens
ggagaacgctatggtctgtaaggctaaaattggagcatgacgttgaaaataggattccagattacatgcatggggcttctggccacgcttgaatagtagacactggacttgaaaatcacttgtttgggtctgcaaagcatgcattttgcacccacaacactgcctggaatcagtgtcagttctgggccattttcccattttattcaatcaaccgttgagttcacacgccagccattccttaagtgtca

SEQ ID NO: 155925 - DNA, 312 bp, Homo sapiens
aggaggcggaggaggttgcagtgagctgagatcatgccactgcactccagcctggcgacagagcaagacaccatctaagaaaagagaccatgtctcccaagttccagaaccacgtgctatctggttatattagatcttctgattcattttgataaaacttaagatgctaatttcaagtatatcaagattaaaatctgactatactgaaacagagacccccccctttagcatctgctacatttccttagagaactctccagtgaacagatgaattatgatgcctccatacaattaaatgccatgctgtgaaat

SEQ ID NO: 155926 - DNA, 348 bp, Homo sapiens
gtacataacaaaatgaaggcagaaataaagacattctttgaaaccaatgagaacaaagacacaacataccagaatctctgggacacatttaaagcagtgtgtagagttctttcttttctttatacaacttcctatttatgttcctcggttataaatgaagttccagtccctgtgagatttcttgcattcgtggattattgacattaagagaaactgagaagagacaggcaacaagtcagcacaatacagtccacagtgtaggaaagccttccagaggttgtattctcctcatgatagtggaatcaactttataaaatcacagatactagtttcttgaaattccactta

SEQ ID NO: 155927 - DNA, 578 bp, Homo sapiens
aagatggggcagggaagatagagagaagagaaaggctgatagaaatggggttagagaaagagagcatgagagacagacacacagagagaaagacatacacaaacaggctcagagaaagtgaggccttctcataatcattaagcatcattcccccgcccccactttttttgtaaacttcccaacacctttcttttttaatttagatttttcaagtcctgggtatgtatatttgaaggcatattttaagtcagcagtgtgcacacaaaccaggccacaataactcctctacatgtagggaggacatttgggcatttaattgaaagataattacagattattaaagaaatcaaacacaaaaagccagtcaggaaatcttactttgttctaaacaaaactgttggtattttcaaagacagacatcagtcaaaggtcagacacttattagctggtgtttttctttgcatacttataaggagaaacagagttgaataaaatctttccctgaatggaatactgataacattactggaattttattctaggtatatccatccccacccccaccatgacccactatg

SEQ ID NO: 155928 - DNA, 522 bp, Homo sapiens
gagatcgcaccgctgcactccaccctgggcaacagagcgagactgtctcgaaagaaaaacaaaacaaaacagcttgaagcggcagggttacagctctgcgacggcccctgcaggcggggtgtgctgggcagagtgtgctgagagcagcagctcaggacagttctgcagccacatttacacccacttttaatttcatgtagattaaggggcagcccaggcaaaagtttctagggaaggggtagtaacttttgggtcgtggggtcattgccatggaaaggggtagtaactcccaccatgcctggcctgtttactttcacttccagcttgcccttgaattgtttcctgggcaaagccaggaaccctcgaggggctcagccccactgtgggtcttgcctgccctccatcaactagaaggcgacgtagcattgagttaatccaccattactttaaatggcatggataccactcatatagtattgagaaaaggaagtcagatacaaaagagaacatgcaatataattc

SEQ ID NO: 155929 - DNA, 267 bp, Homo sapiens
actctggcactcactctcggttatttttgttaaaatgaagttatatgttgttctggctatctttgtgaggggaacaattgctagagtcttctacttggctatcttgcagatgtcactttttctcttttaacctttgtagaagaggtaaaagtgatttatacaccaccattacagtgtcagaatattcttgactataaacttacttttatcaatgagttgatagtttcatgtttcaatattttaataagtagtatcactttgcttcag

SEQ ID NO: 155930 - DNA, 240 bp, Homo sapiens
ccatgccttctttcagatgtagtaatatgttatcattctcctctgtcccacagcctttggaagtttaataacttatgactgcaaggtctgttttcctcatctgaacgtcataatgtttcatcttccctgcctgagcatggaaagacccacctccccaaggcaagttgttgagggctcctgaatatactcaggtgtagaaagacaagtctgtcaaggacacaggctgtggcggtccccagg

SEQ ID NO: 155931 - DNA, 857 bp, Homo sapiens
ggtctcagtccccgcggcgggcgctggtctctccacgcggctgcggcccggtaccctccgcccgccgccgcctctggtgaccctggccctgaccttctccctcttcccttcctcctcctcctcctcatgtctgcctcgggctgtttggtgctgaagagcgtttcttctccgtctcgtgcaccgcatcctgacgaaattgtctggtcaccagaaccgagtagcccgtagcgtgtcccccctggccctgcacggttgcccctctctggggctcggagccggttcctcccggggtctcagaactgggagtgcagacgttggcgtttctcagactccggagctgcccgggacaggaatgcagccctaaccccggcgtcgcctcggctcgtgcagtttgagcggtgtttcagcgctcacgtccgaccccaggcagtctttgagcttcgcctcttgccccgagaatgtgtaatgatcggagaatgcaggtggaatgaggttctgcccctgcttgcaggagtttggtttctgggaaagcaggcgtgaaaacccaggcccgggttgatttgagaaacgcaagtggggtctggaaggacctctcttgagagaggaggtcatgcttatgttgagtcttgaaggtacgttgttagatgtgagaggtgggaaaaaggctgccggcggaggaagtaagtgcgaaagtagcagaagcgaagccccgtagtgcgttctggaagctgcaggttaggcagaaagaaaggtttgaggaggggctgctgtgtttccaggagtagtcaggtcagaacatggaggtttcttgagaagcagtaaagaagcgccattgagggtccttattttgctagagc

SEQ ID NO: 155932 - DNA, 621 bp, Homo sapiens
cttcagggattgccagccttttcatgattacgattatttttaaccaagtaatatgattagtgctggtcattgggagaaacaaaagaggttatctaccatcccagggttccagctgccttgagggctgagtggtacaatatccaggcatatctgtatatcatttgagacctacctgttgggacattctgatatgagtggaccttgacttcatctgccttttttcttgaagaattccataaaatgtcaaaaatatttgttttcagaaggaatactcacattcttgtgagcatacaccaactgtcaggattggggtagtggaagactgaccccaaagaaattttatgcctttgaagaaactaatgaattaaagtgtcagtgcttctcttgagtggagctttctggctctttgcagatttttatggtggcttagtttcttgttctgggttgttctattaagattcaacagctatgttctgtggctcaggaaggattttaaaaaatacatagtagcttatgcctgtataatcccagctactccagaggctgaggtggaaggattgcttgagtccaggagttcaagaccagcctgggcaacatagtgagagagagcccatttcttta

SEQ ID NO: 155933 - DNA, 350 bp, Homo sapiens
catttagccccggtggatgtgaggagctgcagaagaccatgagctcgcacgtgatgtgaactttaggaagggcagtctgccccagtgggtggtatgggtttgaatggcacttaggaagctttgaagagtacgaggaaagtggctctgatgtcggagtgacagcctgcaaaagtaacagggcctcctgagggaggcaagggggatttctgtgctgggcgttccctccccaccccctcacctttgcaaagagcaaatgtcttcttgcttggcaccagccggaaggcctcccccaccagagtcctactaggactcaattcagagcaccccaggccactacaaaaatgacagcc

SEQ ID NO: 155934 - DNA, 345 bp, Homo sapiens
gacactctcagaaccatgagtcacacataactaaagcgtggggagcaccagcactacggtgaccaactcatcttggtttgcctgggaatttcttggctttaacattgaaagtcctgttctaatatatccttcagtctggggcaagcctggacttttggtcacaccagtccacattaatattgtctggtccacgttaatgtggactggtgtgaccaaatgtccaggtttattatttatatgtattttcaaatacaaataaatcttaatttcctttttctttgcttattttttcttttacttctttttcttttttaaaataaattagaagtttcttttctcattcca

SEQ ID NO: 155935 - DNA, 352 bp, Homo sapiens
tctggctagaggtgaactctgcctacatagaactgatcatctagtttgaaaatatgagaaaggccaggcttggtggctcacatctgggtattcccagcattttgagaggccaaggtcggaggattgcttgagcccaggagtttgagaccagcctgagcaacacagcaagacctcatctctacaaaaaataaatataaaacaattaactgggtatagtggtttgcacctatggtcccagctactcagaaggctgaggtgggaagatagcttaagcccaggaggtcgaggttgcagtgagccatttatcataccactacactctagcctgggtgacagagcaagaccctgtctc

SEQ ID NO: 155936 - DNA, 726 bp, Homo sapiens
gtggattactatttaatgaatatttttggaaaaactctatttcagtttagaaaagaatgaactgagctcctatattttcattctacacattgcagtgaattccagatgggactcaaagacttagcaacaacaacagaacagaacagaataatttatattttctggctcttgctggggaaatacattctaaatattgaagaaaaaggaaatactttcagggaatgcatttctgaatatatatgtaaactttgcaaagctttttctgtaatgaaatcttttaatattttggtcaagcaacagaatggaggaaaaacaaataataagcaaatacttgcttattaatatgtttaggaaacacttggataacacacatacacatatgaatatatacacacacacatatatatatatgttctacatgatcatactaaaatttagatgacacttcgtccaggaagaaatattgaagaaaatgcaatcatacaaacacgacattgccacaggggaaaacataacatccatggtaaatataacgatacaaaaatctgttacatttagtaaaaagtgcagaaaaccggcaagaaaaatgcaggagcctgattttggtagaaagtggcaaaaaggctctaaatgcccagtgcaaatggcttgaaattccattcccaggcctggggctccacatttccaggggctctgctttccaaaagatatggttcaatgtcccct

SEQ ID NO: 155937 - DNA, 350 bp, Homo sapiens
attttttaatcataaatgaaatgggcacagaaattatttaaaatttaatcaaaatgtataatgtatgaaaaacaatagttgaaatttccagaggcaactactcagctttctgcttttattttagtgttttcaggtgattattaccatatctctaaataatattttcatattactatttttagaataaccaactttggactttatctcttgaatttttttctgtgccagatgaagatttaattcactcataacatgccttgatccttcttctcttttcagtttttgagatgttgactactaatttctgtgcccatttcaaatagcccaaataatttctgtgcccatttcaa

SEQ ID NO: 155938 - DNA, 318 bp, Homo sapiens
tatctatcaccatctgggccaggtggcaaaataaatctatgatctctatggaccatgatctcttacagattgaagtgcatgtaccgcatttcctaccaatggcccagccagcaaagtgctgggcatgcaggttactaggcatcaaaggacggagctatcctcttctcagtcagactcttcttgctgcaatgggacccccaaggccacagaattgtcctaacactctagtcatgaatctttaagtacaatggcttttaacatgatcaagttttacccaagtctgcaagggtacacattaacaagaagtcaaatgaatca

SEQ ID NO: 155939 - DNA, 159 bp, Homo sapiens
gcatggtcagccacgtttaaaaagaaggacatttccacagcttggttgaggatggcttgtatattccccatcactaattccagcattatttctccagtagtaataatgaatgtgccctcatatagccacatttccccaacccttattataacaagttaa

SEQ ID NO: 155940 - DNA, 119 bp, Homo sapiens
tcacttcctggttgacacccaaaacaacaacaaagattcacttcctctgaagcctgcactccctagttcattcttgacaccttgctggacacccacagcaggcaaggaaagttcaacag

SEQ ID NO: 155941 - DNA, 233 bp, Homo sapiens
tgatgttttcaagattttctctttgtctttggcctttagtagtttgtgatgtatctaggtgtggatctcttggtgtgcatcgtatttgggcttcagtaagcctcttagattcatagattaatgttttgttttgttttaccaaatttggagagtttttactcatcatttcaacaaatttttttccttgcctcagcctcctgagtagttgggactaccggagtgtgccaccacca

SEQ ID NO: 155942 - DNA, 455 bp, Homo sapiens
actgtgtgtgacttctcagttgacatgcttttaacagctcagcttgtttgtgtatgctagacattcttaaatttttcatatttttctatcaaaagagcctgataggagaaaagtgttaaagtagctggtacagaaaaagttggtgttaaaattatctatttgtctcaaaatttgtgattcaggaaagcactatcatgcattagtgcaactattgcaacataattgcaatatcaaaatcatatatttatgtatataactttagaaaggtctaagtagggttaatataatataaaacaaaacatcgatttacagctttaggtaggtctaaagaaggtgaatataaatcagaatattgacatctaaagcccatgctagggtgaaaagtatcaaggagtgcccatactcagtgattctgaagcaacattattagttaatagtttcctagaagttttgac

SEQ ID NO: 155943 - DNA, 487 bp, Homo sapiens
aattttactgctgcccattgcattggagacacagtttgttgaactaggtgaagttaacttcctactggaataaaaatagcactcttctgaggaacataaaagaatacagactgtctacaatgtattattatgaagtccagtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattgctaaaatggaaacatcattaggtgggtctcaacaccagactgaataaatcagaccagtgaacttgaagaaaacacaaattactcagtcgaagaatggagaggaaaaaagat

SEQ ID NO: 155944 - DNA, 429 bp, Homo sapiens
ttttgggggggggggggggggggtgtgtggtgtgggttttttttttcccatctcttaccagcattatttttttttagttctgtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattgctaaaatggaaacatcattaggtgggtctcaacaccagactgaataaatcagaccagtgaacttgaagaaaacacaaattactcagtcgaagaatggagaggaaaaaagat

SEQ ID NO: 155945 - DNA, 355 bp, Homo sapiens
ctctgctgaaccctgatggtgatcgcaggcagtgaaaggcataggatgcagagacacggggtcaaactagacccccagtcctggggcccaccttctactcaggttggctgactcctcagtctccttgttttcagagcaaaccacattgagggcgacctcagctgtgagtgggatcagagatccaactggacaccagctcacagcgtggagcagggaacattctccgacttccacacgggagaaaaggctctgaattactaaactcaaggctgttttacaaaattatctcaagatatcaataaacaaacatagatcttttaccttagtcttaaataaaatggtatcccaccgatct

SEQ ID NO: 155946 - DNA, 710 bp, Homo sapiens
tgctgacaccttagcagcaatcaaggcagtggcgccagtcttgtactggtagttgcattttgtattcttcacatcatacaacatttaaggttttaaagtatgctagtttcactttaaaaatgtccttcacaaataactaaaaattgtatttttttttcaaatccatccttgcttacacgtcttttaaagaatatgtgtgaaaaaatggaaactactgccgctacatgcccaagtgaaatggttgtctccggaaaaagcactagtgtaattctttgaattttcacctaaaaatacaaattttattacacttgtatccaccagcttgagcttgacagcttgccagtacttaaagacttttctagtaaaagaagcattatattaacaatttatttttgactatataatgaaatatgtcaacatttttgtgatctttacaacttagtggacacctatttttcaaatggccagtgggtgccattacaaaggcaaaaagcctctggtatgtgcaagatagattgatggatttcagtgcttaattgatgtggtttcagattcagtccacactgcaatgaaggctaagaaactaccacatgtaagtttggtaccgtatcaaagaataatatctagaactatctggaaaggctataaagtagttttcccttttccaacaccttatctttatgagatcagatttccctcatatatttcaa

SEQ ID NO: 155947 - DNA, 650 bp, Homo sapiens
gatccagagagaaaaatcaacaaagaaacatcagagttcaactgcactgtagataaaatgaacctaacagatatttacaaaacattctatccaacaactacaaaatacactttcttttcaagtgcacatggaacagtttttagaatagactatgctgagtcataacacaagtcttacaaaattttcaaaaataaaaatcacatcaagtactttttctaaacacaatgaaataataccagaaatcaataaaactagaaatcaataacagaaggaatggtggaagctttacaaatacatggaaattaaacagcacgctcttgtatccccattaagaaaagaaatttctgaaaatttctggagatagaaaatgaaagcctatgggatatagcagaagtatgtcaaagaggaaacactagagcaataaattcctacatcaaaaaagtaaaaagatatccaattaaaaaccatctggtgcacttcaaggaactagaaaatttctaaaaagccaaatgcaaaattagtagaagaaaagaaataacaaagatcacagcagaaacaaaaaaaaaacagagattttaaaacaatacaaaaaaatccatcaaagaaaaacaatttgtttgaaaatcaaaagaaattagctacactaagaa

SEQ ID NO: 155948 - DNA, 293 bp, Homo sapiens
acactaagctaacaggagttacaaacacttggaatgctagaactagaattcaaaatgatcttaataaattatataaatcacatttcaaaactgtggaacaaattcaaggttatatcctgagagagacagaaaaactatactgtcagcagagggaggaagattttctgagcgcaggtatgacagttagcagagtggtgcacactctaaaaatggggtgtccaatcttttggcttccccagaccacaatggaagaagaagaattgtcttgggccacacataaaatacactaaccc

SEQ ID NO: 155949 - DNA, 420 bp, Homo sapiens
accaccggggtggctggactacatctagatcctgctgccttgtgcccttcatcaccccctggctgccgtccttggcctggcccaagttcagcactcagttctcattagaaggaattcagcaccctggacagggcattgggcagccctgttctgggacgctctagagtccttttgagagccagcctaacagactgctcactgttccctttttattccagcctctaagcctttactccttctgtgcccaccacttgttttgcctagcaatggaatggtggatccattgtccttccagacgggttttgacgtggcttctgttcccatatcccctctacctctgggcctcgcagcctctgtacctcccatatgccctccgttattttgtcttatagcattgccccaaagtccttcccctcctgc

SEQ ID NO: 155950 - DNA, 187 bp, Homo sapiens
gtgggggcttgagccaggaccctgcctctcagtacttcccaggtctgtcctatctcccgaccttcacctcctcctctgggaggcccaggacccctcttcctgctcagccctcgcctgggcctaacaattatcaaaactctgggtagctaggccatgattctttttttttttttttttttttgagaca

SEQ ID NO: 155951 - DNA, 504 bp, Homo sapiens
caggagaatcaaaatatctaacacggaaccccacaggcagtgaattagacatggctgcagatggcatctaagcagagagagggtcaaatatagagccccaatatcacgaatcatcagataaatgcaagacaaaaccatggtgagatatcttctcacatgagtcagaatagctataacttgaaagtccaaaaattacagatgttggcaaggttgcagagaaaagggaacacttatacactgttggtggaagtataaattagttcagaccctatggaaagcagttgggagatttctcaaagaactgaaaacagaattgccatttgacccagctatgccattgctgggtatatatatacctaaagaaaaataaatggtcctaccaaaatgacacctgcattcatatgtttatcatagcactatttacaatagcaaagacatggaatcaatccatgtgctcatcaatggcggattaaattaaaaaatgggtgctgtgtgtccaggctg

SEQ ID NO: 155952 - DNA, 515 bp, Homo sapiens
aatttgttctttgagctaccttccctcctcaccacaactatctttagtcagtaaggatacttaatgagagacaccaggtgaagttttcatcatgtagacagtggcgactcagtattttaagtgagggaatgataatccaatttgtgtaaagcagggcttcttaggacagttgactggagggagaagaaaatgaacttcagttgatgaggaagaatgtagtaagacaacaaaacagagctgggaatagagcatttggaactattggggactcatatgagaagaaattcaaatgtccaacgattatttgactgaatgtgaaggaaggagtaggaaggttgtgggatgacttgaacattttaaatttaggccgctgtaatgcttttaaatgaaggtgggaatagagatgaacccggttttttaaatgggaaaataacccagttttgatcttttttagtctgggtgcttactggatgtcaaggtagaaagtgtccaacaaggtgctttaactataggtt

SEQ ID NO: 155953 - DNA, 634 bp, Homo sapiens
tctagaggatcccagatcatgcagagtaacccagatgatcagagcagactgggggtaggtggaaatctgggtagcagtgttggacatgttaacttcgagatgccgtcagacctttacgtggggattccggtctggggttccaggcaaaggaacgggctgaaggataaagagtcaccaacataggcacagtcattaaagccacgggcctggaggaaatctcttagggcctgagtgtagacagagaagagaatcaagccctggggcactccatctcttagcggccagggagaaaagaaaggattggcaatgtaggctgaggaccacactcccatgacaaacaaggtcaagttagatgaggactgagaagtggttactgggttagcaatgtgcagggtgctgggggccttgacaaagggcagtctccttggtgtaaagcagggaacagtctccttggtgtaaagcagctgagagtaaagagagaggcaaaggtgtgaaatcgtcctctggagaatggagacgactgggctagggacaaaagtttgtgtgcatgtggttacaaattgaaagatttttagtagagtcgagtttcactatcttggccagggtggtcttgaactcctgacctcgtgatcca

SEQ ID NO: 155954 - DNA, 232 bp, Homo sapiens
atattttaaagatggagttttactaatggactgaatgtgaagtatgagaggaaaatagaagttaaagatgactccaggatttatggctaaagcaactggaaaggatggtgcggtcatgagctgagatggagaagatgataagcagagcagactgggggtaggtggaaatctgggtagcagtgttggacatgttaacttcgagatgccgtcagacctttacgtggggattccg

SEQ ID NO: 155955 - DNA, 245 bp, Homo sapiens
atcgtgccattgcactccaacctaggcgacagagtgagactgcgtctcaaaaaaacaaaaacagaaaaggttaatgacttgcccgaagtcatctagcttgtaagtacacagccagaatttaagcctgggtggttaacttgaaaaccgttatggagcaacccagagatttagcatcagtggttcaaatctcagttctacaattacttgccatgtgacctcatacaagtcacttaccccttctgaga

SEQ ID NO: 155956 - DNA, 787 bp, Homo sapiens
tcattaattagtaacacttatccaggggggtttttaacctttcccccactcaaggattattctaatgtcagagtagaataaaaaataagtgcagcgatgctgactcttccaagcttaacatttctcacaagtcaattagctttgtactgggaggagggcgtgaagggctgcttgcggtagttgtgtagcagcagcacaatggccgcagacaaggaaaacagtttctaggaattcctcgtatataattttatatttttgacaagattaatgacccatgctcccttcctctccatttctttttttggaattctgttggtatgtagttactatattttattaaaggaaattagccttatctcttattatattttattaaagaaaattattatattattcctttatatttttattaaaggattttattattattaaaggaaattagccttatctcttattatattttttatgaccttcaaagtagtgtctctgcttaaaagtgtaccctggccgggcgtggtggctcacacctgtaattccagcactttgggaggccgaggcgggtggatcacgaggtcaggagatcgagaccatcctggctaacacggtgaaaccccgtctgtactaaaaatacaaaaaattagcagggcatagtggcgggcgcctgtagtcccagctactcaggaggctcaggcaggagaatggcatgaacccgggagacggagcttgcggtgagctgagatcgcaccgctgcactccagcctgggcgacagagcaagactccgtctca

SEQ ID NO: 155957 - DNA, 311 bp, Homo sapiens
ctaggatcctcccactgcactgtgctttcttcattccattcatcagacaacagctttggtgagcctttcaaagcataaaacaaattgtatcactcttctgttaaaaaaaaccctccaatggcttctcaacccacccagaaacaaattcaaggtccttaaatgtgaagtcccgggtggtctaacctcatccacatctcccagctcatttccctctgccctctctgttacagccatggggcttccttggtgatagtggtcacacacaccagggttatccctgcctcaaaactttagcacaacattcttctgcc

SEQ ID NO: 155958 - DNA, 971 bp, Homo sapiens
  misc_feature (255)..(255): n is a, c, g, or t
  misc_feature (276)..(276): n is a, c, g, or t
  misc_feature (294)..(294): n is a, c, g, or t
  misc_feature (308)..(308): n is a, c, g, or t
  misc_feature (316)..(316): n is a, c, g, or t
  misc_feature (494)..(494): n is a, c, g, or t
  misc_feature (630)..(630): n is a, c, g, or t
gatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacacttgtgctgccctcggagntccatgaaggtggtggctgantccatgggcatcgccagnattcaggaggaganctgccagntgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgnctctggtgggggccgggagctttacttctatgaggagaaggaggttgatctgagcgacatcatcaatagccctactgccccgggtgaccctggacgtctgcctcaaagctcattggctgagcatcgagggctgcanccagctatccccgagaacccgcccccagctcgcaaagagcaacagaaggctgcagccacagaagccctgaaagcaggcaaagcaggcaggaggaaacggaccctgaagggcaaggtcaggggcaacacagccgacgcacggacgagagacgggcgaccagcagaggggccctggacatgaccccgaggtcacaatcgctgcgaggcgagcgacagcaggaatgcgaggcgggggacaggagccgggggagcggcagagtcgagccaggaggacgaggggggagacagcgaaggcggacgaggcacaggcaaacggggaaacagaaccaagagacaagcggg

SEQ ID NO: 155959 - DNA, 1230 bp, Homo sapiens
  misc_feature (579)..(579): n is a, c, g, or t
  misc_feature (600)..(600): n is a, c, g, or t
  misc_feature (618)..(618): n is a, c, g, or t
  misc_feature (632)..(632): n is a, c, g, or t
  misc_feature (640)..(640): n is a, c, g, or t
  misc_feature (818)..(818): n is a, c, g, or t
  misc_feature (889)..(889): n is a, c, g, or t
gatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacacttgtgctgccctcggagntccatgaaggtggtggctgantccatgggcatcgccagnattcaggaggaganctgccagntgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgnctctggtgggggccgggagctttacttctatgaggagaaggagctcattggctgagcatcgagggctgcanccagctatccccgagaacccgcccccagctcgcaaagagcaacagaaggctgcagccacagaagccctgaaagcaggcaaagcaggcaggaggaaacggaccctgaagggcaaggtcaggggcaacacagccgacgcacggacgagagacgggcgaccagcagaggggccctggacatgaccccgaggtcacaatcgctgcgaggcgagcgacagcaggaatgcgaggcgggggacaggagccgggggagcggcagagtcgagccaggaggacgaggggggagacagcgaaggcggacgaggcacaggcaaacggggaaacagaaccaagagacaagcggg

SEQ ID NO: 155960 - DNA, 308 bp, Homo sapiens
atgtattatatgaacagagccgagtcacagcatcctcttctctcaagcatgtggaagtccttcctacagtttatgtttcagactctttctctcccgttgagtcctgccacaattcctgctgggcaacataccatcccatctctctaactactcccaagagctctgacaaacgctttcagaacttgcacttgaactttttctttccaacataaacatctggtaatctgtaactgactttatgtatcactcaagtcttgcctttactgagtgcctgatatatatcaaacctcgaggttacatattgactg

SEQ ID NO: 155961 - DNA, 229 bp, Homo sapiens
tgtgacaaagcaagtttagcaaaatgttaactgtggctctaggtaccaactatatgactgctcacagtagaattctttcgacttttctgtaggtttaagaatgttcatagtaaaatgctggggggaaaatattacatattatacagacaggactaaaaatacctcttactgcaaacgagctgagtagctttcactgaatgttccaaaccagtgatttgcaaccctgaac

SEQ ID NO: 155962 - DNA, 218 bp, Homo sapiens
gcatgtgacttaaaaaaaatcgcaaaaataaaatataccacttcatctcagtaataacaccatttctgaaattaatataatgatgcttaaaggtctaactgaagcgttctgcttccattcttgaaaaaaacagagaacacatgttctctaaaattttcatggtgctttaaaagttcctttactttgaaattccacttacttccaacattgcttcggtt

SEQ ID NO: 155963 - DNA, 1140 bp, Homo sapiens
tagtttttcttatagatatctttcatttacttgtgaaggtgtatttctaagtattttatttttgtaggtgtcataaacaagtttgaattttttatttgattctcagcttggtcactattggtgtatagcagtgttactgatttgtgtacattgattttgtatcctgaaactttactgaactcatttatcagatctaggagctttttggatgagtctttagggtttcctaggtatacaatcatgtcatcagtgaacagcaacaatttgacttcttcctctttaccaatttggatgtcctttatttctttctcttgtctgattgttctggctaggacaaagagctgtttctaattttaaaaatacatgtgtccctaactcattttctctctcagttccagtgtctcgccccatcctcaccctcagggttcccagggcccaggctgtggtgggggacctgctggagcttcactgtgaggccccgagaggctctcccccaatcctgtactggttttatcatgaggatgtcacccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacataa

SEQ ID NO: 155964 - DNA, 4487 bp, Homo sapiens
  misc_feature (3126)..(3126): n is a, c, g, or t
  misc_feature (3413)..(3413): n is a, c, g, or t
  misc_feature (3644)..(3644): n is a, c, g, or t
  misc_feature (4311)..(4311): n is a, c, g, or t
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccctaatcaacttaatccccttcttggcttcctcctcaactaactagctggggttttccgtactcataagtcctggctcagccagacccctaaaacagctcagtagattccccagcttttaccaaatgaatttatttattgtattttctcctcattccttgtatgttccaacagtacgccaatttttcttgatgcacggagcgtgtcctacttctctactgacatttacatattaacttagctacaagcacagtcttatagataaatattggtcaagaccttaaattctccaaaggatttccaatcttatggtagatttggagaaagctgctggtgaacaaagggggaaatggctccctaggaaccaactcctcaaacttctggagtttttatgatcccttgttttctaacctgctaaaatcagtatcattttattgtattattttaaaaaaactattgttgaagtatgacatacattcaagaaacgtgtgcaaattgtatgtgtacgatttggtgtctttttaggagctaagttgcttctgtttttacttgaatctttgtttatagaaactgggggaaagtttactttcttttcagagaagccaaatggtatgatagaaaaatcttgagcctgatgtgtcagacatgcccctagcataacttgttgagtaaagaggttatttttaaaatgtgaatgttctgagactactccaaagtcagagccaaatctactaggaagcttctagacttcactcattctgcatcccattactatctttttatccatgttttactttcttctcatattcagcagcatcttaagcctctttattttctgtttcttgactgtcacccttaatgccagtagaatgtaagcttcatgagaacagaactgcatccatcttggtcttcacaacatccctgtgcctactcagtgtttggcacacagtaggtcctcagtcaacatttgtaatttagtggacagatgatatgacaagatgataagaggggatttaaaaaaatcatctagcaaagcccaagaggaaaaaaaacaaagctattttagaaatgaaataccaatttgaagcagtaagaatagattggatatctttgaaaaccattaattgaatgaagaaccaatttgagaaaacaatacagaatgcaaagtagaaagatacagaaataaaggcaaaanttataatatggaaatcagacaatggatttgtctgtatccagttatgtggataattaaaatggagaccctcagaaaattgaaccgaagagtaaaatgaaactcaaaaatgtagtagaaattgttgggaagtaaagaaaacttgaatatgtagatcagaacatatatgttgatgacgttattgactttgaggttaaaaatatatatatgtgcctatgattatggggaaaaaagcagtcgtctcagaaagaaaaacatcaagttagtcttagactttgcagtgcactcantaccaaagagagaggaggccagacttggacctgcgagggaagaataataaccgaaaattttatatcaattcaaaaagacattgtcaaaaatacagggattcaggaaactgagaatgcactaagccttctggaaaaaacacctaatgacaaaatctagcccaacaagatgtaaatgaatataaaggactcataatgaggaaaccgcattatgactggctctcaaccctggcngcatattagactcgtcaaagacctttgtaaaaggtcacacattgactcgtcaaagcccctctccagactaattcaattcagaatctcacagatggggccacagaatcagtattttttgacacaacctcaagtgagaatattgtgtagacaagattggaaaccactgatttagatatagaaacaaaggctaatcaactgtgagaattatggtcacagaatagaaagtaactattatgaacactgaaaatgtaaaaaaaatgtaacaaagaaaaatagttagaggaaggagaggaagtaaaggaacaatcattttctcatgattattattatttcagagtaaattgtgagttatttcacaattcaaaaagaatggactgttttaaaaaattagtaatagatttcaaaatgtccattttgtaaatcgtttctgaatactttgtcaacagttactcatcattaatggcttatacttcactaaaattccatggaaaaccaactagtagcctgtagagtcacataggagagaacaagtgaattctttgggtggcgcaagcatagatgttaggactgacaaaaaaaaataataaaaataaacctgtgcattgatatgatcacaaatgatcagggaaagaggaaacagaaactctcatacgccattattacaagngtaaattggttcaaccttttcgtcttaattgacacattgtaattgtatatatttatggaagcacagtttgatattttgatatacatacatggtatataacgatcaaattaggatatttaatgtacccatcatctcatgcatttatcatttctttggaataaaaacattcaaaagcc

SEQ ID NO: 155965 - DNA, 5491 bp, Homo sapiens
  misc_feature (3470)..(3470): n is a, c, g, or t
  misc_feature (4719)..(4719): n is a, c, g, or t
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagagatgggatttcctcatgctgcccaggctaatgttgaactcctgggctcaagtgatctgctcacctaggcctctcaaagcgctgggattacagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtgnttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcnctccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgtaaaaaagca

SEQ ID NO: 155966 - DNA, 3673 bp, Homo sapiens
  misc_feature (1652)..(1652): n is a, c, g, or t
  misc_feature (2901)..(2901): n is a, c, g, or t
tagtttttcttatagatatctttcatttacttgtgaaggtgtatttctaagtattttatttttgtaggtgtcataaacaagtttgaattttttatttgattctcagcttggtcactattggtgtatagcagtgttactgatttgtgtacattgattttgtatcctgaaactttactgaactcatttatcagatctaggagctttttggatgagtctttagggtttcctaggtatacaatcatgtcatcagtgaacagcaacaatttgacttcttcctctttaccaatttggatgtcctttatttctttctcttgtctgattgttctggctaggacaaagagctgtttctaattttaaaaatacatgtgtccctaactcattttctctctcagttccagtgtctcgccccatcctcaccctcagggttcccagggcccaggctgtggtgggggacctgctggagcttcactgtgaggccccgagaggctctcccccaatcctgtactggttttatcatgaggatgtcacccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtgnttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcnctccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgtaaaaaagca

SEQ ID NO: 155967 - DNA, 2360 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcacccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagaaattggtaggatgatcatgtagcgtactcggggatcgtcta

SEQ ID NO: 155968 - DNA, 442 bp, Homo sapiens
aacaatggcctagtggcccagcacagtgacacaatatcactcagtgttataggtaagttgacctaaccagcagcacaaaaataaaaagaccatctcccctaactttaccagtagccaagatcagaggtacagtttctagagtcatttgctgtgtgacatcctgtcaggcttggtgcctacacagcctccatctctaagttttgtatcctacacgttcaggaacttgcaccttcccttcccttgctgtacttttcctgctagcagcagtccagccatcacgaccaaaattcccctaacataggagtaaaggctttcaaaatacaaactatattctggccaacagtgatagtaagaaagaaagttataaagttctgtgtgcttcaccttggaagagatttagttgtggttttctctgtctgccaatcaataaaaaggccaacac

SEQ ID NO: 155969 - DNA, 5398 bp, Homo sapiens
  misc_feature (3377)..(3377): n is a, c, g, or t
  misc_feature (4626)..(4626): n is a, c, g, or t
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtgnttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcnctccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgtaaaaaagca

SEQ ID NO: 155970 - DNA, 2865 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacataa

SEQ ID NO: 155971 - DNA, 3951 bp, Homo sapiens
  misc_feature (1930)..(1930): n is a, c, g, or t
  misc_feature (3179)..(3179): n is a, c, g, or t
tagtttttcttatagatatctttcatttacttgtgaaggtgtatttctaagtattttatttttgtaggtgtcataaacaagtttgaattttttatttgattctcagcttggtcactattggtgtatagcagtgttactgatttgtgtacattgattttgtatcctgaaactttactgaactcatttatcagatctaggagctttttggatgagtctttagggtttcctaggtatacaatcatgtcatcagtgaacagcaacaatttgacttcttcctctttaccaatttggatgtcctttatttctttctcttgtctgattgttctggctaggacaaagagctgtttctaattttaaaaatacatgtgtccctaactcattttctctctcagttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtgnttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcnctccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgtaaaaaagca

SEQ ID NO: 155972 - DNA, 2883 bp, Homo sapiens
  misc_feature (862)..(862): n is a, c, g, or t
  misc_feature (2111)..(2111): n is a, c, g, or t
ttcataagtcacttattggagcctccgtttgtttcagctaaaacgaggatgaaatagaactaacaacgtattgctgtaagcatcagcaccatgcctgttacacactagatgaccagaaagcctggaaacatatataatatgattatgattcataatagaatgcccatggtcagtttgttatgtacttgttcatgtttccaggcctggcagccaccctgcagtaagaagtcactcactaggagtgatcattatagctactttgtctggattcctaagaaacattcacatttctctgtctcacaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtgnttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcnctccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgtaaaaaagca

SEQ ID NO: 155973 - DNA, 1580 bp, Homo sapiens
ctgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctatggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttatcacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttggtgacaaagttagaaaaaagtggaggtcagtagggagatatgaagggacgcaggtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatg

SEQ ID NO: 155974 - DNA, 219 bp, Homo sapiens
ggtaattgtgaataacccatgaaataccagatgtgaaggtgcttcatcatccaaaggggaccgggagaaggagcccaactagttaccttcctactggaaggcatggtcccactgacacagtttctgctcacgaacacatggtagttgctgaagaaatgtcctttgaagagtgttttgtggcctgaatgtgttctctgcaccctgctttctctcattctt

SEQ ID NO: 155975 - DNA, 270 bp, Homo sapiens
ctcagaggatcccggtgttcctttgtctctataaaaatacaaaattagcctggtgtggtggcacacacctgtagtcccagctactctggaggctgaaacaggagaattgcctgaacctgggaggtggaggctgcagtgagccaagatcacagcattacactccagcctgggcaagacagagtgagactttgtctcaaataaatagacaaataataaatacacaaaaattagccagatatgctcgcttgaactcaggaggcggaggttgca

SEQ ID NO: 155976 - DNA, 1227 bp, Homo sapiens
atagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagttta

SEQ ID NO: 155977 - DNA, 849 bp, Homo sapiens
caggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggt

SEQ ID NO: 155978 - DNA, 1124 bp, Homo sapiens
atagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagttta

SEQ ID NO: 155979 - DNA, 708 bp, Homo sapiens
caggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagttta

SEQ ID NO: 155980 - DNA, 366 bp, Homo sapiens
aggggtggactgagtgaatggtgcaccattccctgtgggtcattcgaaacaagctgcctgtctttcaagaatctgaaagatgctgcctgacaaagcaggaccgtggcactggatgtccgtgagggtgcctgaagaaaagtggaaataagctggtttcacttaggcaaagggcaagcccactgagctttcttacagcaaattagaagcttaagcccaggaaccagaatgaacatcactgtgatcatgactggcagcacatgattctgccatcatacccttttcgttcccaaactcaaagagatgcatctggccaggtgcggtggcttatgcctataatcccagcactttgggaggccgaggcgggtg

SEQ ID NO: 155981 - DNA, 214 bp, Homo sapiens
tggcccagggttccttttgagagggaactgaggccctgtccgattcctgagccatgggcccctggagcccaccaggcctcagttcttcgtcattgaacactcagccagcttagggctgggaaagcagtttcgacaacgacttgctccctggtcagattgacacagctgagaggggagaatcggggctctcgacataggtgagcctggcttggaa

SEQ ID NO: 155982 - DNA, 529 bp, Homo sapiens
ctgtgtctgtgtgtgtggtatgtgtgagtgtgtgctttgtatgtatgtatggtgtagtgtctgtagatgtgtgtagcgtgatgtgtatgtaagtgcatgggtatgtgtatgacatctgtggggtgtgtgtgcgtatgtgcatgtgagtgtgcgtttatgggcatttggcatgtgtggctggaaaaggagacagtgagaagccgcaggagtgagcaggatctccaccgcactcccggggctccgggtgctggttaaagggtagtagagaggtgccttcctcttgccctcacaactgcctcaccatcctcactctgtagggaggatacagagcacaatgaggtctgccatacgcccaggtaagcatgcatacctgggcgtatgcccttttcctaacactcacaacaaaactaactaatactaacatctcagacgctcaggaaatagaaaccgtctgaactatcctgcccgccatcatcctagtcctcatcgcccttccatccctacgcatcctttacataacagacgaggt

SEQ ID NO: 155983 - DNA, 267 bp, Homo sapiens
gaggcagttttaagttgaaaattatgaagaactcccaaaaatcagttgccccgtgatgccttaagccagatgtgcctatcgttggaaactttcaaacgtacatcagataaaatattctctcatattaagtggaaaactggaaaagaaaatcccttaggtactttccagtactaaatgttctattaagttattgaattttgagatagaatcaaagtaaaattaaacagcttgccttgccctattactatccatcctcatcctagcaat

SEQ ID NO: 155984 - DNA, 138 bp, Homo sapiens
aggcatctgcagctacctgtcccaggcaccccagagtctctcggggtatgctgatgatggtgacaggctcaagttgaagctgcaggaggaactttttgctgcttttaagcagcccaggcctgggacaggttcagacag

SEQ ID NO: 155985 - DNA, 204 bp, Homo sapiens
agaatcgcttgaacccaggacgcggaggctacagcgagccgtgattgtgccactgcataccagcctgggcaatagagcaagactctgtctcaaaataaaaaaaaaaaaaaaagaccatatatccaagggcccactcagcagagacatcaggtatatcacaaagtaggaaaataaagtgttagtaggaaaagaagttgtcagatg

SEQ ID NO: 155986 - DNA, 516 bp, Homo sapiens
attattcattgggccccctcaaatgccacaaggacccagctgagaactgggaaacacagcagggcctgcatgagcacagaccaccctctccgagcctgtttcctctaaagtaatcctgccctggctgactatgcccagggttgttgtagaattaaatgagaagacagatgtaaaagacctacgaaaactggaaagaactcaaatctacaacaatgtcagtactgctaatatcaatattgttactaaaattaaccacaatgaccagcaccccgtttacatgaaccagctccacagacacaggaaaaatataaaattgaactcttcgcacaattcctgggtttcctgcattggcaatagtgtggagacttcacggcagccagttgctcaagtgtaattttatttcctagccttggacaagcacggctacaaaacaccacccagacaaagcccttgaccacaatccccgaagggttgactaacagacttgttcttttcggcttaaaggacctctttatt

SEQ ID NO: 155987 - DNA, 422 bp, Homo sapiens
ctgttaggggtaggatcgggggagggaaagcatcaggaagaatagctaatggatgctgggtttaatacctaggtgatggaatgatcagtgcagcaaatcatcatggcacacgtttacctatgtaacaaacctgcacatcctgcacatgtaaccctgaagttaaaataaaagttgaaggaaaaatgtaaagatttatgagtcccacttgagacctactgacttagaatactgttgggcaggaccataaaacagtatttatttttagtgccctgggtgattctgccatttagacgggtaagaactcctcaccaaagccgggcacggtggctcacgcctgtaatcccagcactttgggaggccgaggcgggcagatcacgaggtcaggagatcaagaccagcctgaccaacgtggtgaaaccctg

SEQ ID NO: 155988 - DNA, 406 bp, Homo sapiens
aatttatacctcaggaccctcaaaaatctcaagagtggctgacccaagtgtcttcagaaagggatgcaaagatggggataaaaacagatagattcgttgcaaatgaaataagcagttaggtccccagatctcttccctgactcagtgcagcaaatgactccctctccaactgcggagtaagaatgaggttttcccctctggggaagataaaacaatctttggacggtaggcagagttgaggattagaggagcatcatactgataacagggagactgcataaaaatacatatagcggaagttgagacctctccagcctttttacagttggatttcaggaatactattattacaagatataaagactcaaacagttctctctaggcatcagcccaggaagaaatatct

SEQ ID NO: 155989 - DNA, 368 bp, Homo sapiens
ttaataccagagatatgaggggaaatttctagtagcttgaattactaaaatgatcctctgaaagattaataaattgtattttggtgtactttgtgtagaaggctatttgttaaataccagttcaaggtaaaaggatgtttaattaaagcttcatattcatgagaatttaacaaaacaatcagccaaattgttttactgtagttgtgcagcagttaactgaaacttacataacgtttaaggctttttaccccaacttcagaccctctgaaacaaactccacttggtttaacctcaaaaatactgctttagacaatttttttaacttctgaagagcaagaagcaaattttatgatatcggttttgcaaat

SEQ ID NO: 155990 - DNA, 300 bp, Homo sapiens
atctatgacatatagaactggggtctgtcaaccacttattttgcttgatgatgaaaggttaacaggggcaaagggaagcaggaaccaagagaagtgggtgttcacggaccatcccccatgaatggcgccaggtggaacacaagttcattctaccccgtagatcttgtccttgccttgcctgcattctttctagtgtctcatgggccagagcccttgagcatcttgccttcttaatcttcctttctaaacattcttgaatcagtcttctcgcccgccccaacacttcccacagtccagact

SEQ ID NO: 155991 - DNA, 571 bp, Homo sapiens
tgttccctcgccgcaccgccggttcaaagaggaggagcaccccaatgagaacttcatggcatctgtgaattctttgtgcagtatcttccattgattaatcagacttcctagtgtatttcagactgattctcttctaaattcacaataaattgatgacttaactaattatatttgcaaagactctatttccaaagaaagacacattctgaggttccatgctgacatgaattttgggggtgatgctattcaacttactacactctgtaaccagtgatgtacatcacttacatatttgatctcaacctaggagtctattgtcccttacatattttatgtagacgaatgactgacataaatatttttggaaaactaaacatcaaggttgatagattttatcagattttatctgtggttaaaattcatgagccatgaatctggtcaaatgtctatgagtttgattgaatactcctgaaaggcaaaccacggtataaatccaggaaatacatagtataaatccaggataggcttcatccgtgttttgaaccgcgtgcgcgtggggatcctctaggct

SEQ ID NO: 155992 - DNA, 461 bp, Homo sapiens
catgatgacaatatcaaattgtaaattttgtgcaacactgttttgctgatcattgttttatctgtcaattaatgagaagtttatttatttattttccttacagataagagtctcacctattgcccagactggagtgtagtgttgcaatcatagctcactgttatcttgaactcctaggatcaagccatcttcttgcctcagtctcccaagcagctaggactacaggtatgcaccactatgcctggctattttttgtttgtttgtttgtttgttttgtagaaatggtttcaccttgtgcccaggctagccttgaacttctggcttcaaacaatactcctggctcagctgcccaaagtgctgggaatactggcatgagccaccacgccctgcctagaaatatttttaaatctcccactatagtgatagatttctccaattacctctgcggttctaatgagtaa

SEQ ID NO: 155993 - DNA, 322 bp, Homo sapiens
aacattttttgagtgcctactgtttttttgagacactgtgctgagtatcgtttcaagacagaggtgaagccacacttggctcagctgcttttgccctcagagagcttatttcttgtctcttagtgactctcgcatgactcagaactgaggcgatgggatactggggtatgacagaggtatgggactggaagtagtacgtagtgctgcagcctgtgccttaatattttctgtgcttccataagttctttctgttaatgggaaaaatcagctgacttcattcagaatttgcagagtatttgctgtatcactagagcaaccatag

SEQ ID NO: 155994 - DNA, 372 bp, Homo sapiens
agtctcacttagttgcccaggctggagtgcagtggtgcgatctcggctcactgaaacctctgcctcccaagttcagatattactcctgcctcagtctccctagtagctgagactacaggcatatgccagtatgcctggctaatttttgtattgaaatgggatttagccttgttggccaggctagttttgaactcctgacctcaagtgatctgcctgcctcagcctccaaaagtgctgggattacaggcatgtgctgccatgcccggcctcttttctataggaatcttgtgagtcctgagttgtgaaatcgtttctacatagtggacatatgtttgtcttttctggagatctaaggactttcaatgatcctag

SEQ ID NO: 155995 - DNA, 324 bp, Homo sapiens
gtggccttttggatgccaagcactgtgctagaggctgccgaaagaaacagacacagcctttgcctacatgagtctactgccaggtgcactggctgtcccagaggaggtgaggggcactcaggaagaggagggggagcttacttggttcgggagatcagggaaggcctccctgaagaagagactggaagaatgataggaattcgccaaataattggaagtggaggggcaatgagaatgttcccagcaaagggacagcatgggctatgaggcaggaagagctgggtgattcgagtgaagggaagggagtgttggaaggaatgagag

SEQ ID NO: 155996 - DNA, 322 bp, Homo sapiens
catcagcttcctagagggaacaccagaatttgggttttcccaaatgtgtttggcatggactaaatgactcaacaacaccacactctacacctctctgttgttccttgcctttaaacatacgagatgccaggtgtggtggctcatgtctgtaatcccagcactttgggaagctgaggcaggtggatcacttgaggtcaggagtttgagaccagcctggccaagatggcaaaatcctatctctactaaaaatacaaaaattagctgagcatggtggtgaatgcctgtaatcccagctactccagaggctgagccaggagaatca

SEQ ID NO: 155997 - DNA, 659 bp, Homo sapiens
cagtccagattgcaggtaataataaaatctcaaaatcaaacaagaaaaatttcagtgagctggaaactagtaacgggtatgctatagtaagaccaatttatttataaaatacgttttagtcttattaaccttggcctgattatttgtttaaagtgcaacaaggataatgattagtcatataggccataagttgactttgctgtaactttttcatatgaaatttcatattagacttttgaaaatcacttaaggtttagagccaagccaaagactgtgtctataataccagtctgaattgagtaaatttctttcttctcaaggtccttaaaatatgttgaggttcttgggggcctgtcagaaagtgacataatttacttatcacaacaaggtcgggaattttttaagggaactgtgtaggcaaggtacctgggccagtctttttccaagtctgttggtgttataaagtcagtcccagtgcttcaaagcagactggtcacattttaaaatatgtctttctagtcaaagcctgggtaaaataaccagtgtcttcaattgtgtcctgttacaaaataaaacagattgttattgaacttacacaaataactatattgctataaaataagaatatttataaataacttccaaattctggagagagc

SEQ ID NO: 155998 - DNA, 380 bp, Homo sapiens
tatttaaagacaggttttcactccattacccaggccggagtgcagtggtgcagtcattgcccactgcatccttgaactcctgggccccagtgatccctacctctggcctcccagagtgttggggttacaggcatgagccactgcacctagcctacttgttatatttaaatatttgtttcgtctacaatttattttggtatttggtttccaactttactaagtttttaaccattgtcaatatcacgtagttgaataaatcatcttttccctgatgatttgaaatgacttgtttattacgtatcagtagcttcccaaaacttaggcagtggatcttaaccaggaatgtgcatcagaatcatatacgggggaaaaaatcatat

SEQ ID NO: 155999 - DNA, 680 bp, Homo sapiens
gagaccactcaagaatttttgacagaggaatggcatgatgattttagaccaatcttccaggaagctttcaggacagtgaaccatacggcaaagttgcactgcttttggctacagcctcctagtgtcaaccaagacaaacttttatcaatagcatatgaatatttagtcacttgttcctaacttgaagaagggaaaagaactattgctcagtatcatgaggggaactgggagagtggccttgctgagtccagaagaaaagcctcccttcatttcaatcccaggctctcaacagcagaatcaaaagataagcaaggggagaccatcttctcactcaatactagagcatacttctctcccctcaattcaggctctcctccccgggagggtcaggctttgttctaagcaaacaatctgtctctgagccaggctggtgtaatggttaagaacataggatttggaccaggccaggactatgtgaccttgggcatgttattcaacttctctgtgcttcaggatcctcccctatacaattcagcagagtaggtgatagaaataaaatgcttaactacagtggctattacaaggcctatgacatagtatgagtgcaatatatgacagttattatttttaaactaccaattactgtatattctagttttattccttgaatcctgtggata

SEQ ID NO: 156000 - DNA, 790 bp, Homo sapiens
agtgcttttaacaagcaaatgcttacttcatttatatttgtccttatcagtatcagttttgctagcttacctttttgcatgttagattttcttaaagggagaattacagctgtgacacgagagtggttagcattgaatggacagtctaagaattttgttcagaaggtttggattctggtcagagagcctggagatataatttctattcttatgtatgataagggaggtagtcctatctgttcgtttgccatttccaagttcttcatctagttaatatgaacagctttaaaaattagggctttaaagtaaaacagccttatataattattggcctctctctctcttcctttgtctctccctctcttccttttttacctccctccctccctctcgcttccctatccccaaaccctgtgtcccctccccagtctcctgacactgtctctttctttctctcatcagtatagatggtggtaggaaaaatgtttatatctaaattgatcagtaattgtaaatatgcagtatactgcataagttaaccctgagatgtgtttaactgagttttatctcagtttctccctggcaggtggtgctcatttaatagagaactcaaaaaagtagcctgtgttcagtccctaatagaccattgttgatgtcatagaataatttttttttctatatactatcatatggtcaggtaagcatttttagagaatgagttagaatttcatgaagactgggtttaggttaaaatacattcatctgggccaggtgcagtggctctcgcctg

SEQ ID NO: 156001 - DNA, 232 bp, Homo sapiens
gacgtgagccaccacgcccggcctctgccaatttttatatgtgatttgatcatctcagaggggccaaacacagctgcagattagctgtttgcagccactttattgtaagtcttaacatggtgtccttctgtgaaccacagtgattcttctcattcactcaccaggaagaatgtctaaacgttcactgcatacccagtagtggcattcagtatttatccatacatccacacct

SEQ ID NO: 156002 - DNA, 346 bp, Homo sapiens
gggccaggagatgtaagccattgggaggggtaggataatggcgaaggtaagactggaggggaaacggagactcttattagctttccacagcttgattctcagaccaatcggaatccatgcaagagcttaaacaggggagacagcagaaaggtgtactgtcagatctgcaaattagaaagatcgctctggacgctggtggagtgaattggagagggagaagatggaggcatggaagttattgaagagcctgccaaagtagtccagatgagaaatactgtatcttgggttaccagaggtaggagagatgaaaagaagcagaaacatttattgaatacaatcaagaaga

SEQ ID NO: 156003 - DNA, 251 bp, Homo sapiens
agatcctcagcaagaacccaacgtcttggtcacttttatttctcctagaacaattcccaacacatagacggtgtcaataaacagttcttcatttaaaaaaaacacaaaactggctggcatggtgtctcacgcctgtaatcccagcactttgggaggccaaggcaggcagatcacgaggtcaggcgttcgagaccagcctggccaatgttggtgaaactccatctctactaaagatacaaaaaattagctgg

SEQ ID NO: 156004 - DNA, 354 bp, Homo sapiens
tgtgtgagcagattgtaccttgaaggaatttagaatcttcatgcagaagataagcaatatgcatatcaaaagaatggggcaggaggacaaagattactaaggcctaaaatggtttaggaaggctttgaaaagggaaatggaagtgttatggagtcttcctgggcaacagcaatcaaaggggaagcttgggtaagagaaaaaacagaaagccctgtacataagagcacaagtgaatagtgaacagtgagctctgctcagggagagatgagtagttaatctggtgaggtagctggttcaagtatggactggaaggtagtaaattttaaaaactgaacagaaatataaagaatctta

SEQ ID NO: 156005 - DNA, 457 bp, Homo sapiens
ccaccaactggtcctgtggccccatatagaagcagactccctggctcaacaaactatcctgaaaaaaaccctagcctccaaattttcagagagattgatgtgagtgtttgatttgagggactgattaaactctttattgcaatgctatggtctcagtgaattgattttgtctgtgcagtgggcaggaagaacccattaggcagttacactactaactagctacaggattgttaaaaatattaagatttgtaaatgtatctaacccatagaaaaccataatatttattttgccatttctcctaaaagtgaagctattgcttaaatctaaccgaaagaattatccttgggtagttgtgaggagctaagttttccctaggggcaattgctaactcaggaagaggtagctaaaagtataagaagctgatcagaacttccaacaggccaaagggacaaaact

SEQ ID NO: 156006 - DNA, 375 bp, Homo sapiens
cgtctctactaaaaatacaaaaattagccaggtgtggtggcgggcgcctgtaatcccagctactcggaggctgaggcagagaattgcttgaacctaggagatggaggttgcggtgagccgagatcacaccactccagcctggccaacagagcaaaactctgtctcaaaacaaacaaacaaacaaacaattaagcaaaataaaatactactgaagcccaaataatagcaaatgtttactgaagttccattccctaaacaagtctagatgtaaataggatttcttcctatttttatgagtgtgtcccattattaccttctctgaaactttctgcagtcaggctcttatcttatttagaaatttgttttttaggaggg

SEQ ID NO: 156007 - DNA, 441 bp, Homo sapiens
gcaagattttcctcattgtctatattagactcgcactcaaaaagctggtaaatatgtcagccctatagaaagaccattgcagagtgttaattggacttcttagaccaaacagtgtcccttcagattgatatttagacttgaaatttttgagaaaaacttggatttcccaaagcaatataacatatcctagcagatagggatggaaattaggaagtagtacagttataaaatgcaggctttattattatttgtttctttgagacagtctcgctctgtcgcgcccaggctggagtgcagtggcatgatctcggctcactgcaacctccgcttcccaggttcaggcaattctcccgcctcggtctcccaagtagctgggattacagttgcccaccaccacgcccagttaattttttgtatttttagtggagacaaagggaaaca

SEQ ID NO: 156008 - DNA, 351 bp, Homo sapiens
ttctcaagtctgttacaaagagaactttggtttctcaaggtttaagaattaatgtcaaagagcaatttagtgttcgagtcaccagccttgctgtggatgattgctgagtcctcggaggttagggccacagcacaattggtgggccgtctgttccccaccctggtggagactttctcacccaaagaaatgtattctgttagtatgtctcaattagaatattttagtaggagacagttatggctcttgttttaatttgtagtggatgattactgtagcaggatcaaggttgagacttgcagcgtagctcatgtaaagcattgattttaaacacccaaaatatattgccagctt

SEQ ID NO: 156009 - DNA, 229 bp, Homo sapiens
agtgactataaataatgaggcttgtgctcagtaagagcagatgcaggagagaggtgctctgggaaatgcgtcccgcaggaccacaagagctgggttattcgtggggtctaattgcctcaaaaaggagacagcaatttgcagggcctggctgatttcatttaatttgctttaagcaaattctgctgtcatgtcaaactacccaggattccaccacaaacatttccccacc

SEQ ID NO: 156010 - DNA, 474 bp, Homo sapiens
cagtggaatgaagcccgggaggagaggaaggggatagatccagagtatgaggggaggaagacagaagacaggatatcttttccgtggaaagggaggaggatgtgaagatggctactctgacaggtgagcttagaggtatggagaacctgagaaaatgctcaccacatcgactcttttccttgggaagatttggggttgtagtgtgagggtgtagactgtagggacttatgaataggaaagatttgggacagtcaccatggtaagtcacactgaccttttagcacttaacacatgctaatgttattgcccagttccccagcagactttgtggcaccgctagctctcagccaagtacacagcaggtgctccgtaaatgcctgtgggctgcaagagacaggagcagcttggggtgacagcctccaccatgtggattttccagggccaaccagaccaattcatgctcccctgggacag

SEQ ID NO: 156011 - DNA, 149 bp, Homo sapiens
tttgcaatcgtggtctattgtgatcaggaagatggcagctctctgtattcataatccacacagcgatgtcacttccaaatgcacaaagacttcatactcactatctttccacagccggggctaaaaagttggaagatcctatctcagag

SEQ ID NO: 156012 - DNA, 622 bp, Homo sapiens
cggttattggatatgtgaaatatcatactatagcagatatggaggtttgccactcagatcacttcaagaaaggacttcccgcccagcagtggggagtgcagtcaccaggcagcctcctactctcagcttcttcatagtcttagctgcagaaagccacctcactcaagttcacattcttcccagagcagcctgcatcagatgactaagcagagtgtcaggggataggagatagtagggatatggaaactcggtcatttcaacccaatgtaagaccagtctaacaggcaatgcttattctaaagctacctacagaggcttcattgggcttgcactgcatgttagctttttcctctagttgatactgcttctaactcttttccttttacagatactgatctttaacaaacatcttgaacaccagactacatctgagggtctactgtctacttctggagaacacagcctgtaacaatgcaaaaataaattgctcggatcatctgataatgacaggctattaaataatttggaacactgagcttccacttttgtacaacttcagattttttttcactgactcaccatttattcatgtattaaataaatatttgagtacctcttatga

SEQ ID NO: 156013 - DNA, 297 bp, Homo sapiens
gtgatgtgtgtgtgtgtgtgtgtgtgtatgtaggggtgaaagactacatcacagtcaggagctctggaagtaatggaatgtctgatgatggccatgagatggggcagatttacctctgtttatcctgccttcctctagaccaccatcgtgaatgtggaagagacattcacataccctcagggggctccttgctgtggtgggatgcagccaatgctctcagtacctctttctactttttattagagagaaataagaagttaggtcattgaaggcggggcacagtggctcaagcctgta

SEQ ID NO: 156014 - DNA, 246 bp, Homo sapiens
aggtccagtttgggagggagcgatgaaactgagcatgatgaactgagggagacagtgaagagggagaaggtagtgaacaagtgaggcacgggttgctcttatggtgctcttgttacttcactctctacatggtgtcttttatgtttctttctctctctttttttttttttttttgagatggagtctcattctgtcgcccaggctggagttcagtggcgcaatctcagctcaccacaacctccacct

SEQ ID NO: 156015 - DNA, 907 bp, Homo sapiens
gaatgtggcaaaagttttaatcacaaatcaagccttgcatatcatcatagacttcatactggagagaaaccttacaagtgtaatgaatgtggcaaggtttttaggacacagtcacaacttgcatgtcatcatagacttcatactggagagaaaccttacaaatgtgaagaatgtgacaaagttttcaatatcaaatcacaccttgaaatacataggagagttcatactggagagaaaccatacaaatgtagggtttgcgacaaggcttttgggcgtgattcataccttgcacaacatcagagagttcacactggagagaaaccatacaaatgtaaggtttgtgacaaggctttcaagtgttactcacacctggcacaacatactagaattcatactggagagaaacctttcaagtgtagtgagtgtggcaaagcctttcgtgcacagtcaacacttattcaccatcaggcaatccatggtgtagggaaacttgactaatgtaatgattgtcaccaagtcttcagtaacgctacaaccattgcaaatcattgaagaatccataatgaatagagatcttacaagtgtagtaaatgtggcaaatttttcagacatcgttcatacgctgtagttcatgggtgaactcatactggagagaaaccttacaaatgtcatgattgaggcaaggtcttcagtcaagcttcatcctatgcaaaacaggagaattcatacaggagagaaacctcacaagtgtgatgattgtgagcaaagcctttacttcacgttcacacctcattagacatcaaagaatccatactggacagaaatcttacaaatgtcatcagtgtggcaaggtcttcagtctgagatcactccttgcagaatatcagaaaatttatttttgagataa

SEQ ID NO: 156016 - DNA, 356 bp, Homo sapiens
ggttgaaccctaggtctcccacttactgtggaatttacagacaagtttgttagctatgccaagcctctgtttcctcattaaaatggggacaataatctctacttcacagctgctgaggacctgggacctgatgcagagacatccactgcatagggtacatctcagttgtgtcaggcccctccccctggccactcccctgccttcgggctggtccacggtgtttctgcgagagtgggcccagcacacctggttcaggtgccttgcctccaacaaggaccacacctggaggcatcattgcgccttccttccctctaacctgggctttctcagcggagtcccatcagccttgtgagtgg

SEQ ID NO: 156017 - DNA, 712 bp, Homo sapiens
cacatgtatgaataatatgtatcttgtggttactgttttgcttcaggagatttgagttttatttttgaaacttctcattattggcctttcatctgtgattcttatatgctttacctgaagcataaatgattgtctaagatatagctcagaagaccttggtgtaaacagttgaattgtccctgtccaagaccaactgacactcatacttagctcactctagtataaattatatttcactgatgaaaagtaaataaatacatcagtatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttctt

SEQ ID NO: 156018 - DNA, 264 bp, Homo sapiens
ttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgactt

SEQ ID NO: 156019 - DNA, 606 bp, Homo sapiens
taaagtaggggtaatcacattgacctacttacagtgggttgcaaggaaggttctgttctgttgtgtttttctgtcttctttaaaggtattgtgttggtatcatataaattagacttaaaaaaaattagtcgttggtgtgtacagcacctgtcatttagagatgcaagaatctgtaagcaataccatctaatccagtaaatgttgtcctctctgttatgctttcatgaagatccacccatcttctcgaacaacctacagggtggaacagcaggacattcaggcctagttaaaaagatcttctggctacctgtccttgggttgctgattgcatctgaatgtgatggtggagctaaggaagtatatctgggcaataacttgcccttggtggtcacactgtgtcagttcatcactataagagaaaggcagaaaagctaagccgaaaagctccatccccacgagaagctggtttgcatggctggaccagtgaggatgtcaagacagctctattgtgggttggctgctggatccaactccaccacttctgagcctttgagttataacatcaagcacaaacaaccaggcttattttcccagccaaagtcacat

SEQ ID NO: 156020 - DNA, 513 bp, Homo sapiens
tggatggcttagcagactgctgtgtttgttatggctggctagtgtgtatgccaatattcatgcatgctcaggcactgcgtggaaaaaaagtctgttgtgtattctcagcgagggcagcccactaaaacacagcaccttgggagtgctggggaggcccagagagtggagctcagcagctcccattcaggctctcaacaaagcagctctactttcaaacagctgataaaacttaaagttcttagtaaatctttatttttaagagtgtctgctatttaaacacacacacacacacacacacacacatatacgcacgcacacaccacacaaaatcaactaaatgagctctaggaaaatcctaatttatatggtccttatttccctaagttcactgtagaaaaaacaagccctgtgttcaagaaatggccaatagtagcatgcctctgagcagaacctggaggcagaggtctctcactttgagataaaccagatgatacacacaggtttagctttctt

SEQ ID NO: 156021 - DNA, 444 bp, Homo sapiens
cccggggcagtagctgcctgccccaccacctacagctgtcctgcaccccaacttcccacggtcagtggcctctccaatactgtggccctcagttcccaattccttctccagagtggccattagcgacatcatcatacaccctaacccaggccagctagccaggactcaccagcagacaagaagatgttccccacgctgctctggcggaaacgcagctgctcaataatatggtgaaaatgggctgggaaaaaggtgacaatcacatcacagtcattcctcccagcctcccttctaggactgcccctcacctcaagcccccttctgagctctcatgctgaaaacacaccaggactaatctggccagactcaccaactccaaaaaagagcgggcaggtgaacacagcagggcccaggcccatgcacggtgctaacatgggcagcata

SEQ ID NO: 156022 - DNA, 3490 bp, Homo sapiens
  misc_feature (2109)..(2109): n is a, c, g, or t
  misc_feature (2115)..(2115): n is a, c, g, or t
  misc_feature (2122)..(2122): n is a, c, g, or t
  misc_feature (2124)..(2124): n is a, c, g, or t
  misc_feature (2131)..(2131): n is a, c, g, or t
  misc_feature (2134)..(2134): n is a, c, g, or t
  misc_feature (2167)..(2167): n is a, c, g, or t
  misc_feature (2190)..(2190): n is a, c, g, or t
gaattataagcaggattaacgtagattaaagttgacagaatctggttcttgctctgtccctttcccatggtggccagccccagctgcccagctgctgttgtctgtaagccaaagctcctgcgtgttctccttccaatagaaaacgactgtgcggaacctcatcctccccgggcccagggtgttggtgcagctgctgagggatctggtgaggtagcctatgctcatgtgccactggagatgcccggagagttccaatgcccaggccataccagcagctccctgggtgatgtccccttggacttagtttcactctgaagctgggaagcaatagcctacattttcagttaaataaaagctggaaatgatgatctcgttaggcctgcctcctgtacttcatgctttggtgctctccttcattttcctgccaggaagactttcccagtgcctctttctatatgcttgcatcccgttctcaagtctctgaccagcggttccactttgaagtccatcccacagaagtattagctcaaggctgcaaagatacaggaatgagaacgcttgctgcaacgctgctcataacagggagaccaggaaaataacccaaagggccattcacacaccaggtttttgagatgaatgacatcatgagcaactcatgagcatgagcaccaggcgtgcctcaccatcttggctccttgttgataacgtgtcagtccctaatatccagcctgactccaaggactgagatgatgagtgtgaaagtactttgtaaattgcaaatggttttgcaaacctaagggatatgatgaatcaacaatgagcaaagtcctttgagacctttcacaaataaaggcattttatatatttaaatccttggcactcacaaatttagcatttgaggttttgccaacctgtggagcaaccccatggcaatttgccatttagctgaggcatatattttcctccatccacaacctgagtatctcagacgaggatgaggagtgagtgaatgaaggagaaatgttaaaatatgattacattatagagtctttaaatgctcattaaaacatatattcgttcagtatcttttatgctttcattaatgtgccctaggctattgagaaagaaagagtaagacaaaaaggtgaaaactagaaatattctatgtaatggaaaagaccataaatatactcataaaacaattagtgagcacagaaatatacaatcaggtaatctataataatgtacatgtaataatctacaacagattttttcccttattttggattctgagaagtgagcactaacatattgcaaagggatttaattgcaaatgatttgtgtaaacctggtgccatagaaaaacttctggggttgaatttaattttatcgcatttaaatagaaaaatgcccacctgagaatatgcagctgtaattacgagggagttttattggttgttactgtggcatgtgtttatttctctcccacttaacattctggatggagggagttcaaggctgctgtgtagctctgcagttgtctggttttcctgctctgccatccttagggtatggccttggtctgtcctcatccttatgggcccccagtgaagctctgatcaagacctcctaattttgaatgtcctagaacttgaatacaccccttccacttatgtcacacggccacatctaaactacatggtaggctgggaatgaattttttattctgggtaactgtgtgtccaataaaaagcccgagattttataactcaaggaaaggaagcacagctcacaattgctgccacaggtcagcctctgtctgtccatgagccagttgttcagatgggaggaaatctgaatagaggaagagacaagtcaggcaagaaagttgtgactcagggtttatctcatctgctggggagttcaaggggcagtttaatactggctgtatttttcgtttctctaagtagaagtttcatttaagttactgtggaataggctgggcgtggtggctcatggctgtaatcctagcactttgggaggctgaggtgggcggatcacttgagctcaggagttcgagaccagcctgggcaacatggcaaaactccntctctnctaaaantncaaaaanttngccgggcatggtggtgtgtgcttgtagtcccanctactcagaaggccgaggtgggnggattgcttgatcccgggaggcagaggttgcagtgagctgagatcatgccactgccctccaacctgggcgacagagtgaaaccccatctcgatagataaataaataataaataaattgtggaatgatcttctttgacattctgctagatatgaaggctgcttagaggcagttgtttgagaaagaaaaaagcaagccctgacctccaggaactggtgacagtggacgctatacaccactcgttcacagtgttgctcgacgctggtcaggtgctcacagctcggccatgttgtcttcctgttggccataagccgactcacagagcactgaccttggacaaggtcatggtgaaaccatggtaaatagagacaaagcaaagccacttcatatttttttctgagcacagacacaaaaaagtttcctgtaggacccataattttgattatgacagggtaaagacaagttccattttctaggatttgatttgagccaaggtcaatgaatagcttattttgtagcttaattgacaacagtaaatacttttgcagtcttaggtcccgcttgatctgtactagggagggtaatttgaaccaagagcctgattcccgggcatttctgccctaaccagatcacgggctaaggatgcaacagagcatagtttcagcagagcccccttgaaaaaaaagttatgctgaatccatgatgcaacatccatttgaaatgaggaaaaagaaggcaaagatgacatgatttattttgtgtcatacctaaataattagaagaaagcccctttttctagtagcacctataaaaatttcactgggctttggaggtctaaagggaaattctagcacatatttcagctccagttaatccaaggttaccatcatctcagttttgtgaagagatggaagaagccaactgaaacagtagcgtaggaacccagccctgccttttgctttatatgtgaccttggccacgtacctgaccttcacctttctcatatagaaaaagaaaataggcgggccgcagtggctcacgcctgtaatcgcagcactgtgggaggccaaggcagatgactcacctgaggtcaggagtttgagaccagcttgaccaacatggtgaaacctcatctctactaaaaatacaaaaattggctaggcgtggcggtgtgtgcctgtaatcccagctactagagagactaacgcaggagaatcgcttgggcccgggaggcagaggttgcagtgagccaagattgcgccgttgcactccagcctgggtgacaagagcgaaactccctct

SEQ ID NO: 156023 - DNA, 976 bp, Homo sapiens
ttgacattgagtgtgtctgcattgttgaagtcactcagcatgttgccatgcgtttatccacttaggtcaacgttaagggaagttcatcgcctctgcttcttcagtaactgatgtctggtgcatcaactgaatgcatttcaggcttttcagcagttcccccagatctatgggtaaaaaaaggttttcaccatgcccacctccccagtgagtgaccaatgtctcattgttaatgcatctgatgcacagagtttagtggtctgagggaggtcagtcgccaagcggagattgaaatcacatttgtatttacattattacttttctacagtttggtttgttgcaggctttcacactactaatctgggctgaatccttgaattactttgtctaccaagggtttcaaagaacttgataaacttgttctaattagccaacatattcatccatgttgtccgtataccaggtgtaaaaataaaacgtttcttaatgcacacaggacatggaaggcaatctacacattttcaggtgtagactttgcttgtgactcttttgtgaggaatagtcattgttattttaggaaaaccctgagtttatccaactcttgttagaattggataagtgtaaaaacctacaatagaatgcaagtgtgagagccaattcctctggtaaaataaactcatattattatttatatatgtctggtcattgtattaataaaatcagtttgttttggctgaaacacatggttggcctttacaatagatgtgaaaatgggcttatagatcattgctctttattgtgaatattaggttgtatttattgccaaactctttcaacagcttctaagcagtgaattttcagtgcattgttgttgttctccaagtacaagcagccacttcagttttaccacattcatcttccacacactgatgaaccatatggaggcagcaggaattgaagtagaaccagagggagtagt

SEQ ID NO: 156024 - DNA, 277 bp, Homo sapiens
ttctcttgcagactgctctcgtctctgtgacctgcgttggcaacggttcgttgcttggagaccccttggcgtcccaggctcaagtgatcctcccgcctctgcttcccaaagttttggggttataggcatgagccaccggagccatcaaatccctgtgcttcttacagacaccagaaaaagtttcagccttgttttcaacattgttctgctgtgctttgtccaaatgaacctttatgagctgcctgccatccagtttctcttgcccacaatttcactt

SEQ ID NO: 156025 - DNA, 524 bp, Homo sapiens
ataaactctggacactatataaattatacaaatatgttaaaaattattgaaagtaaataaaagacacttgccaatttagaagctaaaaatggcattggaagttaaggactggtaaagctgtctccagtcctgcccaggggagaaggacattttgaccagggcacctatgaatacaatctcttaggccaaggcatctctagagtggagaaaggaaactttcagttgttgtctggtgagaatacccctcagaatcactccaagccacctacatattaactggttcccacacagaagaaaatgtaatgcctggctggtattttgagaagccagcttggcaggtgagttccatgctgcaaataaagtcttcagcttcagaccctcatcaagtctaaatttgattgttagaattagatgtcagcttgataaaatccatcatctaaaatgcaaaagccagcctgagcaacgtggcgaaaccctgtctctaccaaaaatacaaaaattggccgggtgtggtggtggcatgt

SEQ ID NO: 156026 - DNA, 410 bp, Homo sapiens
tggaaaaatattgaagttattaataactttgacttcaccaagtagattccaccttataaagatgttagccactctgcttcataaaatcaccatttgttataggagtctcctctgtgactctactgataaaactaggcctctctgttatatacaacatttcagtctcattttctgaatgaattttctaagtatggaaatcgtaccagtatttctaataaaaggatcactaactcttttctcagaaccagaaatgctgcatctgatataactagttattagctgccaagtgaaatatagaactaatattttagataggctcaggaggcactctatctcactggtaaacaaaataagccatcactataatgactcaaggaaacactattgttttttatgttaaggcaagcagg

SEQ ID NO: 156027 - DNA, 175 bp, Homo sapiens
ccgccaaccccctctcacccacaaaccccctctcacccacaaacccctctcacccacaaacctgccaaagtcgctcccttctcagggcctttgcacagctgtgccctctgcctggaatgcccttctcctgggtaccaccttagggagcccctcagcccctccctgagcctggccc

SEQ ID NO: 156028 - DNA, 455 bp, Homo sapiens
ggccccaggatcctctattaaatgtgtggtccatgaaccagcagcttcagcatgacctgagagctcataacctcgtctctacaaaaaatacaaaaaaagttagccaggcatggtggtacacgcctatggtctcagcaacttgggaggctgaggccaagtctcgccacatggcatcatttcctcctcacctgcagaatcgctgtgacttatggctcctctgattgcacctgctttcaccagcagccctggaagagagctcttctgtgtggataagagttgagagatcttggtttcattacttgtttaaattggaccctctcaaatgaatgtaagcacataatggggggactacactatgagattaaaaggaatccagctgttaccagaaatgggtgcctgccaggtttatccaccaaattctttccacttcatgtcattaaaataaaatttgagtt

SEQ ID NO: 156029 - DNA, 879 bp, Homo sapiens
gccactcgaccggatatgatcaggatcttgtcagcagcccttcatgtagtgctaaggagggatatgtctctgaatcgaagactttatgcatggcttcttggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgctgcaagtgtctagccccattatcattctcaatgcacaagcagcagcttggatctctcacaactgcaaccacccttcagcacggatcctgctccgttcagccggtggattcctcccaaacaattccactgttgacatgaagaccaatcactatcgtctcacttcaatataaactgtgacgtgtaatcaccttgggcatcctactccctatgcagtccggtccttaataaggtacacgctgattactactagtcacacgctgatttaatcctgaaatactagtagtgcttgacaggggctccctatattcaggacactgtgctcaatggtgccaaacgacaggaggaggacctacgcactacgcctaaagcgttgcccttgacaccaccaccgtctcctccctgcgccactcacgcactagggcctcaccgcaccatgggttcgggcgcggcataacaccacgcatacactgacgaccgccagcaccctcttccaaccggcagcccggcaccaacacactccaaagggacaacatcacacactgcccggacaaacccactcc

SEQ ID NO: 156030 - DNA, 672 bp, Homo sapiens
tcaattggaacttgtattgttcaaggatcaaatgtatatggttatgtccctatttctcttctcccataattttaaataccctctcaagaagatctcatagctttcaattaccatttatattccctcattctaaaaattatgtctttagctcaatattctggacctatatacctcactcactatgagataacttctctgtgatatctcattggtacatcaaactcaaccttttccaaatggaattgatggttttactctcttccttattcctcaaactatttcttattatctgttagtccttttcagtaatttgcctaagccagaaacttgggagtatattatcttagctcttggttgatctttctgctttcactcttctggcttccagttgttttctccatcagattacactgtacagcattgggggaaaactgagggtatttgggagcatctctgtgggccttgatagaaaattatattatattttgttaatgttgcataattataatgaaatacatcgtttgagagaagattaaatactgatttgcataaaattgccaaataaaatctttacaaatttagaataagtttaagctgatatctggatatattttagatatgttatacttgacgtggctatatttatttgttggttgacatttaaaatttttt

SEQ ID NO: 156031 - DNA, 379 bp, Homo sapiens
tcagagcacttatttgcatttttttaacatcttgtctatgtatacctgacagcttactgtgtcactgaattgacaaaataaatgtaataattattttatcagttgttactatgttttaaggtgacgtggaaattagaatttagaactgaagagaattttataactcaccagtgagctaaactatgaaaagaattaggcagtgtgagaaaaatgattctctcccccagggaaatggaaattatagggcatttttatcattttcaagggcttgaagggtatctatcttgcaaagcagaaatagcaatcgggtgttccaagccacctgggggattaggttggttgaagcatgatttcctgaggagtgagtatgtaaatgtaa

SEQ ID NO: 156032 - DNA, 594 bp, Homo sapiens
gtggcacaatctcagctcgctgcaacctccacctcctggttcaagcgactctcctgcctcagcctcccaagtagctgggactataggtgtgcgccaccatgcccagctaatttttgtatttttggtagagatggggttttgccatgttggccaggctggtctcaaagtcctggcctcaagtgatccgcctgccctggccttctgaagtgatgagattacaggcatgagccactgcacccggccaaaaccttgtttatttttatgaataatatgccattgtatgggcatactaatttttgtttattcatcagcggaagggcatttgaattgtttctgtttttcagctataatgaataatgatcaatcctgtgaacatttgtatacagcttctgtgtagacttacgttttcaattacgttgggtatctaggagtggaactgctgggtcacacagtaattctatattaaactttttgaggaacggccaaactgttttctaaagtggctgcaccattttacattcccaccaccagtctgaatgttccaatttctccacatccttgacaacgtgttgttgtctgtcttctattattata

SEQ ID NO: 156033 - DNA, 288 bp, Homo sapiens
gacaagtgaccacgtttcatccagaccaatcccagtcaggagttccgggagcgcagctgtgggaaacagcctacagacgcattggtgctgctccaagggcgggagcagggagcaggggaatggctgtgtgttctgggcctcctggcctcacagcctcctcaccagcagggatcatggatcaagcatgtgtgtgtcagagacgagcagcacagatggaaatgttccctgcccagtccagcagccacagggcacacagggcagcagagcacttgaaaaacggatggtgca

SEQ ID NO: 156034 - DNA, 92 bp, Homo sapiens
caggctgagcagaaggggtatctgaatactgctagacgagaagccagcctggcattcaaagtgacagagaccacccataacaagagtgggtt

SEQ ID NO: 156035 - DNA, 419 bp, Homo sapiens
caaggtaattaaaccacgatttgacagggacatttggcaatgtgatatttcagcattagaactctctttgcaacgcacttcctccacttggcttggtgaatataattcatttttattcttcagagtgtgttgctttgagatctgaaactgtcctctctgaatttcttcatggttcattgtagaacgctagaaaatgattaccattggacgttgtgggaatctagtcagtatctaagaccctatccaaggttcgtccagtagtagtggaatagggtctgtgaccctactgctggcattgtatttgaatattattatgccctatgtgatagtgatagtgcctttggagagaaacatgagttattttcataccactctaatttcagtttctctgttacctggatttacttgacgttgttctc

SEQ ID NO: 156036 - DNA, 262 bp, Homo sapiens
actctcttctctctcctgtacccacttctgattctgtctagtgaatccttcaagttcaagcttttgtaatagcatttccttaaagtcttccaagatgagcaggcctactcatttactccatcacactcctgaagaacccggtgatgccctgagcacatgacactgtactatagttactggtttagttgtatgcccttctggtagttaaggaaccacatggcaggaaccttgccttcaatcttgtatttccatcttctgccag

SEQ ID NO: 156037 - DNA, 473 bp, Homo sapiens
ggtttttgttgtcagctggttagacatgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtatgtagaactaa

SEQ ID NO: 156038 - DNA, 370 bp, Homo sapiens
caatgagaaacagcagtaagaaaatggtaggaaggatggaaaacataaaaatttaattgacaggatgattggatgtacaggtgagggagagggaggatccagggatggtacccaagtctgtcacctcagctgaggttgatggtattgtcaagtaaggttaagtttgagttgggagcctaagggacatcaagcagagatatccaggagcagatggaatctgtacacataggtattagtgggtgagtaagaagagaagtggaccaagacttgaccatagggagcaacaaatgtaaagccttaaaagaaaaagagagtatcagacaggtccagggtcgacgcggccgcgaatttagtagtagtaggcggccgc

SEQ ID NO: 156039 - DNA, 709 bp, Homo sapiens
ctgggtgacagagtgagaccctgtctcaaaataaatacataaaaatttaaaaagcagaaaaaatttcagagaaaaatcaagacagccctgtgcaacaacatcatgtgttccaacataattttaacacatgtgtaaagggaatctcaaatggagaggagcaaaagggacaaaaatttgaaagaaaaatctgaaaatttcccaaatttgatgaagattatctataaatccaagaagctcagtgaacctcaattaggataaactgcaaaaacaaaaacaaaaacaaaaacaaaaaaccacacctggacaaatcatattgacactgttgaaagacaaaatcttgaaaataacaagaggaaaacagttcatcacatacagggcaacaataatgtgattaatagctgatttctgatcagaaacagtggagaccagaggatgatggtgtgacataatcaaagagtagaaaggaaaacaaacaaacctgtcaactaagaattctatatccaggagaacaatccttcaaaaatgaaggtgaaggaggtttgactcctggttctagaaagatggagagatggagtagatgtacatttttctattcctcttactaaatacaactaaaactctggacactgcacataaaagaattataagcagaccatggaaagttaaagcagagtggctgaagacctcagagtcctagaaatgacattat

SEQ ID NO: 156040 - DNA, 178 bp, Homo sapiens
ttgtgtcccaggaacacgtactctctcccttgcctcatgttaaaaggccacagagctgttcaatcccaggagatccacttagaaaagccttagaactaatcctatgtctcgcctataaccaaattcatatttgtaaccagcccagcccaccaccagttgcattgatcctgcaaataac

SEQ ID NO: 156041 - DNA, 332 bp, Homo sapiens
tcatgagaacacgtatgaatgaccaccaccatggtgctgggatacatcattttccaagaccattcatggacctgttcactccataggcaaacactgattaagtatttgccacatccctggggcagtgaaggacaggaaactccctgagcatggtcctgccttcatggagcttaccaccacaaagagcaagtcagaccagcactgaaataagcacactgcacaggggagcgggggcccaggtagcgaggcagggggagccgccttcacagcagagggccctgggatgcttggggagggcctgtgaaccacggggagaagtggtggtgccgtga

SEQ ID NO: 156042 - DNA, 642 bp, Homo sapiens
gaggagagaaggggccaggaaccgctgctttcattagcagctcctctgtactttaactttgtacgatgtgctcatattactatgattttttttttaaattcaaaagggaaaaaaataagaacaaaatgatgatggttatttttaaaactatgtaattaaacctggaaaaatctcattttgctaaacagaaaaaaagtagcaggatactaaactatattaatagtatggtcataagtatgtttaataaagaaagagaaaaacatatatgggaggagaaaaatctgaagaaatttactaccaaatgatagtgggtgggtttctctacttttctaggtttcccacattttcagcaacgtgattctcatactttcctaatgaaaagaaatacattcattacataaaataaattaactgggccgggcgtggtggctcatgcctgtaatcccagcacttcgagaggccaaggtgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggcggtgcgggctg

SEQ ID NO: 156043 - DNA, 442 bp, Homo sapiens
ggaaatagttgtgagtcaggcagtatgcttttgttgcttctcacccttactatctctttgatgccttcttatctgccactgcagtggtcagttctttcctattccgtttgcccgctcaaagcaaaaggaagaagtattattgatgtttgctatgggtcaggctttttattgggtgtttgacatatactgtcatttagatgactgttaaatttgtggcaccagctctccttccccagctgcaaactttgtctattcaaattgcctagttaagatgttgtagaatttgtttatatcacatgatgttatacacaaatacctgcttaccaacctaccttcgtacatacatattgataatcctgttttatatagataagcaatatactcatgtaatgtcagtgaaaagtgtggctttttatgccagactgcttgaagaaactaaggc

SEQ ID NO: 156044 - DNA, 175 bp, Homo sapiens
caatggtgagcaggaaggcgaagtagatatggaaacagaaatgatactaatatcggtgattccttccttttttcctgtaataagtgctgtgcagacaacatatgagcagtgctgataaatgtaaatgtatttttcatagctcattaagaatcagtttcagaaagagatgtctgct

SEQ ID NO: 156045 - DNA, 272 bp, Homo sapiens
caatgggtgctcccagttgggccctcaaagccatgggaaaagtctctgttactatgtggacagcacagtgcatggtttaagagcactgactgtggagttattcagaccaggttttaataatacacactttgtgaacttaggtaagttcttaacctctctgagccttatttcaactataaaatgggataaagatatagcagctgcattagagaatggtttgaagactagaggaaacctgtacctggtacactgtaagccttagctcaagagat

SEQ ID NO: 156046 - DNA, 154 bp, Homo sapiens
agggccactcacctttggactcacccctggcaggtcctgtaagaggtgctacttgcttccactttgccagctgttcgttggccctgttttgtcttctgctgtttgccttatttatgaaacagaatggaaacaggcgagtttgatttcttataat

SEQ ID NO: 156047 - DNA, 481 bp, Homo sapiens
cttaggcacacaggcataaaaggaaggctggtttctcaggtcaagaggccatcgccaccattcacctggtgaaaggaagctgagccagggaggagggccacagtgtgggtgatgaggggcacctcactttcaaggggccccatgacactcccggctgctgtagtgttcattctggtgtgcacgtgctcaggaagtcaaagaaataaaatcagtaattttttttcatgcttcatctcgtatgtgttcaactctaccccttaaattttgagttgttcgaaataaagagccttccctcatgtatgcatgggaagaaaatatcctctcccagtccccatgcacagtcccgctcactcttctgcgagcagtgagagctgcgggcaatataacactgaaaattgtccttagtctctatgtatttgtttctctgatccgaataagcaagcaaaagcccacaggccatgcgaaaatccctcccagggaa

SEQ ID NO: 156048 - DNA, 421 bp, Homo sapiens
gttcagcagttctcaaatattgagtgcaatggctaagcccatttgaataatttaaaacacattttacactgatggcatattgatttatccttgatatacaaacttctcatggtgtttattaaaccatctaaaaatatcctaacaaatggaatctccattacgatctgttaccagtgaaaagcatgtcttatttccttggaagttttcagttgatttcctcccatatcataaaaatgatatcatggaaggctaagcgaataaataaatggttgtgaaatagccatatttgccgaagcatttcattaatggacatctttctttaagtaagtgatgcatttaagtacgtgacgctcctgtgttgataacctgtaagccatgcagacttgtctccagcctgtgtgttgtcttgtttctacagagt

SEQ ID NO: 156049 - DNA, 680 bp, Homo sapiens
ctaggctactctcttaggcctctgtgaacatctgtgccatgtgtacaggccacttcctaacaggcccaaagaggatgtgttttcataaaagttgtaaacacatttaagaaattatctgaagctcataagccacctgatttcctaggcaaggcctctcatcacattaaccatattttacgtaatgagcagatgggcagaataaaaccagagggaggagaagtggaggaaaaggacagtaatgagtgatgaaatggaaatcacgtgattaatggaacatagattttaaaaagtaatgaagagtttatccctagggtagaaaacagggaacaacaaaaataagtaccacgttgtcaaaacagtaaaataagagagtagaacaaagaaacagagcaagacaaagaaatgctggttttaggataggccttattttaaagacacaggggattttggaacttaccattttgcagctatttgtttaaacaaaaataaatttatgttgcctggtgtcctaaaagttacttatgacaacggtcattaatagataagagcctgcagctatccgggtacaccaacaccagcctttgtgtttgttcaacatttctttctgtgggaaatgtaatttgtagcataagagttcacaagaaccctcagctccatggctccatcactaatgaaacaag

SEQ ID NO: 156050 - DNA, 720 bp, Homo sapiens
tgggattacaggctcacaccaccacacctagctaatttttgtattgttagtagagacggggtttcatcatgttggccaggctggtctcaaactcctgacctcaggtgatccacccacctcggcctcccaaagtgctgggattacaggcatgagccaccacgcccagcctaacataaaattttaaagtgaacaattcagtgacacttagtacatttacatcgttgtgcaattgccacctttagttctaatgcattttgatactggaagtttttattttttctgtttttcttgatcagtcttgctaggggtttatgaattttaatcatttcaaaacactgaattttggctttgttatctttttcctattgcacctttactttcctatttcattgatttctgctctttataattttcacactgacttcagttttaatttgctgttcttgctaatagatggcttttttagggtagaaaattaggtgacctgttttagatcttctttctaatgtaaacatttaaagctataaacttatttgttttttattttttgagatagggtctcactctgtcactcagtttgtagtgcagtggcgtgatctcggctcactgcaacctctggcatgagccattgcgcccagccttaaagctctaaatttactgtaagcattgctttaattttctcccacaaattatgttgatatattgtttctttgttatcca

SEQ ID NO: 156051 - DNA, 387 bp, Homo sapiens
ttcctctcggcacacactctaaatatggtacaggttgagtattccttatccaaaatacttgagaccagaagtttttcagatttggaatatttaattatacttacaatcaacatccctaatctgaaaatccgaaatccaaaatgctgcagtgagcatttcctttgagcatcacaacggtgctcaaaaagttttggatttccaggcctaccattttgagaggctgaggttcaaggagcgcttgaggccaggagtttgagactggcctgggcaacagagcaagaccctgtgtctctacaaaaaagaaaaaaaattagctaggagtggtgccacacacctatagtcctagctactcaggaggctgaggcgggagaatcactttagctcagg

SEQ ID NO: 156052 - DNA, 220 bp, Homo sapiens
ctgatgaggagttatttctgggaaatggcaaatgcccacgggtgaccctgatgccagcagcttctctcccaccagacctgtgcttcccacacagccccacctgctcttgtctttagactaagagcctgtcaccgggcgttgatctagccggctttttcctttgtgttatgggcctgttccttcacctcagtgtattctctgcgtgtgctcccttctggga

SEQ ID NO: 156053 - DNA, 562 bp, Homo sapiens
tgtcctatgtaaacagcagttaaaaaattcaattcaaaagcagatgacagcatactgggtactagagattcaaagataactataagatgttttccttcctccttgagccttaaacccaattaccaaaactgaaataagcctgcatactctttagaagagtcacatgttaaatttggaaagattaacaaaaatacaatcctagtaccttcacattaatttttacataaaaattttaatacagattatatcacctcaaaatttgaacattataaaaggcagatgacgctgtttttcgtcttggggcaagattggcaagagggtaatcatgtgggaagagaagatcctgggcagataagcagaacctcagaaaggtatgtccttgttcatataggctgccgaaatatgtaagacatgatgcacaagttgaaaagtaaaatgaatagacaatccataattaagaaatcctaaagctttccaatttgaaaatatggctgatgctaaaacaaagaaaccaaaaaaaaaagacttaattattcatttacacttgccaatgtcctctctg

SEQ ID NO: 156054 - DNA, 578 bp, Homo sapiens
ctcgggatgacgtggcctatgtacgtacgtggattggagaaatacctgtcacgaagcagatgacagcatactgggtactagagattcaaagataactataagatgttttccttcctccttgagccttaaacccaattaccaaaactgaaataagcctgcatactctttagaagagtcacatgttaaatttggaaagattaacaaaaatacaatcctagtaccttcacattaatttttacataaaaattttaatacagattatatcacctcaaaatttgaacattataaaaggcagatgacgctgtttttcgtcttggggcaagattggcaagagggtaatcatgtgggaagagaagatcctgggcagataagcagaacctcagaaaggtatgtccttgttcatataggctgccgaaatatgtaagacatgatgcacaagttgaaaagtaaaatgaatagacaatccataattaagaaatcctaaagctttccaatttgaaaatatggctgatgctaaaacaaagaaaccaaaaaaaaaagacttaattattcatttacacttgccaatgtcctctctg

SEQ ID NO: 156055 - DNA, 196 bp, Homo sapiens
cctgattactgctgcctctgtcttcagagttcctactactctccttaaaactggagctgaaggatagacaaaaattcctttccctaaggtaagagaaatgtcttagaattataaaagtacttaagttgatttttagatcttatgttagaatctttgagttctttcccattcagtatcctatccgaggttgccccca

SEQ ID NO: 156056 - DNA, 290 bp, Homo sapiens
ggggggtggctttgaaaggggcattcttaaggggaatcactggaggacctgcagaagggaaaaaggcattcttggtgctgaccagaatagaaagtattttcacacccacgaaggggcgttctgctggggagggaggtggtcagggccattgggggctgttgctgtatggacagagataacgggggacagttctgctgcaaggcactaaggaaacactctggggagaattatatagaggatactaataagagggttcacgagcagctgccctacatggggaggggcaatgc

SEQ ID NO: 156057 - DNA, 680 bp, Homo sapiens
ggaattgtataaggagcataaggagtaagattaacttttgtcagaggagtcaggaaaagcttcagagggaaagaggcatttaaggttaaccaggaaggaagagaagaggagggttcatcagaaagagaaggccattggtaaaggacattttgggcagagggaacagaatgtgcaaaagcactgggcttataaaagggatcagaatgacaggaatgttgagagtatatgggcctggtggcagcagataaatctgaagtggtaagctgcccctgattgtgaagggtcttatgtgctcagctaggaacttcgaacgttatgttcatttagtaagaaatgggcagataactggatttcttaaataacggggagtgatgtgagcaggatagctatctttcttcctattttattattatacaataacaaaatgccttctagaagcaggatctgctcttttacactcagctatggaaacctggaggctgcttttaaaacatttgacacagttaaatccttctctgacatcatgaggcagtttaggccatggcatgatttgcaaggttgtaaagtgatattgtgatgaagtactattttcacagtactatttaaatataaacactatacttatcaaattaaatggcagaatactgagttgtgatacatataaaccttctatattaaaa

SEQ ID NO: 156058 - DNA, 384 bp, Homo sapiens
tgaaaaccacagggaaatgggtactgtgtgttagaacctgggatatcattttttaacatctttgtgaaatatggagagaaatccactgcctaattttattgcattttctgcaagtcagtttactcttctgctttcaatatatttatttccatttactcttaaattctttcttagttcctcagtctcaaattacatcccatgcttgttcacttttaatttcagtcttttattttctacagctatttcctcccatatcacatcttcgcatcttcctatactcttgactgtgccaagcttcctgaaattttttatttttatgcagcagtagaaatggtagacaggcaggttgcagatataagcttgccctctagcttcagatcttag

SEQ ID NO: 156059 - DNA, 460 bp, Homo sapiens
gtgcttacttcaaatgcagcataggatgggttgaatggaaagaagtgaatggaaagaagctctcctcctgggagggttaatattctcctattttgctccccaagaatatggttagttgtacacagacacaagattctatggaaaacctgagactgactaaaagtcatgattgactcaagaagtgcttgcattcatataccacccattggaaattcaacaatgaataaaacatgcaggctgtatctctgagattcccacagccaagtggcatgtattacataaaaactaaatatttgtagtgtgacatgacatcctgtaatagagatgagtacctgtgttatgggagctaaaagcagcaacaactaacttcagcttgggaattatgaaagtttgaaccgaatcacaaaagaacaaggaggatatatgtacctggtagacaggaagtcatataaagagaggt

SEQ ID NO: 156060 - DNA, 331 bp, Homo sapiens
gaaatagggtgtccctttgtcgctaaggctggagcgcagtggtgcaatcacagctcactgcagcctcgaccttctgggctcaagggatcctcccacctcagcctcccaagtagctgggaccacaggtgcgttccaccacagctggctaatttttttggtagatggggtctccctgtgttgcccaggctggtctcaaactcctgggctcaagcaattctgccttggcctcccgaagtgatgggattacagaggcgtgagcccctgcacccagcttaacatgacttcctaaaatcagattctgaactcaaggtttgtttactttcgcagttta

SEQ ID NO: 156061 - DNA, 366 bp, Homo sapiens
gagttacataacttgctgaaggtcaaacaaccagtaagtggcagaacgagagactcaaagccaatctgattttgaagttcgttcttactatgctacactgctttctgcaatctttaataattgctaaagcagccagatcatatttatctacttcaatcctccattcaacatggttttgccaatgtcagtcctctctttccactcttcctttgataaatgattttaacctctctagaattgagcaagttttcaaataataacacatccagtacaatatcgaattctagatgccatctcaccaatcctttacattttccttcttcactttatttccttacttgctgtgcaaaatagcattgatcattg

SEQ ID NO: 156062 - DNA, 378 bp, Homo sapiens
atcatctcacctgaactacttcaattacctcctaattgattttctcttttactcttacactttattatctacactgtagctaaataattaattaaaaagagtatgttaggtgctctgaaagggaaagtatagtttgatgaggtgggaaacaaagaggagtccctgtgtgccaggggatcaggaagggcttttgatgggaggtgaacttgctatcaaaatcagtcctgaagtcataaaaattagtcatgtaaagattaaagggctatgttggaggaagaatgttccaggcagaggggagaataccatgttagaagttttggaggtaaatgagagcttggtgtattgaagaattgaaagaaattcagtatggctggatta

SEQ ID NO: 156063 - DNA, 447 bp, Homo sapiens
tggagcgggaaaacagtcactgatggggccggccttagggcgggctacccgtggggcccgatgacccacacttagctggaaggaagaggcagccaacaacacttccttgagtcacacagctggagcccaaatccacccattagtccaggaccaaagccaatgtcatccgcggcctctcccactcctgcatccagtccctccccaagcctgtcagctctacctgggagatgcagtcatgacaaggacctctcaccaccacacctgtctcctgggcaaagggctgggtaacttctttaagcagcagagagtcaggcttttagggccatatggtctctgtcgcaacaagcctctcccattgcagccaaagcagctgtagagcatacgttaccaagtgggtggggctgtgcccccatcagtcttccctggcaggacagcaggtggctggat

SEQ ID NO: 156064 - DNA, 663 bp, Homo sapiens
tgtctcccaagtgtctttccctggtagctgcagaggtcaaaggtcccaaacacagtgaagagctggactttctaaaatccagttgctgtcaaaacctctcagaaaagccaaccagcaaggcactcatctttgctgccccaagggaccaggttcagggagctgagtcacagaggagcatgcttggaagctggccagctccacagcagagcagtttgccaggccacgtgccacctgcttcctgtggctcacggccttctggctggcaagcccctgtgggccaggaagctcagacctaacctgctgtggcaggaggtagctctgaagtgatttgtcaggaactgtcctcaggtgaagggagaaatgagacaaggcacttttgctcccagaacctggcccttaggggactgtgaattgtgatcagaaaatgggagagaggacatttctttaaccttgagatctcccatctgagtttcaggagcagaacctgaatcaaccaagaagggttagcagaattgggaaactgaatgatagacatagtcaaagagtctggctgttgggaaatctggttttctgtaaggcagtggggcactgttctacatgggcaaggatctgcctgcctcacattatcccccagggctgtcaaccagaccccaggcatcctct

SEQ ID NO: 156065 - DNA, 426 bp, Homo sapiens
gttattctcgggtcttggttttggttattaagtcaaggaattgatacattatgtatatcatgtagatagacatacattctttgtatctttctattttgggggggtaacggacactcttaattaggtttcattaattttctctgtttatctcacttttggaataatactttatttttgcattgcactttcacatcaaaaagggttaaaattcagtaaacatttattatatgccagatagtaggctaggttctttcatatatattaccttatttaattctcaaaacaaccctggaaggtagatggtatcgttttaaaccttgattttttttttttttttaattatggagagagaggcccagggaggggccatgacttgcccaagatcacagagtcggtaagaggtgaaaccagaccttgaactcaggt

SEQ ID NO: 156066 - DNA, 279 bp, Homo sapiens
tcccccgcaaaaaagagaaatgtttgcctattccaagtgcaacatattggaaggaagatattcttctgtattttgatcttgaaactatattattttaccattcacacttgggtctgtggttcattttattgaaagatcagttttccccactgaactgcaatgatgccatgtcataagtcagatgattatatatgtttgggtctatttctatactgtatcttcttccccaaaggtctatttatctctgcttgtgccattactattaaatttttaaatatt

SEQ ID NO: 156067 - DNA, 348 bp, Homo sapiens
atttcttggtatcaagcctggtccatattcacatttcaccagttacctaaaaattatatttcttttcttttttctcatttctttgttccaatcaggatacaaacaaaggacatgcactaacaacattttgtctcttctagattttaatacagaacagctcctcctcaacttccccttttatcatgccattagctcaatgaaggcactagctcaattttacaaaccattttcattcatttcatgaccctaattatttactatgcacttcagaacatagtggatctggctgacaccttctagcttcaaatacttatttctgttccttcactatttgtcataaaagaggaa

SEQ ID NO: 156068 - DNA, 316 bp, Homo sapiens
tagttgactttagctctaggggaactgtgggacctgaactctgcagggcagtgttgcccatcagatggggctgctccgacctgagcaacccttggtctgctggcttctcccgggggccccagcctggctgcgtctgcttgcagtgcagcctcaggtgccctgggggtctgaatctcagcacctgcactggcagacagcgcctgacgagacctccagcagggcggcccctgggaccagcatcagcccgcctgctccttcctccactgcagctcacccagcccaggaccacccgccacacctctttgctggcgctcgt

SEQ ID NO: 156069 - DNA, 451 bp, Homo sapiens
gatacagataccattatctctgcatcacagatgaggaaactgaggcacagagaagttaagattgccaggctggtgagtgacggaggacttggaatgatcctctaagatttcatccaggtcttaaaaaaagtcgtggcatattctccatgaaaaaacatggtgaagaaaatctcagctgtataatcctaccttactacaaagtttatatttatgaatgagactaggaataccagccagccaagtttgtggctgttgtgtgtttccagtctgtagaggtttcctgctagacatgcaagaggtgggagttcccaattcccaaggtatcccgattaaggacatgaagggtgaaccacaaaataggaatgcagtagacatcaggggcaaggttatggtgccagggagacatattgctcgcctggaaggattttactaccaagtagagatgctcctt

SEQ ID NO: 156070 - DNA, 309 bp, Homo sapiens
ccccccaccccacaacagtccccggtgtgtgatgttccccttcctgtgtccatgtgttctcattgttcaattcccacctatgagtgagaacatgcggtgtatggttttttgtccatgcgatagtttgctgagaatgatggtttctagcttcatccatgtccctacaaaggacatgaactcatcattttttatggctgcacagtatcccatggtgtatataataacttccaattttccttaaattccaagaggtttaaaggccctatgctagtcgacgcggccgcgaatttagtagtagtaggcggccgc

SEQ ID NO: 156071 - DNA, 371 bp, Homo sapiens
cccctgggattacaggctagcaccgcctccggccttggcccatgctcatatcttgtcacttcacctggtagaccttgcctctgaggctgagcaagggatccacgtcaaccctttccaagtccgactgaactagagggcaccttggttgcgtatggagccctgaaacagaaggcaggtgcattctgggcacccccctgcccaaggcttcaattcctgtggtctctctatgctcagcctggaaagcttgggccacctctctcctcacccctggacagaccaagtcctgctgactccgctgtctacaccacctcatcctccttccctcccctgctgtctgcagggcctccatctcctctggtcttttgtcctcc

SEQ ID NO: 156072 - DNA, 315 bp, Homo sapiens
cagtcagaacagaatggctctcaaatgggaatgtaaggtggggactcttaacaagggtgtaggcagggtttggggggactaactggggcctgtgacttcggggttccccgcgatcccaggtgtgaaggaatggggagcagtcatgagaaacggagaggacgactatgtgctagggccactggacagagccctgggtagagacccactagaggggggttgaggataaataccaggatccccttcctcctgcctttccctctgctgctggtgcctcccatcagccaagcacacctgggagctggaagcaggggatct

SEQ ID NO: 156073 - DNA, 130 bp, Homo sapiens
gtgtgtgtgtggcatggtatgtgtatgtaccacgtggtgggtttgtgtagtgtgtgtggtgtgtatggactgggtgtgtggggtggggaggtacgtgtatggtgtgtgtatacatggtggggtatgtgtg

SEQ ID NO: 156074 - DNA, 587 bp, Homo sapiens
gccagtgaaatctgaacactaattggatattagattatcaaacattaattttgttgttataaaagtattttgggttttaaaaacatgagcccttccttgtatacaaacttttggaacattcatgagtgaaaatgatgtctggatgtgcttaaacaccccttctcaccctcaaaagtcaattgagcattactggccacacttcataatttttagaactgaataatgtgtactgggttcattatattattttctccgaattttttgaaaaaaattccagtagaaatacaggaaaagaactgtaaattaaagtggtgggtgtaatgatttcattagagtattcactatacttttaagtgaatgttttgactaaaaaaataaaattaaaaacacagacatataggggtgaaaagaaggaaatgtgaaggaacaaagatgctatcatgtggtgattatgatgaacacagcatacatccactagccagtaactttgagacagaagtgaacaaatactatggtgttatgaaaagaaaataaaactagggaccccagtccactctgccaaaaggaaaaacattaagctgaaagct

SEQ ID NO: 156075 - DNA, 415 bp, Homo sapiens
atgctcgtgaggctccagagaacagtaaactcttacatgctgttggtgggaaggtaaattagtgcagccactatagagaacaacaggaggttttctcaaaaaaactaataatgggactgccgagggatccagcaaccccactactgggtattcaggcaatagaaaagaaaacaatagatcaaaaggatacctgtcctcatatgtttactgtagcactatccacaacagcttgtgtatggaatcaacctacatgtccatcaccaaatgaatggacgaaaaactgtggcacacaaacacagtggaatactattcaccgtataaaggaattaaatcctgttattcgtggccacgtggatcagtctgacagatgttatgttaagtgcagacacagaaagataaatactgcacattctta

SEQ ID NO: 156076 - DNA, 206 bp, Homo sapiens
agtgtttgacttgctttggcgctttgccaccaaaatctattagaataactgatttataagaaatattttgataagatgtgtatttaataaaaatactaatgtccttgacactgtggttcaagcttttttttttttttttttttttttttttcaaaaaaaaaaagccaattttcaaaattgtcacgaaaaatactatgtgggcccca

SEQ ID NO: 156077 - DNA, 548 bp, Homo sapiens
caagaaattttccttcaagaattttacctttgcaacttggctgtttggcttccagcttgtcttaactttcgccatgccttcctcactcagctgcgtcatttgtagcttttgatttaaagtgagagatgcgtgactcttttttacttgaacatttagtggccattgtggggttatttcattggcccaatttcaatattgttgtgtctcagaggatatgaaggccccaggagagggagagagacagggaacagctggtcggtggagcagtcagaacacacattaggttcactgtcttgtatgggtgtggtttgtggcgcccccaaacaattacaataggagcatcaaagatcaaatattataataatggaaaagtttgaattgtgagaattaccaaaatatgacacggatgtgaagtgagcacctgctgttgtaaaaacagcagcagtagacttgcacagggttgccacaaaccctcgatttgtaagaaaatgcagtgtctgtgaattaaacgaggtgtgcctgtatttgaggtgggctcagtttgccag

SEQ ID NO: 156078 - DNA, 1164 bp, Homo sapiens
actcaggaatgtgcttctgtaacagcagctgagtctcagccagtccctgcagccatatttcaaccactcacagccattcaaaccacgctcaaataaagctccaaggccgagctgtaaccaatccggcagtttctgcacctcgcttccattttctgtactcactttcctttttctgtccataaattctccctgaccacttagaagcagtggagtcattctgaatctgcagtgactctgagggctgcccaatttgaaagtcgtttcttccttgcccagtgacacccttaaatttatctaaagttgttcttttaacacagttggttcaaactgacccaattaccacactatggttgacatcattttcccgagttgatatccttcatatgtggctgcatgtccactgagcaggcctgccactgaggccctctattatatcaatgtcatcctctctatagtaattttaatctttcacaaaacagccctcagtacaagttactatttgaccaattacacagacgttaatgggtgttttgagaagggtcaaggaagaagagcagaaaatgatgaagtatggaatatgttatagctgagaattttctttaaaattacaaacagtgggtcaaagttatgtgtcagtcacttccagaatgccattttacttccagagatctgcatgagctgaccttcaaaataaatggactagggttcagaccaagtaatcaatcaatcaatacagcatgggatcctgattatcaagaaaccccacagagctcacagaactcagcagccccctcccaaggtgcctattccctcacttgtaaaacagtggcagtcatccctcatcttttcatggaaatttagtcaaaaataaaagtagtgtaaaatgcaaatcatcatcaagatcaatcaaaactcagatttctagatttctcataaagagggacttggacactaacacagacaggtgagcgaaaaacaaaccacaatagctagtgagacaaaagctagacctagtgaggtctagcccagggcatacaaagcacgcccacacattcaaacgcccttcagtccagtcacaggcccatgctctgggaagagctctcaggatagtaacggctctagctattgctcagccttccgggtctgccctggtcctcgtgctct

SEQ ID NO: 156079 - DNA, 547 bp, Homo sapiens
gcaggtgataataaaatcagagaagagtgtcaatgaaggaccagaaacctctttgtcctgaaattacaaaatctggaagccacttcattccagaaatggtaccacagctttctaagttcacacaatattgatgacatttccagccactatcagaaacatgagctactgctggggctcttgataagtagatgaaaagagatgtcaaattttacataatcttcatacagattattgcttatggcctgtggagttgggggaggcagatatagctgtactcagaactaggagatgttggccccacttaatcacacattaggcgttcaaaggaacaagagtctagaaattagttgctttaaaatgcccagattttggagagaaaataactttcctggctgggcgaggtgactcacacctctaatcccagcactttgggaggccgaggcgggtggatcacaaggtcaggagattgagaccatcctggctaacacagtgaaaccccgtctctactaaatatacaaaaaaaaattagccgggcgtggtggcaggc

SEQ ID NO: 156080 - DNA, 283 bp, Homo sapiens
ctctgtcaagcatcaagtcagtgaaaaataaaattagattgttgaactatgtgctattcacttaattctaaatttgaattatcattgtttcaaaatgaaatcaaaggataagtaaatgcaaaggccttttgtcattttgttatgctgtttattgtgttttattattttttgctttattttttttttttttttttttcattgggaagccgcgctctgttttctccccccccccgtaaaaaaaaattactacaggaaaaaccctttatgatcttctctctctcat

SEQ ID NO: 156081 - DNA, 317 bp, Homo sapiens
cgaagacactcacctgtggagcctgtgcacgtaggtagaggcggcggctctgagtccaggagctccagtgggcagctccccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtgagtgctcaggctggctgaggtggctactgca

SEQ ID NO: 156082 - DNA, 340 bp, Homo sapiens
agggagtggtggttgctcacaacccagtgaacaaagcgggaggaagcttcctggaggacggggaaccacttttgggccccatccacctatccccatttgacagttgactcagactcagggaccccttggagcgggcttcaacccatgccctggcttctccgcttagctctgttcgcccctggcttctgctcgcgttcccctccggtgtttgctctacacagagttgacctggagttcacggaggtgatgagatggggcatgccagctcattaaagctcattaattagtctgctggcaaccagcccagtcagccctgccatcccgcccaccccggcacaag

SEQ ID NO: 156083 - DNA, 345 bp, Homo sapiens
tctctacaaaaattagccgggcatggtggcgcatgcctgtagtcccagctactcgagaggctgaggcaggagaatcgcttgaacccgggaggcggaggttacagtgagccaagatcgcgccattattgcactccagcctgggcgacagagcgagactccgttctcaaaagaaaaaaagaaaagaacaatttgtgtcatgatttagcacaaaaatactcccaacgcttctttcatttttttaattgcaatatctttaaaactacataatttaagagtttaaataacattataagaacgcaacttttcaaaaaaaatctattctctttcagcagacaaagggaaaca

SEQ ID NO: 156084 - DNA, 556 bp, Homo sapiens
agttaatttttgtatttttagtagagatgaggtttcaccatgttggccaggatggtctcgatctcttgacctcatgatccgcccacctcggcctcccaaagtgttgggattacaggtgtgagccactgcgtctggcctatatttgtaattgttatatcttcttgcttaattgacccctttatcattatataatgaccttctttgtcttcttctatagtttttgtcttgcatctgttttgtctaataccttgtattagacaaaatagttaacatttgcatggaatatctttttccatctctttattttcagtatatgtgtcttgacaagtgaagtgtgtttcttctaggcagcagatcattgggtcttgtgtgtgtgtgtgtgtgtgtgtgtgtgtgtgtgtgtgttttatccatttacctagtctgtgtcttttgattggagagtttagtccatttatattgattgataaggagttactcttgcatcttttttttttttggacatagggtcttgctctgtcacccaggctagaatgcagtggtgtgatcacaactc

SEQ ID NO: 156085 - DNA, 313 bp, Homo sapiens
atgggccgtggccaggctgtcacctgtctgtgatgggcctacctggcagcctcctcagctacagcaggggcccccttctttagctcccatctcaggacaggtctgcccacctcgtccctcagcccagaaaccagggaatcatccctgacaccagcttcttataactgtcagcctggtcagttctctaaatctgggtacctgcctgtcttttttgtcttcaccttcaacaccttcctgcatgcccctatcatctcttcctggactgtcagagtctcctaactggcctagccacgatcacttacacctcaccagc

SEQ ID NO: 156086 - DNA, 272 bp, Homo sapiens
ttcatttatctttgtgtctcctctttgcatgtggttggcactcagttgtctgttgaaatgaatctttgagaatactaccagcagtcaaaatggaaaccaccttggttcatagccacaaatagctgagatccattttttttttctctgtgtggggtaatacctctccctactcgagttaattactaaatctgacaaccatttaaaaacacaggtgattatcgggctatatgcttctgtttttttgagattgaagtctgtctgtcggcttagaa

SEQ ID NO: 156087 - DNA, 451 bp, Homo sapiens
agcccgtcgagtgtcaataaaggggacttgctttggggatgtgtctgggccccaggaccacattcgaggagcatctttcccttcccaaggcaaggcatcttggctacatgtgttggaggatttgcagagccaggatttgggggatagaccaggctgctttcccgacccatgacacacctggactcttcccttccctttttctggctgacagtcttcctagaaagaggtcatttgtttggcccctccatggggctgtgtgaagtcagctgacgggcttctgcacattaagcggagaggtcaggagcacgttatattcattgtgatagtttgtgtgatagttctactatataatagacattatgctgtattttgttacttttaggaaatacatgatgaagtgttttggttacattttaggaaattggctttgagttgacatgtaatgcattat

SEQ ID NO: 156088 - DNA, 286 bp, Homo sapiens
gttgcatcttagatcaaatgggaatgtccataagggagagatggagtctgtacacaaatacaggaagtaccaagttgtgtaagtccagactggggatggtgagggcctgacagaaggcaatgaggcaattagagattggagcctgggactacagaatcatggtctctgtgggagtctaggccatggtgggtggaggtcaggccgtaaagtccccaggccatgtcacccagtctcccctgaacactgagaccagcacttctatgctgcagtttcatcttcccaggct

SEQ ID NO: 156089 - DNA, 579 bp, Homo sapiens
cggctgaagagagaaccttggtgttcatagctcatctaatccaagaaagtcgaaagaggaaacagactcagggaaagaaaatatttctccgaggcttaagtttacagagggaagaaggtacgagaaagattcaagaaaaacacacattcaatgcacaaagcatatgggcctgcaatggggcatgaactaccatgcagtagagggaagagccacaccagatacccgcccatttagggcttgggacgttcctctgatgttgacagatgatttttcccattctatcagtgtggaaactgagtgtcagagactcatgtcccatgtgctgggtgaggtcaggtttcaccgcttcttgcctttttctcttccccatgcagccttctcccttgcctccctgccacatcaccgtggggtcctcctgccaggctgacggccagcacatctcttctggtttcccacacaggtcccaattgtatcaaggcaggaagaaaactcaagactagaggccccaggccgctaaacgattcatggcccacattgtagacctcaaggatgggcaaataaaatgtcacaaggcaagtt

SEQ ID NO: 156090 - DNA, 406 bp, Homo sapiens
gtgatcatttctatgatattaaaaatataagctttgttctgccaaatactttagaagatgatttattttccctcttttggttatagcatagcttgtttcagattaggttgcagctatgtgacgagttgttaaatgaaaatttaaattccagtaggtttaaaatagaaaatcactgcctgacttcaggctatctgcctggtaattgcagaaaaaacttcgttaggtccgtgtagaatgaatgagcacaggctctatgaaatgctgttcagacaaccatccagcagagaaaagactttgaagatgattgccttaggagttattgagcacacatactgaagaagtaattctaattcaaagaatgaaaaccttcttgatttttatgaagataacttactagaaccactgg

SEQ ID NO: 156091 - DNA, 232 bp, Homo sapiens
aggttacagagaaaccagggaataaggctagaatgatccatgtggtaatgcgaaaaggtcaaacgagagaatgaactcatgtttagctgatatagacacagatggatacatgtaaaaatgtttacacagtatgtctatatatccttccttgtctactgagaaaatctagaagcaaggtggctcacacctataatcccagcactttggaaggccgaggtgggcagatcacttg

SEQ ID NO: 156092 - DNA, 149 bp, Homo sapiens
cggctaattttgtttttgtatttttagtagagacggggtttcaccgtgttagtcaggatggtctcaatctaaaacaggagaatcatttattgagtgcactcaggcccagctgactcaacgtccaaaagactgggcccggaagaaagaca

SEQ ID NO: 156093 - DNA, 584 bp, Homo sapiens
ggtgagctaagagtgagcatggagaaagtataccctggacaaaagtggcacaccacttccactcacatgccattggtgaaaattaatcacatgaccgtatctagattcaagggggctgggaaatgaggcaaagcaaatagaacagtgagtggcaacagtctctaccatgcttcctacacttcctctatagtgaaatgtatcacatcctattgcaaatgtgtacctaactagttgtcacattggtagattttcagctttgttgtggtaagacctgacttggtcactgccatctcctcagcacctagtatactgcctggagtgtggtcaggactcattaatgacagcatagatatacgatcaaggaaggctgtccactctgcctcagactgtaataagagtgaggataagctttaaatgtcaatgtcataaaaggtaaagaaagattgtggcaatgctctagattaaaggcagctaaagagacttgacaactaactgcaatagctgtccccagactggatcctgtactggaagggagaaaatgttacaaatgacataattagatcagatgacaaaattggaatatg

SEQ ID NO: 156094 - DNA, 290 bp, Homo sapiens
ctagcccatgccgtgccccctcctctgaattcccagaggaatacctctctgtgtgccactcccccatgcctggcataaagacccccttgtactgttctctttctgtgtgtacacatctcatctccccagggagcctatgagcttcctggggggccaaactcagatttaccaccctcagtcttggacccaaagcacagctgactcctgctcagctttcaaggctcatggcagccttcacctcttccaggaagtctcctcaacctccaggtgggtttaggggcctcccacag

SEQ ID NO: 156095 - DNA, 546 bp, Homo sapiens
tgatttgaagtaaatttttgaagtaaaaattaatattatttgtatttccatacaaatgtttaaaaattgataagtactgagaatggtttgaattaattaagtatgtctgcagtgcttgactgagaatatttggagcttttggtatctatgtgcctataaaacatatatatgctcataataaacacataatttgtgtgtctctgtatatttttctgtactgtaaaagcatgttaaggataaatatccacagaatgtaagcatgattagcaaattcattattttatacacttgtattagtgctagctatttaacttttctgtattcatttttaaaactttctgagaatatttaaatttaactcaaactaggctgtttcttgttcttcaaaaaaaagacaagaattattcaaaaatatgtattaaataccctgtattttccaagtagttttagggacttactagatattatttctggattcttatagctctaaacctctatgaacaagctgagtcatagtttgagtcaataccttgacatattgatgct

SEQ ID NO: 156096 - DNA, 349 bp, Homo sapiens
aaatgggagagagggaggagagagggaggaggaggggaagggaagagaaagagggaagataggtggagggagaagggaggggggcaaataggaaggggactgaggaggacacagggagaagctgggaactaacccttcctgaagatgtgctaaaggctgaggtaggcactttacatattttagtcccatcccatgttacaaatggggaaactgaggctgagaaaaactcagatattatcatatattctgtgaccgtgacagaggtgggtgtgaatgaaggccagccctcttatgtcaccaaggcatccctctaactcacagaggagtcccagtatcggtggtgccacct

SEQ ID NO: 156097 - DNA, 215 bp, Homo sapiens
acagtagtaggtctaatgttttggcttaaagacaaaggtgacagggaataccctagttaatagagaatgcacttcagattccatataaagataggagcttgaattataactcatctttcaggattactctaggaagagataaattcttattacacactaatatgctaactctacacaataaaaaataagcaccaactgagcataacagttctgtg

SEQ ID NO: 156098 - DNA, 527 bp, Homo sapiens
cagtttaggatctagtttgcattacctccaagagaatagccatgtttgcttttctctgctgccacactgtagcatgttatgttttgacttgggacaaatggccactctgaccagcatgtgatggtactggtacctcatctctgatgattagtgatgttgagcgtttcccatgcctgttggaatggcaatccgttggaaatgtcttctcagttactacccatatgtatgttgctcaggccactgtgtggccccagcactgttggtttgcatcgggacttggggattgtttgtcgttgttagccaagacaaatgttacactgctgttcctacagtgagtagtgggagtggggtatggggacatatgcttatgcccacagttccatcagaaatcccactgccttaagacagtctcacgggaacccagtcccagccttgcagcactgggtagccctgtggcattttgactttggatgtatctgcattgttgaagtcactcagcatgttgccatgcatttatccacttaggt

SEQ ID NO: 156099 - DNA, 150 bp, Homo sapiens
ttttcagcctctggtcatcaccactcctttcggtccccaatccatgttgtaactcgttcaagcgtaacaccgcctaattattctgagtcatgagcacaaaataactcattctgtcaatcacattcttttttttctttttctttttaagat

SEQ ID NO: 156100 - DNA, 654 bp, Homo sapiens
aattttcactatagactgttggccagcaaaattacacaaacaaaaaaataattacaacaaactaaaattccctgattcattcaagtaacccgatttaaagtaaaggttaaacatccttaactgaaaaacgcaaaatccaaaaggcttccaaatctgaagctttctgagcaccaacatgacaccacaagtggaaattccacacataagtacttaagaggaacttggtttcatgcacaaaattattaaaaatactgtataaaattaccttcaggctatgtgaataaggtgtatatgaaacaaatgaatttcatgtttagacttgagtctcaccccccagacatctcattatgtatatgcaaatattccaaaatccgaaacacttctggtcccaagcatttaggataagggatactcaacctatatattaatcctaacgtagcacagatcctattaaaaatctctctagttaatcattttattcctttttggggaaactaatttcttccattcctattaacagttagaaagataatagcatttcagtcccagatctttgcacagcatacaacctaggccctgtggaatgctgtgggggaatatgaaacagttcagaggggaatacgaagcagttcagaaggcatgctgttgacctca

SEQ ID NO: 156101 - DNA, 363 bp, Homo sapiens
gtgaaactgttctttaactgttgtttcagttggcatgagctcaaaatggtcaagtgacaaactcagcttcactgtagtggagcggttgttgtgtcctaaggtagaagtattccaagacctctaaaccaagaaaccaagacctctaaaccagctgaccaagcgttttaaggatggaggaaaaaatgttttttgagtaggttattaggtatgataatgagagggggcactctgattcaatcttttaatttccagatctggactgacgtggtggctcatgcctgtaatcccagcactttgggaggccaaggctggcagataacctaaagtcaggagttccagaccagcctagccaacatggcaaaa

SEQ ID NO: 156102 - DNA, 180 bp, Homo sapiens
tctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaa

SEQ ID NO: 156103 - DNA, 157 bp, Homo sapiens
aagctgaggcaagaggataccgtgaggccaggagtttgagaccagcctggacaatgtagcaagaccccatctctaggggaaaaaaaagtgtcttgaaaaggctctctataataagatctcactgtgtgtggcttcaaagacagctttattcaatttg

SEQ ID NO: 156104 - DNA, 286 bp, Homo sapiens
taaccacaggcatggccagtgtctgtagagtgaccgttaaaaattccttagacatgcccaaggaaaatgtgatagaaaataacaagcacgctctgagattagggcaggaaaaggattgatacagagtttattgacacagaggtattctgctaattatacaagtctctgcttttttttttttttccaacggagtcttgctctgtcgccaggctggagtgcaatggcgtgatctcggctcactgcagcttccgcctcctgggttcaagtgattctcctgcctcagcct

SEQ ID NO: 156105 - DNA, 286 bp, Homo sapiens
ctgtactcaaggaaagaaactgatggaaagactttttattcagacaaactgtccttcaaacataaaggttagagacaaacacctttttttaatttatttttatttatttatttatttatttttttgagacagagtctcagtctgtcacccaggctggagtgcagtggcatgatctcggctcaccgcaacctccacgtcccaggttcaagcaattccctgcctcagtttcccgactagttgggattacaggtgcctgccacccacgtccggctaattttttgtagtt

SEQ ID NO: 156106 - DNA, 382 bp, Homo sapiens
cagtacagattaagtccaatatttccttgttacttttctgtctgaataatttgttcaatgccaaaagtgggttgttgaagtctccagctgttattgtattggagtctgtcttctctttagctctaataatacttgctttacatgtctgggtgctttagtgttggtgcatatatatttacagttgttatatcttcttactgaattgactccatcattataaactttgtcttttattatagattttgttttgaaatctatttgtctgatatatgtatagctaatcctgctcttttttggtttccattggcatgggatatatttttccatccctttattttcagtctatatgtgcctatagatgaagtgtgtttcttgtagggaa

SEQ ID NO: 156107 - DNA, 236 bp, Homo sapiens
tcatttggtgcagaagaaaacactgaattccttggagccattattgaggcttgaaagtttggaagctctgtgttagcagcattttagggacagttcagccagaagtggatgtgttccctacagacatgaaattctagcaactgcattgtttcctaatgggatcacaggttatggactcatggagctgaaaaagtctccacaatgggagagaaactgagaggtgctgaatccagctg

SEQ ID NO: 156108 - DNA, 506 bp, Homo sapiens
tggtaactgaatgtgtattaccacatatgccaggcacaatactaagaacacgcacaccagggaaaacatttgctaagggcacttttccctaaagacacacattttagttcactctatctgcccagctctatcccgttttgcttcagggaccgctctgttatctagaatagaaacctactcaagagaggccacatcagcccccagcattcatagacacccgagaacagagggcctctttgtgtgcgcttgccttcatttctgtgcaattagagggaaactccttcaggtaaatcaaagagaaattctctgcaaacttttgcttcagaacttacatttcaattatcctattcttaaaacaggattttggcataaaggttgctgaccttggtttctaaatacaaagccttcagacttttcattgaaatgtactgactgttcaagtggcttttaaacataacattgctttaaagaaagaaaagttatctttctggtagtcttactgatca

SEQ ID NO: 156109 - DNA, 271 bp, Homo sapiens
cagattaacatttttctccaaagtggaggtggctgtttgagtgtaaaggtaatgtgctcctctaagagtcacagttaagtataaggaaacaaaaacatctgtaatcccaccacatggaacaacttgctaatatttgtgtatattcctttctgcttcatgtgtaaccatttttacatttaaatctttactcctttgggaatctcttggaagaggagatgtagagatcttaattctcaccaaaatttttctggctcttaccatttagtgaatt

SEQ ID NO: 156110 - DNA, 134 bp, Homo sapiens
cacacgcccacactacacagagtctatagtggtgaataagactgggatggtctctactggcctgcctgccttttcacttgtgggatttcagggctccttttctagagtgcaatgtcactccaatagtatttgac

SEQ ID NO: 156111 - DNA, 205 bp, Homo sapiens
gaggagggaacagctggagggagcaagagccccagatggttttaggaggcagatctctcagccctcagttgaagtacctttttactttcagataatttacaaaagtccaatgtaacgattaagaatgtaggacgtgaaatactagtcagccataaaaaggaatgaaataggccaggcgtggtggctcatatctgtaatcccaaca

SEQ ID NO: 156112 - DNA, 848 bp, Homo sapiens
gtaattcttggtgtgaggtaggtccataccacatagaattgagtgtttcattctcccactcaatgcatgaatcattaacacgtttgtatttattttcaattgctgccctaacacattaccaaaaacttagtggcttaaaacaacagaaacgtattatttttctgttctgtaggtcagaagtccaatatgactctaaccaggctaacatcaaggtatctgtaggattgcaggacttctggaggttcagtccatttcttgtctattcagattatggcagaattcagttttttggttttgtaggactgacgttcttgtttcctcactggctgtgagctgagggccattcccagcttctagaggctgccctcattccttggctcctggcttccttcctcccttttaaaagttagcagtggtggagagtccctctcacactttgaatctcccctgccccttctgttgcatctcttactgataatctagggtaatcttcctattatgaagtcctcaacctttatggctgcaaagtctcttgccactaccgtaacataaacaggtatagcaccaagaggcgaagatcatggaggcaaatttctgcctgtaacgccattttaatagactaatttaatagacattttaatggacgcgacagctagggagacattcatatcctcctctaaagcataattaggtgaaattgtttaaaagctagagaggttctaggctgggtgcggtggctcacacctgtaatcccggcactttgggaggccgaagcgggtggatcacgaggtcaggagattgagaccatcctggctaacacggtgaaaccccatctctactaaaaatac

SEQ ID NO: 156113 - DNA, 272 bp, Homo sapiens
aaactgctttatttcttataaaacgctgtcaactgaagccagtcacatgggtgcttccactactgcttgaaaatccgccagtaggcaagaaagggattgctctctcggaaaactatttgatgttagaccttatgataagtgtaggtttcaaaaaagaaaagactccaaacatgtaagaacaaaactgcaacagtggccacagacgcagtgaaagcagtttgctgcaagcagctgccaacagggtgtgagcagagctgggactgcccccatca

SEQ ID NO: 156114 - DNA, 260 bp, Homo sapiens
cgaggacactgccccgctgccctcctcacttcccagcgtctgctgtcccctccgctgctgctgcccggcaggattgctctgtgtctcatccacgtttgtccctgcagagttcctcgcctctccctggaaccgccagcctcatgccgcatctcagaggctttttttttctctcttttttttttttttgagatggagtctcactctgtcacccaggctagagtgcggtggtgcgatctcggttcagtgtaacctctgcctgt

SEQ ID NO: 156115 - DNA, 258 bp, Homo sapiens
  misc_feature (6)..(6): n is a, c, g, or t
  misc_feature (98)..(98): n is a, c, g, or t
tctttngtaaatgggggctagtggtgatgaactccctcagctttggcttgtctaggaaaagctttatctctcctacatttctgaagggtagtcttgtngggtaaagcattcttggttgactttttttttctatcagtactttcaatataccatcccactgtccccgggactgagaaagtttttccaaacaaaagcatcatgtcttgctcctcttactcgaatgaggcattcctttctcttatcccaggagggttttct

SEQ ID NO: 156116 - DNA, 491 bp, Homo sapiens
ttcagcagtttgagacctgcctgggcaacatagtgagaccttgtctttatagaaaattaaattagccaggtgtggtggcatgtgcctatagtcccagctacttgggaggctgaggcaggagaatgtcttgagccagtaggctgtagtgagcctcattacaccactgcactctggcctgggcaataaagcaagaccacatctcaaaaagtaaaaaattaaaaaataaagcaacttgctttaattcagacagtattagttgtcagaatgacttaccacaatggaagtttctcatatatttttttgccttataattttaggctgaatttattagaaaacatttaggggagctttcattctattttgtagaatagaggctacctcgaattaaaaggggaaaaattactagatctgccgcaaaatttaatttctaaaactcttctgtgtttggtaatagtgattgagggtggtggttcttgtttagaaaaaattca

SEQ ID NO: 156117 - DNA, 325 bp, Homo sapiens
atctctataagcatgatcccttaacctacttccagtttacactctaccaccctttatttttcctctctagtcccttttaggaaggcttattcatttttaactgacttcaattaattatcccaactgcaaagatggtcttcatgtcactcatctaatgagttgtctagagggagtggatgggtacaaaaacaggttctgctacttctggctaagggaatgcagttgttgacttgcattgcggctttggaactcttgtccttttcttcccaacttctacatcttctatcagttgtaccagctctactgtcttgcggtacgtgtttat

SEQ ID NO: 156118 - DNA, 545 bp, Homo sapiens
ggatgtggcctttcttctgtttcttttttcctggtggcttggaattggagatttacatctctctttctctctctctccccaccatccccctgtctttctcctcttctcccaccctacctcaggatagaaaaggccatattttctacaagcagggggcactctctttggtgccatttccatctgcccaaatgaaaaggatttttcatctcactggagaggtcaagtctgagacgcagactggagctaatctaagcaaatgggggggctcaacaagtccaacctgcactgccatttggaatcaacatctcagtagaaataaaatgttattttgctttgctgattcctgaaatgtacttacattccccttcaggaaatttgaggaaaagaacagtaatcaagggcaggatataagggttcctgtgtttcctgaacaaaataccatttttatagtctctcaaaagcacccagtctcaccaacagtcaatcttccaaccatcccgtatttcctacttccccttctctaacacacactccggctttaaccc

SEQ ID NO: 156119 - DNA, 726 bp, Homo sapiens
gtaaacataagtataaaatgtaatgttttttgaaaactattaggttggtgcaaaagtaattgatgttttgccattaaatggcaaaaccgggaaaacccacatagtttagtcccaatttgaaatgcttatttataattgctcataaacacacatgcaactctgaatcagctgtacatggcttctgaagactgccgtaagatttgacagggtaacctattctgtatagagttaaataacttggatcatttgatctattaaatgtctctgagtaccatttatgatggaatggagcactttggctgtaacactatctcatggaatagaagtgtgtttattctgcctacatgtgaaatataatactacttctgtttgctctttaaagaaatatcctaacagcatcttcttgaaagaataaagaacagcctgtgtatttttaggagttggtactctgcttgcgttttaagtatggaccattgcctttgtttttcagttagagtttttaagttttatttttgtttttaagggggtaaaacaatttattgatctcttaaatacatggatgagttttgtgattcccatttgacagattttaagatgtgaaaatggttaatgtctagaagcttagaagtgcagttggcatcacgtgttattttctgtttaagctaattctttgtttgatttatttaatagttcttatttggatattagtaaccatcaataaataaa

SEQ ID NO: 156120 - DNA, 467 bp, Homo sapiens
acggtatgggaagtcaggagcgcctctgcccagctgccctgtctgggaagtaaggagcgcctctgcctcgccgccatcccgtctgcgaagtgaggcgtgcctctgcccggcctcctcaccgtctgggaaatgagaagcgcctctgcccggccaccgtcccatctgggaagtgaggagcgcttctgcccagccaccgccctgtctggaaagtgaggagcacctctgcccagccccctcaccctttgtaagggaggagtgcctctgcccagcccctgcaccgtctgggaagtgaggagcgcctctgcccggccccctcaccatctgggaagtgaggagcgtctctgcccagccgctgtgcaaccttccacgtgtgaagtgacagccttgtgtgtgatctttctgccctccccaagtttgcattttcgacattaaagtttactttttaattaaaaaaaaggagatcgaga

SEQ ID NO: 156121 - DNA, 356 bp, Homo sapiens
gctgatggctgtaccatgaggtgtaggagaatcctgcttgtttgtaggaaacttacactgaagtgtttaggggtactggagcatcaggttggcaacttgctcacaaatggggagggagtgttcttttattgtacttccaacttgtttgtaactttaaaattgtttaaaataaaaaatactcatggggccaggtgcggtggctcatgcctgtaatcccagcaactctgggaggccaaggcaggcggatcacaaggtcaggagatcaaaaccatcctggccaacatggtgaaaccccgtctctaataaaatgcaaaaaattagccgggtgtggtggcgcatgcctgtagtcccaccta

SEQ ID NO: 156122 - DNA, 611 bp, Homo sapiens
cctctggggacactgagcagcttccctggactttaccaactaggtgtcagcagcacgtacccctgctctccatacccacaactgtgacaaaccagtgtggagtccccaaatgtcctcttcaggccaatctcacctcccccactgccttatccctacccatgtttgagaatcgcaggtctatataatagtgtttaatctagaatctcagtgataagacttttgagtggtttttgtttgtttgggttatctgcacttaattatctataatgatacatgttatttgtattaaaaggggaattaaaaagaatcttagcatcaggaaaaccttccaggtatttttgccataatgcaatttttgagttcctaaaaaccctcatactctacaaaagggcacaataaaagtaaaaagaagtcccatgggaataggtaagctggggcaggccactgagaacttatgcaaatttgtaaccaagcatcaagggaacaacagcaatattaaatgtttttaaatgaacaaattttaccacataaacactacagtaaatacagaactgcaccttttaaaaaatgcacaaggggggctaggcgcaggggctcatgactgtaatccc

SEQ ID NO: 156123 - DNA, 259 bp, Homo sapiens
tcaaggaaagttcaaccttattttattttacttaacaatttactaaagaatccaatgaggagaaaaacatacatcaatgaagaggccactattccctaaggaaaaatctgagcacacagtcagagagcctccagatgaagggctttgcacagggtacttcaagctccttcgtgatgggcacttcagtgacaggtgagagctggccagagcttgtggattacaaagtggaaggaactcctgctgtagcatagctctgaag

SEQ ID NO: 156124 - DNA, 336 bp, Homo sapiens
cctaaatattttggtttcttttgaaactattatacgtagcagcatcttaacattttacttcccaattatttgttactgttatatagaaaaataattaatttttatatactgaccttgtatattataattttatatactgaccttgtatattctttctctaattaattatacatattgtttgttgggggagaggatagtttccttaggattccttatggaaaacgcttgttttttgtgaataatgatagctttactttttaaaaaaatctatatgccatttatttttttgttacaggtgaatttttagaaaaaataaaataaaagtgatgaaataaa

SEQ ID NO: 156125 - DNA, 197 bp, Homo sapiens
tgttgggattacaggtgtgagccacaccacccggccaagagtaatttttaaaaaatgtttttccatgtatgagaagttgcttacaatatttagttttgtgctgtagcattgttttgctttttggctttgcctgtgtccttatctatttctcccataaactgtgaattcattgacaacagaactgtgttcatttctcc

SEQ ID NO: 156126 - DNA, 170 bp, Homo sapiens
attctgcattgttttcagccttgcagtgtgctaggttagtatttcttccaccgaccttgttaatcatctcatccatacagttgcttatgaatagtgttgccttccttgtcaataagagctatattaagagcaagcatccttttactgcttcttgactggttgtgttcttg

SEQ ID NO: 156127 - DNA, 324 bp, Homo sapiens
cattttaataaatatatagagatacaggtatagataaacataatcatctgtgtctttagacatatttgtatacagtataatggatagcatttatgccctgctcaccactgattctgattcttgcagttttatggtaattggaatgaaatcaataaacagtctacttcagtatattcagaactgtcattaaaactttctgtgatgatggggtgttctgtacattggacatgggatgtccaatacaatagccactgtctacttatggctattgagcacttggaagggctagtgatgctgaagaactgaatttttaatttattgggt

SEQ ID NO: 156128 - DNA, 101 bp, Homo sapiens
tctttgccattgttcacagatgtgattcccatctcatcatttctagattttgtgctgcagaatttgagagagtgctcactctaaaacctacaagttataca

SEQ ID NO: 156129 - DNA, 382 bp, Homo sapiens
agtcgtctgatggattttcctctttggtacacctatgagcgtgttttagaggagtgaagggcaggtctcatggacgggaatataaaggttagtatacaccagtccgtggtgtgctggagccagcttgcactagcttatttaaggggatcaccaagaatattaacaaattcgaaaatttattcatatttgcctttttccaaaaaggacttaatatgcttattatgaataatacaataattaaggcatgctatttatgtaggatagtatactgcaaatggggctgctaaactatactgattgacattattgagcatagtacagttgagtgtgtgtctccccagccatatataaacacaataataagaatagctaacatttggcc

SEQ ID NO: 156130 - DNA, 564 bp, Homo sapiens
ctgagcccttagttttaaccatcaccccatacctttgttttatatcctgtcaacttctgaaattttaattgttcacttattagagatatgaaactcactttgttgcaccttaatgccacctatattttctggttaaaatatatgtataccaacacacccccactattcttgtttataaatctccacccttccagagtctcgtgacgacagaattcatttcaatgaaattatttataggtggaagaaagtggaaggagacaatatgtatgaacacagtccctaccttcaaggagtttgttttctggttgggaaagacctaagtgtggaggttgacttagaacaagaaacaggatgtacctgcttaagtctaagtaggtgaacttaggtactagatactttggaacaagttaagattgttaagataaaaagagattttgctttgtgggcttgggaaccctgaagatgaaatataggatattgttactatagttgtttcactttcagatatttcaaatattaagattttttgattcagctatgtggagatggataacataattgatg

SEQ ID NO: 156131 - DNA, 213 bp, Homo sapiens
gttctctctatactcttaagtctctgatgcaggaaagatttggcccatgcacaattcttcttggcctcttaagaacagggaatctatgggatgccagagttccccatatccaatggctctataactccagggatatggccagtccaccagaaagaaaacactgcacattgaacccagctgcccacggttctctgcagccatcacgctccagag

SEQ ID NO: 156132 - DNA, 1706 bp, Homo sapiens
  misc_feature (217)..(217): n is a, c, g, or t
  misc_feature (225)..(228): n is a, c, g, or t
  misc_feature (234)..(236): n is a, c, g, or t
  misc_feature (244)..(244): n is a, c, g, or t
  misc_feature (267)..(267): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (288)..(288): n is a, c, g, or t
  misc_feature (291)..(291): n is a, c, g, or t
  misc_feature (298)..(298): n is a, c, g, or t
  misc_feature (301)..(301): n is a, c, g, or t
  misc_feature (320)..(320): n is a, c, g, or t
  misc_feature (328)..(328): n is a, c, g, or t
  misc_feature (338)..(338): n is a, c, g, or t
  misc_feature (356)..(356): n is a, c, g, or t
  misc_feature (366)..(366): n is a, c, g, or t
  misc_feature (369)..(369): n is a, c, g, or t
  misc_feature (677)..(677): n is a, c, g, or t
  misc_feature (696)..(696): n is a, c, g, or t
  misc_feature (709)..(711): n is a, c, g, or t
  misc_feature (714)..(714): n is a, c, g, or t
  misc_feature (716)..(716): n is a, c, g, or t
  misc_feature (738)..(738): n is a, c, g, or t
  misc_feature (741)..(742): n is a, c, g, or t
  misc_feature (747)..(749): n is a, c, g, or t
  misc_feature (752)..(752): n is a, c, g, or t
  misc_feature (755)..(755): n is a, c, g, or t
  misc_feature (767)..(769): n is a, c, g, or t
  misc_feature (777)..(778): n is a, c, g, or t
  misc_feature (786)..(787): n is a, c, g, or t
  misc_feature (789)..(789): n is a, c, g, or t
  misc_feature (805)..(805): n is a, c, g, or t
  misc_feature (807)..(807): n is a, c, g, or t
  misc_feature (819)..(819): n is a, c, g, or t
  misc_feature (829)..(829): n is a, c, g, or t
  misc_feature (831)..(831): n is a, c, g, or t
  misc_feature (837)..(837): n is a, c, g, or t
  misc_feature (839)..(841): n is a, c, g, or t
  misc_feature (844)..(844): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (858)..(858): n is a, c, g, or t
  misc_feature (860)..(860): n is a, c, g, or t
  misc_feature (867)..(868): n is a, c, g, or t
  misc_feature (871)..(872): n is a, c, g, or t
  misc_feature (883)..(883): n is a, c, g, or t
  misc_feature (890)..(890): n is a, c, g, or t
  misc_feature (902)..(902): n is a, c, g, or t
  misc_feature (904)..(904): n is a, c, g, or t
  misc_feature (915)..(915): n is a, c, g, or t
  misc_feature (917)..(917): n is a, c, g, or t
  misc_feature (921)..(921): n is a, c, g, or t
  misc_feature (1594)..(1594): n is a, c, g, or t
  misc_feature (1689)..(1690): n is a, c, g, or t
  misc_feature (1692)..(1698): n is a, c, g, or t
  misc_feature (1700)..(1700): n is a, c, g, or t
  misc_feature (1702)..(1702): n is a, c, g, or t
acagacgcccacagtgctaaggctggtgagggccctggagggccaggggtggctggcccctcctgatctgttctcactcctttgctgagaacctcccaggggcaggaggggacagctgaacttcagagctggggaggtgcccccaggtgactcacatgggaggcatcagctcttcccacatctcttccaacagcttgggcgttggcagtgctgggantacaggcnnnngccacnnngcccggcnttttttgtatttttagtagaganggggtttcaccntntnagccnggntggtctnganctcctgacctcgtgatccncccgcctnggcctcccanagtgctgggattacaggngtgagccacngcncccagctgggtcccagcatttgcgggattcaaggtggggatgtgcagtctgtcaggagtgttaaaagcacggcagcatttccagtccccaggcctcctctccttgcttcagccacgcccaccctcctctgtgcctgctcatgcccatgtgcttctgttgggctgtctgctggtccacaggaggattactggtgttccggattttcagcatgaacacagtatggggtctggcccgaggagggcctggctaacagagcatggattcaaaatcagagcagagctgggtaccgtggctcatgcctgtaatcncagcactttgggaggctgnggcaggtggatcnnnagntnaggagtttgagaccagcctggncannatggnnnaanccngtctctataaannnacaaaaannaaaaaaannanccaggtgtggtggcangngcctgtagtccnagctacttgngnggctgngnnnggngnatngcntgaacncnggaggtnnagnntgcagtgagcngagatcntgccactgcacncnagcctgggcgncngagngagacatttaatatttgtcaatctgatggattgaaatggtaggtcatttgggctttccctgcaagctccaccttccgggttcacgccattctcctgcctcagcctcctgagtggctgggactacaggcgcccgccaccacacccggctaattttttgtatttttagtagagacgggggtttcaccgtgtcagccaggatgatctcgatctcctgacctcgtgatctgcccgcctcggcctcccacagtgctgggattacaggctgagccactgcgcccggccgggttttctgtaatttctagtgaggttggacatctgttccagttacctactgctacgtaaaagtcgcggtcacctcaagtcagacaccattcttaaaacagttaacacaaccattttattatatctcacagcgttgtgggttaggaatctggacagtgagggcagggttaatcttcagttctgtgccaccagctgggatcacttgagggtgcttggctggcatacgggttagtctggggaccactgccccctttccggcatcctctgtgggttccagcatttttcttttttttttctttttgagatgaagtctcgctctgtcacccaggctaaagtgcatttgtgcgatctcagctcactgcaacctctgcctcctgggtttaagtgatcntcatgcctcagcctcccaagtagctgggattacaggcgtgtgccaccatgcctggctaatttttgtattttttttttgagatggagtttcactcnngnnnnnnngncngagt

SEQ ID NO: 156133 - DNA, 872 bp, Homo sapiens
  misc_feature (760)..(760): n is a, c, g, or t
  misc_feature (855)..(856): n is a, c, g, or t
  misc_feature (858)..(864): n is a, c, g, or t
  misc_feature (866)..(866): n is a, c, g, or t
  misc_feature (868)..(868): n is a, c, g, or t
tcacacttctggcctcaagcaatccgctcgccttggccccccaaagtgttgggattacaggcgtgagccactgcgcccagctgtgtcgagacatttaatatttgtcaatctgatggattgaaatggtaggtcatttgggctttccctgcaagctccaccttccgggttcacgccattctcctgcctcagcctcctgagtggctgggactacaggcgcccgccaccacacccggctaattttttgtatttttagtagagacgggggtttcaccgtgtcagccaggatgatctcgatctcctgacctcgtgatctgcccgcctcggcctcccacagtgctgggattacaggctgagccactgcgcccggccgggttttctgtaatttctagtgaggttggacatctgttccagttacctactgctacgtaaaagtcgcggtcacctcaagtcagacaccattcttaaaacagttaacacaaccattttattatatctcacagcgttgtgggttaggaatctggacagtgagggcagggttaatcttcagttctgtgccaccagctgggatcacttgagggtgcttggctggcatacgggttagtctggggaccactgccccctttccggcatcctctgtgggttccagcatttttcttttttttttctttttgagatgaagtctcgctctgtcacccaggctaaagtgcatttgtgcgatctcagctcactgcaacctctgcctcctgggtttaagtgatcntcatgcctcagcctcccaagtagctgggattacaggcgtgtgccaccatgcctggctaatttttgtattttttttttgagatggagtttcactcnngnnnnnnngncngagt

SEQ ID NO: 156134 - DNA, 523 bp, Homo sapiens
acatttttatttacaaactcttttctacccactgaaattcaatgccattagctgaccattcttaaaccaataaccagagataaatgattgcctcccagaatagtatcttcagcactactcacctactagccaactggatagtcttccttcccaccactgaattaacataaaattaatccatctactcctacacaagcactacagttgccatcaagatacttcctggttcccaatttctacccgttatctccaacacagatgattttcctgggaaattccttgttacacatcaatttactacagtaacactttcagcaagacaaagtaccttgtgcatgttaattacaaggggaaagctagtgcaaatggaaaattaaatacattttattgatctcttcattccagtccctggattttcctcttttccccactgtttttgtccctttgaactccctaatacaattttgattatattagttgaaacgctttcttgccataccttgtacgcctttgcttctgtttg

SEQ ID NO: 156135 - DNA, 255 bp, Homo sapiens
tgctaaaggagaagagtagttcaggtatctaaatcttaagctgtgtcaaatattgaaagtaactcttttaggttttaagttataatggtacagaggaaaaaaggtggaaatgtggaatttagcaaatatcaaataatagtgtttatgttcataaccagagaaataatgacaaataaagacaacttgtatctacggatacttccaaatgggcaaaactgttacaaaaaggagagcacttggtatactgtaattaca

SEQ ID NO: 156136 - DNA, 287 bp, Homo sapiens
tatttagaatatagcccctgcttttatttcagggaagaagctttgtcctgggagtaccaaatggcacaagccaggggccaggaagacagagcatgcaagaacacagcaaaatgtgccagaaccaaagtcaataggtggctctctaggacatcaggaacttggggtttcaaaactaacttattcttaataaacggcagtttatcagttggaatcttcttaggaaactagaaaaaatacaaaaatacagtaggtaaatatacctgtaacaagccaatacttaaacatca

SEQ ID NO: 156137 - DNA, 1436 bp, Homo sapiens
actgatcaagtatagttaataaaaggggctgggcggggtggctcacactggtaatcccagcactttgggaggccgatgcaggcagatcacgaggtcaggagttcgcgaccagcctggccaatatggcgaaaccccgtctctactaaaaatacaaaaattagccaggtgtggtagcacacgcctgtagtcccagctacttgggaggctgaggcaggagaatcgcttgaacctgggaggcggaggttgcagtgagccgagatcacaccactgcactccagcttgggcgacagagtgagactctgtctcaaaaaggaaatatcagagttgagaatagaaggatgtagcatggaaagtggaacagatgatgtttttgttgtcacaaataaggggagctaaaccttggcctgagcccttgtgagagggagtacagagctgaattgtgtggataacttacattttaggcagagggttgagaaatacccatttagctacatagagtaagttaaaagttcagaggtttttccgtctctggcgtccaaggtgtaatgaattccttggactgtactgagacctgcagaagaacagacaggagccagttgttcagaatcatgaaaaatcaagaaggctgtgattgaatggagtgtaaacccacatttcccttggaatgcaggtccaagataaatgtgctgcaacaaagcaaaatgtgtggcaattttcatactgaagttgaaccctgttggggagggagagtgggaagtttttagtaagtttgttaaaaaattgtatagggctgggcttggtggctcacgcctgtaatcccagccctttgggaggctgaggtgggtggattgcttgagctgaggagtcggagatcagcctgggcaacatgacaagaccctgctgtctctacttaaaaaatacaaaaaataaaaaaataaaaataacctggtgtggtggtacacgcctatggtcctagctattcgggaggctgaggtaggaggatcacttgagcccctgcaggggtggggttgcactgagccaagatcacgccactgcattccagcctgagtgacagagcgagaatctgtctcaaaaaaaaaaaaattaccacatagttcttattaatttaggctgtataaagtgttcgtcttagtgtactatcttttagtaaatgtaaaacttattcactgtaattaatctatgaccttcccagctacttatacatgtgaaggtagatgatagttttgttaccatggtttagctttaaaaaggagtgattacaaaaaaaaaattgagctgagcatggtggctcacacctgtaatcccagtgctttgggaggctgaggtgggagaatggcttgaggtcaggggtttgaggccaggctgggcaacatagtagagaccttgtctctacaaaataaaagtaaaaaaaaaat

SEQ ID NO: 156138 - DNA, 343 bp, Homo sapiens
atagtatgtagcggttacttctaatatgtgggagtccttattcaatcattgtgggcctgtcactgctgacactgctagataaattaaataaaataatactcctgcctcacagtatttagggaatagtgatttaatgaatagttaacactgagtattggctggtagaatcatggagttgtaacggattttagaaatactccaaagtcatgctcaagtcaggagccctttctttaatgctattgataaaaaatgagtggagagtggggataggaaatgtatcctaggcaaagataaagtggtagaggtatgaaagagtggtggatttaaatacacttaagcattt

SEQ ID NO: 156139 - DNA, 211 bp, Homo sapiens
gagatgcagctgggagtatgtgtgagtacagacacatctaaaaacacaaatacgcagatgaacacagattgggggatgtgggcgctcctcttcaatcagtctttgcagcctgggctcttgcctcgcagtgtgccgttctcatatgatatctgctcactgaatcacggcttgctgcccaggccctgcagccctggcccatcgtccaggcaca

SEQ ID NO: 156140 - DNA, 324 bp, Homo sapiens
gtcaggtggtgaaaatgttctgtacctctagggagatggtagttgcacaggtgtacacatttgtcaagctcaccaactatacacttaagatttgtgcacatactgtacgtaagccatatctcatttaacgcacctagcagaaaggaggctaggcagcgcttagtctgggatcagtcttagaatggagaggtgcttctggccaacagcacctaacactgcagctgggttttcagagagcgtggggtcctcacaggcagagcttcccatgaggagcacagagcaacagttcctgccaggcacacagtggggaaggcctcgccaacc

SEQ ID NO: 156141 - DNA, 208 bp, Homo sapiens
tttcaattttgcattatacattattattaatttttaaggctagttcattaaggaagttcaaaataatatgaacaaataaacatataaatatcaaatacttgttatttaactacttgaattagtacacaaagcattaataataaaaaccacaggccaggcacggtggctcacacctgtaatcccagcactttgggagaccaaggcaggt

SEQ ID NO: 156142 - DNA, 465 bp, Homo sapiens
cattttgttgggggtgcagggcatttagttttctttaccacgaaatcatggtgcaactaatgaaattatatttgtcctcacatctcgttgttctacttttccccactgcaagtcttaaccccttgaggaaaaatctgttttctttcatccgtttcataaaaggctgcaatattcagaaaggtacaaacacaaagtcatctatctgcttttcaacaaataccaaggctgtcattaggcatttgcatctcctatcagtgttaacacttggagagattaattagttatttcaggatgcaaagtacctgtatctaactacgaaaatcctgctaaagaactgagttcaccttaatagtttcaaaaataatgcattaatactgtccctcaaagcatccttcatttctcacttgccttagtcatcagcacttctccaggatgtacgtttttaatataaaaaataaggtaaaa

SEQ ID NO: 156143 - DNA, 128 bp, Homo sapiens
cataacagtgagtacaatttttctctcccatcctcagccctgccttctccttagtcccaccctcaaagttccattgcagcagaacctctctcaaactaaccaaaacagttgccttttgatccagtgtc

SEQ ID NO: 156144 - DNA, 191 bp, Homo sapiens
ggctaagattacaggtttgagcaactgcacctggcccagtgggtgatatttaaaaccataattggtgtaacatttcctgttctgttaaaatttctgaaataggattttgttgcaaaaattatggcattttggctgggcacagtggctcacgcctgtaatcccagcactttgggaggctgaggccctggatc

SEQ ID NO: 156145 - DNA, 338 bp, Homo sapiens
cagtggaagggggcggcctggctcacagccgcacagcgcgggaccagcgcagtggcagagggcacggcccctccagggtttgagtcacgtggcctcctggaaaaggcaactgtgggaacaggcctcagagcagtggctgcccggggctgtgggccagggtaggaaatccaccccaaaggggcccaaaggagtgttccgggctgtgggaacatatcttagctgtgctgctgtctacacaactgcatacactggtgaaggctacacctaacagtgaactttaccatatgtcagttgcagaccacctgatttatacacaaagaacggaggtctcggccggg

SEQ ID NO: 156146 - DNA, 602 bp, Homo sapiens
agcctcccaaagtactgggattataggcatgagccactgcacccggcccagagtcagttattcttagagcaggtgttttggcttttgtctttaatgcttccctccccactttaacataactgtaatatataattattggggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgcctgttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaa

SEQ ID NO: 156147 - DNA, 583 bp, Homo sapiens
agcctcccaaagtactgggattataggcatgagccactgcacccggcccagagtcagttattcttagagcaggtgttttggcttttgtctttaatgcttccctccccactttaacataactgtaatatataattattggggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgcctgttcatcaggctggggtctgacctctttctggtgtctggtgctgatctaggcaaggtgacaagtgctcaacagaggcctgttttagaagtttcaatagcatagtggtcaagcttgtttctcctgggcagcgctcttccgagggggtaccgagctc

SEQ ID NO: 156148 - DNA, 532 bp, Homo sapiens
ttcagggtgttacttctcattttagcggcaatacattttgcttccgtgtgatgaaacatcctacccgtttgcatgttgattgtgtctcatgtcccatctcgcaacaggcagtaaaaccccatctccagcccaaagcaccttgctaaagagcctgcaccgcagccactgtgcctttgcgctctggctcgtgcgacctctccagatcttcttcctcatttcgtctgttcactggggccctcttctccctgtgactcgcctcagccttttcactccttgctggacatggagtaggactattgggaggatgaaatagacgaatgtgtggcaagcatgtaggagagcctgtggcacagaagcagcactcggtacatggtgcttgttattacatccctactgatgggagcaagatcccatcagagtctcatgaatgatatttcttaagatttgctcctcctgaatcagtttatgtttttctaggatttcctgctgtctcaggtagtggtcatgctgcttttgatactcttttaactca

SEQ ID NO: 156149 - DNA, 393 bp, Homo sapiens
ctaccaaatcctgagtcctccacccaattaattcaaaatctgtcaaaagactgcacacatatgaacatatccatatacacacagactcacataaatatacagacacacatatagtcatccatccctcagtatctgtgggggattagttccaggacccccacagatgtcaaaatccacagatgttccagtcccttatataaaatggcataatatttgtatataaccttattcatatcctcccgtatacttttaatcatctttagtttactaataaaacctaatacaatgtgaatgccatgcaaatactatttatttatttcagacagagtctcactctgtcacctaggctggagtgcagtggtgcagtcatagctcactgtaacctccaaatcc

SEQ ID NO: 156150 - DNA, 345 bp, Homo sapiens
tgagagaatgtgcactccctggcggggatcaggggtgcacagggagcatctcatttcttggcattggagaggcgggtccaggccccagtcttccctcattattcccaaccagaggagcaggacgtggtgagtctccagggccaggcagcctctgtgttgtctggagtggggacatcatgtggcacggtgatgccaggctgcgtgtcctggccttctttccccgggacctttttttttttttttttggagacgaagtctcactctgtcgcccaagctggagttgcagtgagctgagattgcaccattgcactccagcctgggtaacaagagtgaaactccgtcaca

SEQ ID NO: 156151 - DNA, 341 bp, Homo sapiens
ggagctcctggtgtgatggaggaggcatggccctgtcctccaggacactcctgtctgatggggcaccatgacttctgtttcctgggactctctgtgtaacagaggggacacagtcctcttgttctgtaggagctgtgtgcctgaggaatgaagcatggcctccatcctgcaggagcctccaatctgatgggggatccatggccacttccctcagagagattccctatttgagagaggagccctgacctctgtcctcaggaaggacccctgtctgatggaggctcatcttgtcctctcactcaagaaaccccatttatggccttcacctttgaccccttcac

SEQ ID NO: 156152 - DNA, 299 bp, Homo sapiens
ctgactcaggtcccaatcattgcaggatgttcaaggacgggagctggtgccatgtcctaccctgactcagggagtgattcagactgagagttggctaaatctagaaggatttttggattgcattataaccttttaggtattcatcttatcctttagctaagaatagatctggaccatgaacaagcccttctgaaatcatcctcctccactagagttctgagctttctttccgtgtccaatctagacagtagggatcactgcacgttgaactttcctcgttctttcttctgcccagtttg

SEQ ID NO: 156153 - DNA, 410 bp, Homo sapiens
  misc_feature (354)..(355): n is a, c, g, or t
  misc_feature (359)..(360): n is a, c, g, or t
  misc_feature (365)..(365): n is a, c, g, or t
  misc_feature (372)..(372): n is a, c, g, or t
  misc_feature (378)..(380): n is a, c, g, or t
cagatcccggtgttccttgtctgtgaattgatttgtctattttgttttattttttgagactggatctcagtctgtcacccaggctagagtgcagtaatttaggaattaacattatgacttgaactaggaagatggtagtgcgaatgaagaggaaaggccgtgaaagatatcgttaagtgaggcaggggggtgaggacaaaagagaattagcttccaaagacaggagttctagacctgggtattctgtggggcctgaactcccagccttggttttgccatacatcaatctctctcttttttttttatctttttttttttttgtgaaatggattctggctctgtcccccaattggnnttgnnggggngcaatangggccnnnggccctttaaacctccaaggcacagttatt

SEQ ID NO: 156154 - DNA, 501 bp, Homo sapiens
tacctcaaaaagtaaaataaaatataaaatgtaatttggtcagggaaggctttactggacactgacatttgaatagagatctgaagaaagagtgaaaacaaggcatgcagatacctaatgagaaaaatggtccaggcagagggaaccattagttcagaggtcctgaggcaggtgtgtgcgtggcgtgttctaggaatatctaggcagccacggtagctccaatggggtgagaacaagggagaatagtgacagatgaggtgggaggggtcatcatgcacggctttgtatgccattgtgaagactttggctttaacattttcgtgctttgggaagacactgagggttctgagcagaggagtgaccaaactgttaaaggatcactctgttgctgtgtggagaataaactgtacagagcaaaggcaagagaccagttataaaactaatgccataatccagacaacagatgatggtggtggcagcagcggtgatgagaatggcctg

SEQ ID NO: 156155 - DNA, 520 bp, Homo sapiens
ccacctcccaacctttcccggcatggggtccttactgcgccagtctgcaaaaggaacccttccgagggtccgcttgtatcccagcccgcgttgggcagtcacccgagggtaaacccgggaccctggcctcccgccacctcgcagggcgccggccttgggatggcgtaggggttgcgtggattgggggtcgttaattttgcaaagatgacacctccttcttccttgaaagcctctttttgaatttaattcagctgggaccctcttccaaacattcaagcaggatgtcgatcctagagtccagaacggggacttccaccctctccacagaccccagcccagcgtctatgggggacccagcgcagagaggcacggaaaacgggcacctcccagcagacatggtggcacggggggacaaacgccataacagagacagtcggaagccctccagagcccagggtaggcaggaacgtgttcaaagaggaggagactccggacaggggctggcatgggagtgggggta

SEQ ID NO: 156156 - DNA, 557 bp, Homo sapiens
cgggtctggggatgctgaagctgttgggggtctgtgaccagttttgtaaatgaagaaaggtacttcagggattcaggttgaagccaacagacctttcccagatgccaagggcattgttctggccaacacccctgggcctgcctttgaggcatcttcagtagtatcagagatgctgacttggcattccagggaggtggaacctctggtcctggtgattttccttagggccttagattaaaacacacacacatgtatgcatgtacatacacatgcacatattcacatcacagatgtacacatcacacactcatgcacacatcatatatacacacacacctgcacatctatgcattgtaaaggggactccctcaattgtcaaagtttatttcaatgctagaagaaatggcaaaaaaaggacaaagatcttcaccaactgatgaatggataaacaaaatgtcgtcttcccagacgacggatgttattcagtcataaagagcaatgaatagtggacatatgcggcaacgtggatgaacctcaaaaccacatatgatatgatt

SEQ ID NO: 156157 - DNA, 219 bp, Homo sapiens
aacggagtcctatctattagttggcaaagtggtcatttgctgttggcttagatgaaaacttaccaatatcacttgtgacattcctgaagtatagaattatcttgtcaaaactttagttataaaaaagaatctttagttttctttaaaaacttttaaaaaattattttcaatctgttttagagacagggtctgtcttcctttgttgcccaagctggagtg

SEQ ID NO: 156158 - DNA, 459 bp, Homo sapiens
ttcttccaacacatttcaattagaacactcttaggatgtcgttacagctatgctctatattggagtctctgatgaaatcacatgtctaaaaatctcagcatgcttttaatcaacagaatatacacgtgttttctttttttactataaaggatataccaaacaactttttgaagactttacttcaaaaaggcacgtagttttgcaacatttttggtaagtctttaattatttcaaaatgaaaaattgaaaataaaatgcaattatttactcagcccccccaaaaaaaggcctgtatggggaatgcatgtggtgtgtgtgtgtgtgtgtgtgtaagtgtgtgatttgaagaattgaaaaaattttattggggttttgtagcatcactttgatagcatcctgtaattttgtattgtgtttgaaataaaaataaagtgaacacactgataaaagaatttgaaa

SEQ ID NO: 156159 - DNA, 256 bp, Homo sapiens
acaacatccagaataccagagagggttcctgacccaattccacaatcccgcatgttcccagagctgccctagaacaaataaaggttccagacctagaattacaggggcagaacacagagaacccctttttccattttaaacaaactaacaagcaaacaaacaggagaaagaacaattctaaagataaaagttatgacagaaataatataaaatacccaagccaaacgagagagccaagggctagtaatctctgcca

SEQ ID NO: 156160 - DNA, 198 bp, Homo sapiens
agaaaagcaaactgctactctgtgtgtggtctgcagaccagccgcattggcttcatctggttgctgattagcaattcagaacctctgatactaccccagagctattgaatcgtattaaaggttcagagtagccaggcatgatggcacacagctgacatcccagctcctcaggaggctgaggagggaggatcacttgag

SEQ ID NO: 156161 - DNA, 386 bp, Homo sapiens
gttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttg

SEQ ID NO: 156162 - DNA, 375 bp, Homo sapiens
tagctgggattacaggcatgcgccaccacatcctgctaattttgtatttttcgtagagacagggtttctccatgttggtcaggctgatcttgaactcccaacctcaagtgatccgcccatctcagcctcccaaagtactgggattccatgcgtgagccactgtgtccagcaaaaataaaatttagaaagagagagagagagagaaattaacattcctgataaaatggtaattttgtgaactgttgggcttgcttttgggcacccacccagcggataactgtcactcacaggtcaagtgacctgtaaccacagggtgtttctgtgtcgaggccaatggtagttcttgttccttccctgagtgaatcttcgaagggg

SEQ ID NO: 156163 - DNA, 566 bp, Homo sapiens
tcatgttggtaactagggtgggagtacggaatcaaaaagcatgcagtgagcctggaggagggattacagagtctaggggaggatgagtcctgaacaacacctatacagtaaagacaaagaagaagagatggattttgaaatgttgaggacaggactgcagctgatagaggttatatgtttggggtgggtatgtgtgcgagggaggcaatgtttttctttctagttctgttttcaactctagaaatctttgcacttattcccataaaaactcttaaaattttgataactatgctaggaaagaaatatatataactctgctttcctatgcctgtgacattgtcttgggggagtgattgccccccacgccagtggcatgtagtactgtatagtgttgtaccaccatcacttttatctaattccaagacatttcattaccccaaaataaaactccataaactttaagcagtcatgtcccattcccttctctccccagcccctggtaaccatcaatctactttctgtttctatggatttatctgtggggaagtgattctgacctcctcctg

SEQ ID NO: 156164 - DNA, 490 bp, Homo sapiens
gttactaaaaaccaaattcgtcaaagtttacttttaacttgttcatgacttcgtttttaaattttcatcaaataaagatataagtaggtttttttttttaagttcttcgttccatcaaactcctgacctagtgatccaccctcctcggcctcccaaagtgctgggattacaggcatgagccaccacagtttggcccccttctgttttatgtttgggtttttgagacaaggaatgaagtgggaaccaaattaggtaatttggggtaatactgtctctaaaatattagtaaaaacaaagctctatgtaaagtaataaagtcataatggccatataaatttcaaaatccacactgggcttcttatgcaaagaacacggtacaggacatctaggtcccacattcattcaaaattctggttcccagattcaaaattccaactgtttatatcaattcctacatggatggcctcccctcctcagatactgggcttcc

SEQ ID NO: 156165 - DNA, 349 bp, Homo sapiens
ctgcatgtggagacaagacaactgtgagaggaattgctaagaataactctgggctttccggtcttggtaagtggatgaaggctgaagccccattcaccaatggaagacgcgtggttttggtaggaaaaaccataagtccaatttttggacatgctgatgcctgtggattttccagatggaaaagtctgaaaggtagctggatacatgggtgaggctcaggaaagatggttgcattgataaaacagtgggcctcttatgcaaggcccagagcaggctcctccagtatctgcagtaaagccattaccttcactctctcttgacccaaccctaaccgtttaacaggagcact

SEQ ID NO: 156166 - DNA, 311 bp, Homo sapiens
aggtgggagtcggggctgggggagagagcgcgcgcgcgggcttcggcggggagaggggggccgggtcatgtgatgtacagacacccccgctacaggctggctgcaggggtgacgtcaccacccttgactgcagggggtggcacttccgctccctccccagctgctccccagcccctggcaccgccggctggagccctttcgcagtttgagtgggcagagggagagaggggttttccttctggccccagcccgactgcttctcccgccgcccggagtccccgccctgggaccggaatgggagccgcggccgc

SEQ ID NO: 156167 - DNA, 415 bp, Homo sapiens
cttgaaaccctttaccatcttgacttctatgatgacatgctgtcctggtctcctgccaccacccgaacactcactctcagcccctttacagcctctacctcccttcatggccattccatcctaagttcttttctctccaagccctctgacattgagatctcacatacacccaaagctttaaccatcacctttgtgagaatgattccaaaacctgtagctcttccttttctttcacactcaattccaaagttcagctgccttccatatgtctctccctggaggctccactctcccctcaaactcaatggcttagtaataattacagtgaaaatcaactcctgtcctgctccccaaaagaaaccactctcaagcttttctctttttagcgtctagaatgtttgcctccatatctcaa

SEQ ID NO: 156168 - DNA, 549 bp, Homo sapiens
atagaaaggtatgaaataacagaccacattctgggagtgaaagggatttgggtaaatggcagcttcagacatgcaaaggatggtcaggagaaacaactggaaaaactgaaaaaatctataaaggattttggtatgttagaatgtatcaacctgatcaatgagtaatgtagattcattagggtattttaagcatttaaagaacataatcggtcattattttagatattccaaacatctaaacatgacaaaggcaaacaagagaaacaggagttagctaggcacgatggctcatgcctgtaataccagcactttaggagaccaaggcgggcagacgcttgagctcaggagttcaagaccagcctgggcaatgcggtgaaaccccatctctactaaaaatacaaatattagccaatcgtggtggcatgcatcagtggtcccagctacctcgggaggctgaggcaggagaatcgcttgaacatgggaggcagaggttgtagtgagccgaggtcgcaccatcgcactccagcctgggaaacagagtgagactct

SEQ ID NO: 156169 - DNA, 289 bp, Homo sapiens
atctcaatctccatctcaagtctatcttaatcattgaaggagtgctctccatcttcaagatcctaaattaaacacctgtgtgtttctaatctttctcttggacctctgtttccacaatgagaacacgccagagctaaccagctggagaccacgtggcacagacatgagccatcctggctgaggccatcccggaccagctgagctgccaggtgaccacagacacacgttcaggcccagcaggtgtcagccacgcctggccaggttagcaggactgcccaactggcccgtg

SEQ ID NO: 156170 - DNA, 448 bp, Homo sapiens
ggaagtacggatgtgggaagtgcaggggacttcagatcacggggtgagggaggaggctcactgagagagaagaccagtactgtgctctgtggggccagctcatgagaccgcaaagatagtagcagctttgatgccaggctgggaattctgcctgcgctgttgggagccagtcacgtgttccacacaggtgagtggcctgttcagattctgtccctgtgtgctccatcctagtggtacctgggagttgtcatctccgtgcctctcttttttctgtccccaaatctccagttatcagtctttctattgcacctaaaaaaactgcttgcctctctccctagttgtatgtggtccctgtgtcctcatcactcatccatcaagtgacaaaactcttctcttaaccttcagccttggcctcctctggtctaccctttccatgctgccagaggga

SEQ ID NO: 156171 - DNA, 545 bp, Homo sapiens
ggagagcagagccaggttcagagaaggaaatttgggttttattctgggcataatggaaagccactgaggggttgattttaggcagaaaacagtgctgtggccagattttaatttttaagagtcacacttgctgctggttggagcacgaattggacgggacaaaaacagggataagggaacccaaataggaaggttttacacaaatccaggccagagacaatggtggcctagaccaaataaaatggacaacagatgaattcaagtgatattccggtggtataactgatggaattcatggatgaactgagtgttaagcatggggcttcactatagccacatttagcttttgcttttggttgaacagcggtgtcattttccgagatgggaaaagctggggtttaagcagaaaaatgaagagttccactttaaatatgttaaatgagatgtttgcgtgacacccactagatgtcaagagagcagctggatatgtaaagtagatttggaggaaagatctaggatggagctgcagatctggtagttgtcct

SEQ ID NO: 156172 - DNA, 200 bp, Homo sapiens
ttatgcgaaaatctccaccaggtggcgggattcccgatgaattattcttttggcccgtcggtattttctagtcaccagatccaaacagaagagaaatatgcaccagtaagggtctctgtaggcctagtgcaattgttccaaagaagtcacagaagaagacaaaggaggatgctgtggcccagtgggcggggcctgtcagg

SEQ ID NO: 156173 - DNA, 403 bp, Homo sapiens
ctaaataaattatttagtaacaaccttgcatcatagctttagattcactaatgagccaaggtagctaaagttctgagaagctttttgttttttaaagatatgcctctcctccccacccccaatacaataacaaggtaactttaaactatctatcccacctcaaatatcccccacagggacataatataccctgtatttgaggtgagatagtgttatccatagggacataataagagaaagctgtatttcgttagttttgtttttaaaagataaggagaaaattagttttagctacccttgaactttttgaaaaatggcattgaggaaaaaaaaagacactgaattgctgtgatttaatatctcccttctgtgatacctgttcacaatattagatattacttta

SEQ ID NO: 156174 - DNA, 334 bp, Homo sapiens
agatgatgaaaacaactatctttgccaatatcaacttaacaaaactgggaagaggtgggatttgtgaaactaaagaaaaaagaatgttttctggaaagagctcaaggacaaaggtaggaaaccttgtcacaaggtacaaggtgagtcttcgacaaacagaagatccttgaaaaaggtacaaacactaagttcattactccttgtctcccaaaaggatctaccttctgccacctgtttataacatatccttcacagatgacactattaacatcaattcctgctctaactttttagcaatctcccttaaatttcattgacaagtaaaacaagtggg

SEQ ID NO: 156175 - DNA, 183 bp, Homo sapiens
tattgggcacttaactgcatgatgggtaccgtcttgtttctgtgtttacttgcataatttcggacagtcttcagaaaaaacatgtaaattatcccatttacaaagattaaagaatttgcccaagggcacacagtagcaacagagtgtcaagacgtgaggccaaaccctttacagactcttaag

SEQ ID NO: 156176 - DNA, 246 bp, Homo sapiens
ggataccaagaaccaaaatatcacataaagttatcttttatagacctgtcataccaagtctcagacaactagaaacaaattttaaaatatgttacctcttcacaacaaccctcttcattcgatctaggtttattgtccttccaactcaaaccaacaagacaccatacctcatgaagtagtaattatactgccacaaatggtgacagattaatcatattctctctgaaggtccctgcaggctgcagt

SEQ ID NO: 156177 - DNA, 509 bp, Homo sapiens
agaaaaaagtgtacataaataatagagcaaagtgttggggggaagaggggatataaaggaactctgtaattactgtacagtgttagagaaataatctcttaaaaagtaaagtctgttttttaaaaatatgcaagatttgggcctcactaaatacatcttgcgtgtatgaagttgaggccttggaataagcattttggtcaggctctccagaggatctgcctgtattctgaggtttgagaattcctggatatcagtccatctcctttcaccatctgtttcattctaagaaagagcttaaaggggctttgtctagagaactgtctcttgtgtgttaggatgtgtttcatctttcagaaggtggacaaaaagcttcctgctaatgctagaaatatttgctgcaattccacactgacagttgaaccacagtaaagacaattcaggcaagaccagtttcagacacaggaactgtcaattttcgaacgtgtgcagcctttcttcagaagtgtgcc

SEQ ID NO: 156178 - DNA, 360 bp, Homo sapiens
tgtcatgctttcactgtcaacagggacattatggtattattccctatcctcctcttttatgtatggacttcaattgagtagttttaattgcttttttttttgagatggaatttcgctcttgttacccagccggggtgacagagtgagaccccacctcaaaaaagaaaaaaagactcgagaaatttggaaaatatttaaaactaaatgaaaacgaaaaatacaacttatcaaagtgggggggatgtagtaaaagcaaggctggaagagaaaccggtagcatggaatgtatatatgccaaagggagaaggatataaaatcaataatcggcttccacttcgggaaactagacaaagggaaaca

SEQ ID NO: 156179 - DNA, 516 bp, Homo sapiens
gtcatttaattgtaaaccaactagcacccacccatccaaacccagtgctagaaaagaaaaaaaaaaaaaggtgttgacggagaggtctgcagtcttcaacaccttctgtttcagcagctcctgcaaatcctgtcccttcacttttcttacctatgtagcccactagtagttaacaactgtcaggcaggcaagagtcactgtggcccagaggtcaccaatcttattaaatctctatgccgccactaggactaagtaatgcccacactgctcagagcaaggcaggggggaaaatgattgaagagacagagttagaaaagccagagcagaaatgaaaaacgaataagaagtgagtaagtggtagaaaaaccaaatacttccacacatggactgtccctacctttcatctaagaatacaacaatcagccgggcgcggtggctcacacgtgtcatcccagcactttgggaggccaaggcgggcagatcacaaggtaaagagatcgagaccatcctggccaa

SEQ ID NO: 156180 - DNA, 645 bp, Homo sapiens
cagaattatgttactaccttagttaactctagagctttgagtggcttgtttttaacagactgatgtaattttggagttctttattgataggtatatgtgaacgtttgtttatttaacctgtgtgttttgtacttcctatactggacataccattttattttccactggatttgagattcagtcttgactgaactattcactaacagttgggcaaattactttagttctctgggtttaagcctacacaccgataaaataaaatggaaaaaataacatctatctcttggggttataattaggattggagatattattaataaattgatgaattgaatacctagcacatagaaagtgttaaataactgatgattatttaaattggagaaatgttcaccatatttagaaaatattaaaacttttttaaacaatttccatctttctgataaatttgctacatttttcttcattcacctcgtgtgcttctttatttttttgcatgttctctgtttttatctacctaatttccccaagtttatctttgaacctggagttaccgtctcaccaatactatactggaagggaaagagattattccttaaaaggaaatcagtataccgttacaaagaagtaattgatgttccaaaa

SEQ ID NO: 156181 - DNA, 231 bp, Homo sapiens
caaaagccttgtcaaaagtccaaaatatactgtagaagtgttttcccagtatacataactaagcaaactctctaatgaattcctaatgaaagatttgatggcagtttattagaattttgtccgaaagggaaagatgttacaatgttaataaaattctacaaacttcacctcaggaagtgtaacttgacttctttttaaatatctctttagaaataaatgccctaagtcttg

SEQ ID NO: 156182 - DNA, 334 bp, Homo sapiens
caaaccagggacggagactgcacagctgcacagctgcaggagggttggctctgaaggttaatcaaatggatacagtgcttggtgaagtcagtctcttgacggagacagtggacagatttcagaaatggagagtaggacacagctggtctacctgatgtatcttgtaccagtttccaaaaatattgccttccctgcctatctttggagacagaagttctgctgcaatgaatgcatttctatgacatgcttttcaaatttctagagtcatcttttaggctgtaaataacctgtaatagacataacgccataagtcacgttaaattaacttaaattt

SEQ ID NO: 156183 - DNA, 413 bp, Homo sapiens
ttactcatgaataaaacatgaaaaatactcatactgatggataacactttacacaacactgaatcaactcccctttgcttgcctcctcctaaaggactggcttaatttcagtagtagaacccaaacatgaatcaatctcatgactaagcattaactatgcatccatttagcaaatgaaagtttattttagcatttgaaattctgtggttcttcaggaatatagccagataaatgatttttactaacaaatgcaactaacaccatttcatctcctctctaggaatgactgaagactcttgactatcatctattcagcacctggaagcattacctttttgtaatacgaaaagaaaaacagctgaaagaaagaaaatatacttgtcccttcaaatatagatcatataatcaaatac

SEQ ID NO: 156184 - DNA, 195 bp, Homo sapiens
agagacttctttttcttctgctcataaagatttaaagatttgagtttacagttcctggacccaccacttatttgagagaatgttgttaacacaaggatagaaaaacaagcatcttccttcaactcagaggtctatagcagtacacttccaataaaacgcgtttttgcttaagctagagttgtatttctcttctct

SEQ ID NO: 156185 - DNA, 591 bp, Homo sapiens
catgacttggatagtatcttttgtagaagataaaattcttttcatatagatgtttttattatttctgattaaaaaccaaaggcttctataaaacataatcttgtgaaaaattcctgtggaacactaaagtttatttagatttgtaattttgtatgaatcattgcttgatacagtaatagaaaaaaagtccagagtaatagataattggcaatcctttgaatatctttaaaatactcagttgtttcaagtgggtttttgacagcatctatatataattcaattaaaatttgagttatctggccagtgtctggagtgtgtaagtatttgactgaaaagataccaaggtaaaactgacctttagttacatgaaataaataaagggtttgacttatttattctgtctagattagaaccactgtatctccctactccaaaatgtactgtggaaggtatgggcataaccagaaagtttttcagaaaggatctctgggtctctggaaatgcccagattttggttaaataccgatttctttttaatagaatggaaagaggcagttttaaaaacagaagatttaaaggccgttcttgtca

SEQ ID NO: 156186 - DNA, 598 bp, Homo sapiens
aatcaatagcgatgccactttattactactactagtgtagggctattaatactactttagcgctactattactttgtcagtgctaattactactttatctgtagcagtattaatttgaggtaattacatacaacctctttacttcctttccaacaagctcgtaagtacattcattgcacatatttttgagtcccaatcattctcccagtagtgtgctggaagctgtgttcagggagtttgaggctctcatccaaggtgtttcagtggcagccctgttcagtgttgtcctatagaaacccagtgcagtgatcctgaagagtttagctttacattttaaaattttcattcaatgcaaatcaaaccaaagtgattacttttggcagactgacaatctgttttaccaaatctatgtaatgcattttgaaggtctgtttagagtctatgataacaaattgctaattatttccagagattttcaatgaattctgaagtctgtcaagtgtggtgattatagtactctgaaattgcttcaaaaccatgaatattgaatactcctacttacaagatgacctgtatcatcaataactgagttaccata

SEQ ID NO: 156187 - DNA, 309 bp, Homo sapiens
ccccactatatacaggacactccaagatgcttacgaattcatttaattatttttaatggtcacaaccatcttgaaatgtaggcattattgtccaagatgataaaagcaaaactcagagaagttcaacaacctgtctgaggtgacacagccaataagcgtggctaaacctagattctatcccaggtttacctgacctcatacctgcattagtatatcattatgcctttggccatctcattataaaattaacttcctttgtatttctctgttcaatcaaaaggtaagaacaatgaaagacaaagggaaaca

SEQ ID NO: 156188 - DNA, 170 bp, Homo sapiens
caccccctcaccactttgttcagtgacttcatccaccaaatattctatttcatcactcttaagttctcccacaaaacactaggacataagaaagaaaagaagcttttatttttatttctttctttcttttactttatttatttattttgagacagagtttcgctcttgtt

SEQ ID NO: 156189 - DNA, 390 bp, Homo sapiens
caggctggactcaaactcctggactcaagtgattttctcacctcagcttcccaaagtgctgggaattacaggcatgagacatgagacactgtgcccagccttgttttatatttttaatctaatatttaaatctttgatccattttgagttaatttttgtatatgatgtgaagggcaccacttcattattttgcatgtcactatcagctgtcccagcaccatttgtctaaaagataattctttctcgattgaaagaatggtctttacactttttgaagacaactcaccatagatttacaggttcaagcgattctgctgcctcagcctcccaagtagctgggattacaggagcatgccaccatgtccagctaatttttgtatttttagtaga

SEQ ID NO: 156190 - DNA, 436 bp, Homo sapiens
ctggtacgatttaaaatggtgggcatggatttcatcccccttcatctctgaagacactttagatgggaagctgaaacacccatctgccttctccaagtgttcaaacccctgactccttctccgagttgagactctcattggcctggctgacattggactatacccatagatttgtcatttttctaattttcctgctcctctcatggaactagaagaagttctgaggatgtctctatatcaccagagggcttcaaagaaataagaagtggtgggaagcatttcccatcttcttttcagtcacgttacaccaattttctttctagctctcttttctggggggtcttcctggttctgctcctctattcccagactctcactccccatcttgcgtttttgctacggttggaggcgctctcctggtagcccctcagagaca

SEQ ID NO: 156191 - DNA, 252 bp, Homo sapiens
ctcagtgccctccctggaggattaagtccaaaccccttagcttaacactggaagcctatcttagaatattactccctgtctgcttcccaccaactcccacgcctgatatatattttaaaaaccaaatactctatcctttgagcaagctgaccttatgaacccctaaaaactacatgtgaaaatttttgcttgtgtgcatttttaccagggatgaggtccaatgctttctctgtttctgagaagatctatttt

SEQ ID NO: 156192 - DNA, 961 bp, Homo sapiens
gaaggcagcagtgccctggcctggccacccgcgaacccctctgtccaccccatgctgcgtggcacagggcaggcgtggggcctctagctggagccttgagtgggtggatcctcggtggggctttaaggccaacctgtttatgaaaatgcatggggactgactgcagatgcacagacaactcagatgcacagacgcccggacgacgtggacacccagacgatgtggacgcacagacgacatggacgcacagacgatgtggatgcacggacgacgtagacacacggatgactcatccacagatgactcagatgcacggacacccagacgacgcggacgcacagacgacgcggacgcacagatgacgtggacgcacagatgacgtggacgcacggacgacgtggatgcatggacgacgtggacgcacagatgacctggacgcacggacgacgtggacgcacggatgactcagatccccagacgactcagatgcacggacacccagatgacatggatgcacggacgactcagatccacagatgactcaaacgcacagatgactgggatgctcagatgaccgctgctgtgctgccaccccagggctctctgggcgtttcctgtggtttgggcaccaggagcctgggagtcccatgctgcccccagggcactacctcctgggcccagccctgcatccggtggcagggctcaccgtcatcaccccaacagtgcagggtggtctcagggacctcctctcatcattgccaagaactggctccaggatgtttccatgtggccggctagtatggccaaagtggaccctggcgtgctgtccccttggacgcctccaggccctgcccagcacgtggggctcgtccatcctgtgcctgaccatgctctgccatgcggggcctagcccagccccccagccctgctgcttctccccaccccacccccgccacctcca

SEQ ID NO: 156193 - DNA, 591 bp, Homo sapiens
  misc_feature (1)..(1): n is a, c, g, or t
ncagcacactttattaaggacctgtagctgtgcaggatgcaaacatctgggcatcagtgactttcctcctgcccccgttgtccctgatggtggcagaagatcccagctgaccacagcccctttccctggggtcagagggagaagacaggcgcagtcagcaggggatccaaactgaatggtgatagagacatggctcccaaagtactgttctcctcattctaccgccactggctcaggtcaagccccactcctggcctggatcattacaattgtcttctagttgctgtctttctgctcagtcccaaccctccaagccatcctgttattctgaaattcacatctggtcattcttcccagcctaaggcctgatccactgctccccatgtcctatgggaaagtccccattctctaggtggcactggaggcccttcaggatctgtctctaatgtcccttccacactcctttcccagctgtccccaccacactgctgttgtctgctgcagcagacaacagcagtaactcttgtgttcaccaggacccagaacctttggaagggataggctcgttggtgacattgtgacttcagattt

SEQ ID NO: 156194 - DNA, 590 bp, Homo sapiens
  misc_feature (1)..(1): n is a, c, g, or t
ncagcacactttattaaggacctgtagctgtgcaggatgcaaacatctgggcatcagtgactttcctcctgcccccgttgtccctgatggtggcagaagatcccagctgaccacagcccctttccctggggtcagagggagaagacaggcgcagtcagcaggggatccaaactgaatggtgatagagacatggctcccaaagtactgttctcctcattctaccgccactggctcaggtcaagccccactcctggcctggatcattacaattgtcttctagttgctgtctttctgctcagtcccaaccctccaagccatcctgttattctgaaattcacatctggtcattcttcccagcctaaggcctgatccactgctccccatgtcctatgggaaagtccccattctctaggtggcactggaggcccttcaggatctgtctctaatgtcccttccacactcctttcccagctgtccccaccacactgctaacaacctggctgcattgacttttttggatcttcctcaacagtctttgtacttttcacgcctctgtgcctttgctcaagccgatctctttagctggaatg

SEQ ID NO: 156195 - DNA, 381 bp, Homo sapiens
caatatttgcttacattatagcatctaatataagatgttatttgctcattgtttattatgtactccatgctctcacaagaagcttagctttgatttttttcttaattttggtggcttaaatttgaaaatttaactttgcattaaaggagggtttttatttaattaaagaatgtattctggagcttgattacaaattaaaatccaacatttgcttaacgtggatgggtttacaattataggaaaaactttttgcacttcatgatttagtggctgtttaactttgtactcaatatagtaattaatatatgttgctgcatttaattttctgtttaattttttaaaataaaaaggtaaaggatgtttgctgcttttaaggagatt

SEQ ID NO: 156196 - DNA, 321 bp, Homo sapiens
gtggatttttgtatttttagtagagatggggtttcaccatgttggccaggctggtgttgaagttctgacctcaagcaatccttacccacttggacctcccaaagtgctgggcttacaggtgtgagccaccatgcctggccaagtagacaaatcttaaatgagattttcaacaaccttttacaaatgtacacactcagatgaattcatagagcattttcatcatccatgttctctctccgtcctttcccccactccaaatgtagtcactatttaactttgagttctaaagattaattttgtatatgcatatgaatgaccctg

SEQ ID NO: 156197 - DNA, 392 bp, Homo sapiens
tatatttttagtagagacagggtttcaccgtgttagccaggatggtctcaatctcctgaccttgtgatctgcccgccttggcctcccaaagtgctgggattacaggtgtgagccaccatgcccgggccatatatattctaataccatcactttggagcttaggatttcaacataggaatttccacagggacagcaacattcagaccatagcaaaggcctcctggaggctgctgcctcaacttcatcaaaactgccgctaaagcctcctggaggctgctgcctcaactgcatcttcagcagtctagggtgtgtcagctcagggataacagaaggctgcctttcaaagttgtgtctcaataagaaggtcaccggttgtggcttgtagaaagttt

SEQ ID NO: 156198 - DNA, 531 bp, Homo sapiens
cgcctgtccttcccctacttcaggtggaggttaacgtcagctcctccatggagcctgccctgactctgaccggacaacttaaccacacagcaccacgccccagccctccagacactgaccctgctaggcctgttcccacagcacttcataatcttgaatacacaattcatgtccttctttattatgtctgctgttccttatctgtctaacccagctgtaacctaagctctagcatggaaatctgtcctttttcttcctttctgcatccccaacatctacagcaatgccaggcacagagtagacacccaacaaatatatcctggaaaaatgaatgggttacaatttagtgggagaagagagacatatggtatactaggaagataagccctatcgagaaaaaataactcaggaaggggaatggaagaaagggaggctgtggggatgtgtcaggaagctgaggagtgtagatctggttacttttgggcaagttacttctctaagcttcagtttcctcatctataaaatggtttg

SEQ ID NO: 156199 - DNA, 315 bp, Homo sapiens
gatgagctccagaggccaggtccggggtcccctgcccagccctggagtgtgagggtctgagtgtgtgagtgtgtgtgtgtgcaggagagtgcctgtgtgtctgagtgtgtgagtgtgtgtgtgtgcaggagagtgcctgtgtgtctgagtgtgtgtgtgtgcaggagagtgcctgtgtgtctgagtgtgagtgtgtgtgtgtgcaggagagtgcctgtgtgtctgagtgtgtgagtgtgtgtgtgcaggagagtgcctgtgtgtctgagtgtgagtgtgtgtatgcaggagagtgcctgtgtctgagtgagtgtg

SEQ ID NO: 156200 - DNA, 317 bp, Homo sapiens
cacagcaaaggtttgttatgtaaacattatactttattatcagcctttgttttccaatacaatgctttaaaaatatcctctgttgtataaaggacattgttgcaaaaaggcagctcaaaacttgtccttcccttcctttcattgatctgttgcctcttaggcaatatgaacagctgtctccagctcacccacaagcaagctgaacataataataaggtagtgttactggcctgaatctatgaatgattatacaaagggtgccagctcttttccattaaagataaggtaacaaagataccatagagaagaaaactggt

SEQ ID NO: 156201 - DNA, 193 bp, Homo sapiens
aatgaatatgagatcaacagcagaactatagaaaaacagctggttaagagtaaaagtctaatccatctggccaaaaaacagatacaaaaacagccccacacaactgtgagacctcaacaacattaaccttcacagtgcaatagtttaatggttctctaaatctaactctagagacagaaaacaaatatccttc

SEQ ID NO: 156202 - DNA, 167 bp, Homo sapiens
ttgtgatccgcccacctcggacccccaaagtgctgggattacaggcgtgagccaccgcacccaacctttcttttctaaactttccaaattctcttagtgaaaagccttcagggtgattatattgcttttagcttctgtattcacttcagatgttccactttgcatag

SEQ ID NO: 156203 - DNA, 686 bp, Homo sapiens
aatacagaataacctacgagattgagaattcttgtagattccaatttatttcctaaagatttagaaacaccacctaagagattgatttgacccaaaggctgggattaaggacccacaggtagaaaaataagcatctgagtagggacaccctttcttctttccttattttgggggaaggatttcaggatgggtagaaatacagatgcatttgaaaatctagagaatagtctcagttttctttccaaaggagtacactcacacttcttaattgtgatgggcaaagggcagggctgagataccagaggtaggttgttatggtttggaacagctgaccagggatgagcctaaggagatactgtccagttgaaggctcagctgaagttatcagggaaattctgaaaggctcattaggaaccttttgtagaccttggtgcttttttgccactgtactctttccaagtagttaaccgaataccagtcaacttagaaaataaattcaacacattttactgttaatttggcttatatttattgttttaagaataactgattttttaaaaaatgatgaaatacaaacttctgccatttatctcatcatttttcgcaatctgtgattttcttttcctttgtgagggaatgctgggaatacatcagtagttgcccagttctgactgtttataacaaac

SEQ ID NO: 156204 - DNA, 168 bp, Homo sapiens
agtactgctttctacatgtgctatcacactggaaaaaacccaaccattgcatctttcattaaaaaagaaaaggtaaaggaattgttagagtgggcctgtgtgaatcctatcatcctgatctcagaaatccaggggtcaagagttggcaaatatttccagtaactcatg

SEQ ID NO: 156205 - DNA, 504 bp, Homo sapiens
aaactaaaacgagtttaacactcagtcaatgtagaagttccagaaaagattaatgtattatatcaagagttgtcagtgcatgtttcagttacatgtagaatgcatgtttgtctttcacaaaaaaaaaaacaacaacaataaatgacaagatcaaagttttaagtaagccagcatttagctaatatatgaagtactctgggatactataatcaaatacaaaagacttacataaatacaaaacttaaatatacaacataaacataatacataaacagaaaggtttaaatatgacataagaacagcctactttatacttaaacagtgaccagacccatcaaagagtcattttcttacaatttttgtgactccattttgttgtcgttaactgtaacacggctgcaaagaacagtgtctgaaagcaatattagttaagctaagtatctactcattcttccatcttcatccccatttaagatccaaggatgccagagcaagcaagatgga

SEQ ID NO: 156206 - DNA, 1143 bp, Homo sapiens
gggaggccgaggcaggcagatcacctgaggccaggagttcaagatcagcctggccaacctagtgaaaccccatctctgctaaaaagaccaaaaaaaaattagctgggcatggtggcaggcacctgcagtcccagctacttgggacactgaggcaggaaaaccgcttgaaccttgggaggcggagtttgcagccgagatcacgccactgcactccagcctgggcaacagagtgaaattctatctcaaaaacaagcaaacaaaaataggcaacaaggcaggatgcttaggatgtaacactaagcaaaagaggaaaaattgattgtgctttgcttacaactgtgttgcaaacgtaatcactggggacaaacaagggtagagcaaaacagtagcagtgttaggcaaaatgatttgcgttttttattttctaaatcagttatgatgcacttctaatactttggtaatgaagaaaaaaatatgatttgtccagcacaaactgggcatgaccagacttgacagcagtctgtggcgtagctatccagagagtttggttgacgccaagctcaggctgagatgacagcatggcgtggcgcctaaggaattggcacggtgcccagctgggtttgcagtggccttagaaaacaccatagaagcctccatgcagcactcacagccagaggctgggtggcactgcaggggttgggggccttggatgagcacagcatcattgctgtttgtttcacagagcagaacacaggctcagcaaggctcatccacctccccaaggtcacacagccttgggctggaaaacatgtttcccatgcagggttccttcccaggcaccccagtcaaacctgatgaattaagaaaattctggctgggtgtggtggctcacacttataatcccagcactttgggaggccgaggcgggatcacctgagatcaggagttcgagaccagcctgcccaacatggcgaaactccgtctccactaaaaatacaaaattagctgggcatggtggtgcgcacctgttatcccagctatttgggaggctgaagcaggagaatcacttgaacccaggaggcagaggttgcagtgagccaagatcgcaccattgcacttcagcctgggtgacaagagcgaaac

SEQ ID NO: 156207 - DNA, 331 bp, Homo sapiens
tgtcattgctttggcagtggaaacgcacgtggcctctaaagagtgggtcccaaggtcatgaaggcctgtggggtggagggcaaggtatctctttccaggctggaatggcagaagacgcggcggcagaggggctgcatgtcctcctcacagcaggcccctgaggacctttatcctcctgagccatgaatgtccctcaggagtgtctaaagcacccggtggggcagggggacccctataggccttaggagctctggccaattagtggtcagtaaaacgcagaggtgaacaccatagaaccacaggtccaggagaattttgtaaaagctctgag

SEQ ID NO: 156208 - DNA, 156 bp, Homo sapiens
gttctaggtaggaaaaggcagcagctaaggctcatgataagggaactggctttagaatagggttactctcctctccttgtcctccccagatttggacctaaggaggcagagctatggctagggaggcctacgagaacacagagaaatgggttcaag

SEQ ID NO: 156209 - DNA, 142 bp, Homo sapiens
ccttagcagcacctgttctccatcttctttgcaactgacctaatttctcatccacggtatagccctttgtattgctccactggattgataagcaatcctgcctttcctgacctctgaccttaacatctttccaggtatcatg

SEQ ID NO: 156210 - DNA, 141 bp, Homo sapiens
tgacaggcgcccaggtcctgaagtctctggttgccactgaggctttaccacctcagttgattctggtatactggtggtctttgccaccatgaataatgttgcagagcatacctttgcacataaagccttttcctcatgatg

SEQ ID NO: 156211 - DNA, 447 bp, Homo sapiens
aattatgggagctacaattcaaggtgagatttgggtggggacacagccaaaccatatcacccacttagtgggtggatttagttcttactgccattaccacaaacttggtggctgaaaacaacatttattcttgcacagtcctggaggccagagtctgaaatcagtatcatgaggtcaacatcagggtgccagcagggctgtgctccctccggaggggaaagccattcccttcttccagtttctgggggctgctggcattccttggccttctcctcttctgcttccctattataaggacccttgtgatgcattaggtccacctggatattccagaataagcctcccatttcaagctccttaatcacacctgcaaagtctgttctgccatataaagtgacatgcacaggctccagatattagggcctggacatctttgggggccattta

SEQ ID NO: 156212 - DNA, 481 bp, Homo sapiens
acggtttgagactgaagttaagtctgatcttccaactttcctagtttaaagtttacccctttagaaacgttgtttaagggtgaaatggagaccaggtaatataaaagcagtcaaggaacttgttgcaagaactttttttgagatgagaggacgactcatcataaaaacttggaactaaacgaaaaagatagcccggctctagtttaagctataagacccttctacacagtctgtcagtacactcagtacagtaatgtctctcaaagaatttattctagcagaatcattaaagatatgcagagactttattaaaatgatgaaaactgagaaggaacctaaatatccaacagtagaaatgggtcgcgtaaacttcggtatatccatatatgggaatgttacattgcattgtcctgtaaaaccatgttgcagatgtgtttattggcaaataatgttcatgacgtactgactcatagaaaactct

SEQ ID NO: 156213 - DNA, 402 bp, Homo sapiens
attctgcttcttttctaaaacatctgtaataagaattttcaagatacatataaatttagtaagcagtagtggaaagaaatatgagaggaggtgtttttaaaagccttaaaatcggggccgggtacagtggcccacccctgtaattccagcactttgggaggctgagggggtatggtcgcttgagcccaggagtccaagaccagcctgggcaacatggcaagaccctgtttttacaaaaaataaaaaaattagccaggtgtagtggagcacgcctgtagtcccagctactcaggaggccgaagcaggaggatcacatgagcccagaaggttgaggctgcagcgagctgtgtgcgcaccactgcattccagcctggtaacagaaagagattctgtctcaaaaag

SEQ ID NO: 156214 - DNA, 407 bp, Homo sapiens
ttttcttttctccttccttcattacagtgtaagttctgaatgatgaatgcaaaaacaattgcctatattatgcagacttgggaataatatttgccacacagtaggcactcagcaagtgtttgttaaataaatgaattaataaactttatacttggactcttaaacgtctttattcccctactttgctccaaagagttacttataaaagcctctaaaagtaacctctcattccagttgcatgaagtcctattgaaccaaaggacattcctctaaggctagtttatttgtctattccttcccattctttccatgtctaattttagtaaagttggtaagtcagttattatatatcatttcattctactttccaagaaaacaaacagatgttttatctaatcctgtgggag

SEQ ID NO: 156215 - DNA, 459 bp, Homo sapiens
ggcccattgtccataactgtgtaaaatcagctcaatgcctgtgtagccccattatgtctgcccataatatttaggaaagtgagtcttttagcctcattcacatacagagtccatctcacatcagcacctgcgcgtccccgtcacgcttgtgacctcgaaggccctgaggatgattcctgtgacggtttttcagccactactgtacgtgggttactagtgctttgtcatctagaatggggttcgtaaccgagggggacgctgccggtgcatgatcatgacaagcctaagagtgagaggatgcttttcactgagtggggggcccgtgctgggccctgagtgctggcgtgtatcgtctctcctcatgcggcccctggaggacgcaccgtggggccgactggctttcccggttgtgctgctgatacgtggctgaaccaggatctgtgctctggccctgaagct

SEQ ID NO: 156216 - DNA, 349 bp, Homo sapiens
agagcacagaaataaacccttacataaaaggccaaatgatttttcacaagaatgccaagactacacagtggggaaaggacagtctcttcaacaaatggtgctgggaaaactggataacaagcaaaagaatgaagttggactctcatgccacatacaaaaattaacatagattaaagacctaaaagtaatacctaaaactctgaaactcctagaaggaaacataaaggaaaacctttgagacactggatttggcaatgatttcatggatatggcaccaaaatcacaggcaacaaaagcaaaaatagacaaacaggacaccaaacttaagaatttctgtgcaccaaagaaa

SEQ ID NO: 156217 - DNA, 637 bp, Homo sapiens
caagtaacaaagccagcccaaattctaggggagatgaattagactccaccttttaaggagacaagtggcaaaatcaccttgcaaagagttgtgggattggagatactgatgcagccatatttggaaaccatctagtacactccacctcctacctaaaataattcgcattcctctcacatgtaaactgcactaatcatcaaccgcctccacgggcacatcctattatggcatctgctcaaagtccagggtctagtcatctcagtcagctgctagtgtagtgggatgcggttccccatgtttctgtgtgtgctcagatgtgccttctctccatctggaaaccagtgaactaaaaagacaagttatctgcccccaacacactcaacacacaatgatgaggcaaggacaggaaaagttctgcagacaaatgattatatactgtgcacaactggggccctgaagagagaagagaataaccaaggggaaaaaatggggaggtactgcccccaggaagatggattaggagtccatgcagtcttctggcaagggatcatcatgaaaccaccactgtttcctgagcgtttgctcctgtcaggcactgtttggaacattctccaacatgctttctcatttgaccttc

SEQ ID NO: 156218 - DNA, 426 bp, Homo sapiens
ctctattgtggtttccaacgctgggcaggcttaggactgaataattaaagtggattctggggcatgggctgtccctagttgtctggtgcgtggccctggagagattagggcaggtggagtataagagcagattaaggagggagttgagggggttgggattagttgacttgcatttgaaaagcgtgctttcagaagagttatttactatcatggctgggtgaggtggctcaagcttgtaatcccagcactttgagagcccgaagtaggtggaccatttgacgtcaggagaccgaaattatcttggccaacatggtgaaatcccatttctactaaaaatacaaaaagaattagctgggcctggtggcgcatgcctgtaatcccaggtacttgggaggctgaggcaggaaaatcgcttgaacccgggag

SEQ ID NO: 156219 - DNA, 760 bp, Homo sapiens
cagtgattagatctgggatgaacacagcctatagccagatgattggagccaacaaggccttagttggaacatttgggaaagagaaatcccatgcagggagacagcctgcccatgatgaagccagtggagggcagaagaggtaagaatgagggacaggacaagtctggaggacactattggagctcctgggtccagccctgcctgatgctcgagcacctggaacttttccataaattctccttctcccttgagccattctgtgcaagcttgcacagtcacactcaagcgtcccaactaacacactgatcacataatgtgagattctcagggttctctggaaagcctcttcccattgtcttctgtggcactaatttattttattcacccctgaggttaaacacagggtgaattcactgactttcacctcattaaccccacaactgtctccttggcacctaactaactagtttcctattgctgttatagtgaattgccacaatgccagcggctcagattaatgcaaatgtattaccttatggttctggagatgagaagtctggtttgtgcctcactgggctaaaatgaaggtgtcagcatggctatgttccttttggaggctccaagggagaatccattccttgccttttccagcttctagaggctgccccaaacatttggcttatggcttcttcctctatcagctgctcctatcattacatctcctctgaccctccagcctccctctcctaagggcccctgt

SEQ ID NO: 156220 - DNA, 583 bp, Homo sapiens
ggaggtggaggctgcagtgagccatgattgcaccactgcactatagcctgggtgacagagtgagatcctgtatcaaacaaaaacaaaatattgggctggaattgaaaagttgccacatgcaatcttttgtatgtcaattaatctttctcgaccttacgttttttttggctgtatgatatgagaagacccaacacagctcctagtacagaataagagagtaaataaatgttaatttccttcctcctatagtaggtgtgtgctttaaaatttaactagatttccaatttcaatcttatttgggccaaatctcctgctgaaaactacaagtgctaaataaaatgcagcacatatctccctaaaagcaacatcagctgacaagaaaataaggaactaccatgcaaatacatggaaattaaacaacatgctcctgaatgacttttgggtaaatagtgaagttaaggcagaaatcaagaaattatttgaaactaatgagaacaaagatacaacataccagaatctctggggacactgattaggcagtctaagagggaaattatagcatataatgcccattaaaaagttg

SEQ ID NO: 156221 - DNA, 539 bp, Homo sapiens
cttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtacttttttatctggttatacagaaatctggaaacagtcactcccagcctcacaattaaaaaaacttggatatacagaaagttcatagttttccttgaactcattatagtgctgagatttcacggcaaccaactggcccagatactccagagtcaaagacactgtaaggagagttgacatttgagcattagacaagacacagatggtaagagttaagctagggtgattggtgaattgctggaggccaggtgtacactgacagaactgtgtgaaactcctgggggccgcagtataacacagggtgagtctgtgttctcttgtatacttttttactccgtgaatcccatggggtgctcagaagctcctgaaaaggtctcgctgt

SEQ ID NO: 156222 - DNA, 233 bp, Homo sapiens
tccatctctagagggagtcaagtccaaaacaaagaccggcaatctgtctcctctctcagaccccagaaacaggagggagaatggagctaaccagacagtgacttccttcactcacctggcactcgatgggcaggaggcaagatagcaagaccccaaagcctgcctcagctagcctctgagctccaggtctctgagccccagcacagcctataccctccctcaggggctctctg

SEQ ID NO: 156223 - DNA, 434 bp, Homo sapiens
tggaagagcctagactggtcagaggtgggtgaatatgtccagacacaaagaaaaacctgggcacaggagatctatgagaggagagacggccgtgcaggatctggaagggagaagagtgggcctcagtctccctctctcctcagccagagtcagctctgctccagctcaggcacccttcaccaggagccaggcccagggctctgctcttgtactgtgtggtcacagcactcactaggtcagtccgggagggtctgcaggctggaatcacagggccgtgaaaacaaagtgctggtgaagcgggcatggggagggagcctggcctccctctgcaggagacaggctgtctgccaagcccggcacgctcttcatttgttcacctgcccatctgcccatccatccacccacccatccatctactcctggagtagatgccg

SEQ ID NO: 156224 - DNA, 413 bp, Homo sapiens
gaaaccctgtgtctactaaaaataaaaaacaattagccaggcatggtggcaggtgcctgtaatcccagctacttagaaggctgaggcaggagaatcgcttgaacccaggaggcagaggttgcagtgagccaggatcgcgccattgcactccagcctgggcaacaaactgcattaaaaaaagaaagaaagaaaagaaatgaggaacaatgtaggaaactggtgtaaaggccatcctgttataaagtagcaaagaccttggctgaattttgtccatgttctagggctttatggaatgcagaacttaagagtgatgaagtagggtatctggtggaagaaatctctaagcatcaaagtattcaggctgccacacagctacttttaaccacatacagtgagatgtgagaagaaataag

SEQ ID NO: 156225 - DNA, 682 bp, Homo sapiens
agcccagctaattttttgtatttttagtagagaaggggtttcaccatcttggccaggctggtcttgaactcctgacctcgtgatccactcgcctctgcctcccaaagtgctgggattacagtcttaagccaccatgcccccgccgtgtctttaatatatggaagttcctacatggtagaatttatccaacctgttatttaatgacccctaggtttcatattatagaagatttctttaccctgagcttatgaaaatgattccccatgttttcatctagtacttagggtttcattttttcatatttatatttttgatctctggaacttagttatgtacaaagggataatgtagggactcaacttattttccagaaagcccaaccagctatcccagactcttacctgtttttgaggatatctacagaagaagtcttctgtaagactgttaaaaagagttaggacttagggaatttgaagaattacagcaaatcagggtcagattaggtgagaatcaatttataaatttattaatcagtattatatattctgaatatttttgcaacctttggtataattagtattaatgagatacacattgaaggagagtttttccacaaacctatgttgggtttgtgttagatcaggaagctagaaatgcctttttttgtgtgtgcttttttttt

SEQ ID NO: 156226 - DNA, 282 bp, Homo sapiens
actccccctgccttttgatgacacaggttctgcataaggtgagagggaggacagggtgacatccatttcttgtaaaaatgcctcaatgagaaaagggccacatgcatttcttgtaaaaatgcatcagtgagaaaaacaacagcagcagcaacaacagcaaatatttactgaatctcctagtatgatccaagcccccaaatcaagaaaatgtgaatgctgatgtaaaaaaggaaggtatttgttcaaactgcctggccagtgtttttgaagaaaacagagatc

SEQ ID NO: 156227 - DNA, 337 bp, Homo sapiens
tcgtctcactcctgggctgccgagttcctggagtgggcgccatgctcttccttctttctccactcaaaccaacctgggctcatcttcaggatctcactcttctctccaggcctcagttttcttatctttaaaattagaagggctatctgggctggcacaggcgaagccctctcttgccttggccacctcccacaccagaatagtcaccatggcccatcagtgacctcacagccacctcccatgccaggacagataccaccagcctgtcagcgaccccacggccacctcctatgccaggacagagaccaccagcccatcaatggcccaacagccacct

SEQ ID NO: 156228 - DNA, 544 bp, Homo sapiens
ctcaaataatacacattgtacccattaagtaatgctgtaatctttattagtttcttcctgccacttggtttaggtttaatttgctcttatttttccagtatcttaaggtggaaagttgggttattgatttgagatctttctcattattattttaatacaggcaattatagctctaaatttctgtctaagcactcctttagctgcattccatatgttctggttatgttatatcttcatctccattaatttcgaactatttcctaattccccatgtaatttttctttgattaattggttatataggaatgcgttgttaaatttccacataatttctagtttttcatgttccttttcattattggtttccaatttcatcctgtagttctcagaatcaaatttaaatttaattcctttaagatttattggggtttatttggggaggggggctagaatatggttattcctggagaatatttatgtgcacatgagaaggatatataatttgatgttgatgattgcatgttctatagatgtttgttaggac

SEQ ID NO: 156229 - DNA, 658 bp, Homo sapiens
tagacttcgtaagctgtaagtcccagagaaagcataggtgaacagggagatagctcctatggggtgaaagggactaaaagtgcttctcaagacacggactaaagccagcttcacaaccctacatcaaagaggagctctagaaaagaagctaaacaaaaactgctgcccagcactaactagcttatttggaacagcagacctaacgagggagaaggacacaaatataaccttgctaaactaagcagcctgtgggttcattaactgtgtctctgatattccttggtagcataatagaacagaaaatctaaaatatcacattatcagacctgattctggactgaggcctttggccaatgtaaggaaaccccaaaactaccaggtatgatagaataagcatagagggagaaagaaacaaaaacaaataaaccaaatgtttgtgcctacaaataagaattccagacatgtaaagaaatgttcagttgggcgtggtggctcatgcctgtaattccagcactttgggaggccaaggcaagaggattgcttgagccaattagtttgagaccagccctgacaacatagtgagaccctatctgtacaaaaaattacaaaattagctgggtgcggtgccgcactcctgtagtcctaggagcttgggaag

SEQ ID NO: 156230 - DNA, 384 bp, Homo sapiens
atcaacatttcaccatttagctgtgagcagcaaaatgagactaagctgttgtagtgctcatttgcccacctacagcagttctttggtctgggcggttttttcttcctgaaggtaggccccagctgaatccaagttacacataaaagatgttacacaaagttacacaaagatggcaggaggtagggctgtggaagctgccttccaattcaacttcctttccgaacgaatagctaggtaaagtgggaagaaaaaccaggggtgagcaggtgagggacgctttcaaaaatacgctctgtccctcactattgctcacggcggccacaccacttctcttttgacttctgcccatctcaggctgccattctgaattccacagactccctc

SEQ ID NO: 156231 - DNA, 429 bp, Homo sapiens
aagaaggtaggagggtatgaaagaaacaagtagatcaagtactgtttctttggcatcctataattgatttaaactgtagtaattactctagtaatgttcctgagtgtacagaatgaacaaacctgaaagcctaagtactatcttggtccgtctagctcccacacctagcttgagagtagcctctcatatcaatgcttccctgctatcctttcaaaactctttttgatgggataagtgggcaaagatcatgccatcgtctcaaatgctaacttcctttgacaagacagtttctcccagggatatcccccacaggcctaggccaaatctctgactcactgcaaaggtccatgtacactgaactgatagacatcactatttttattggaaaacacaatttatataacactcttcctctggaataatactctt

SEQ ID NO: 156232 - DNA, 172 bp, Homo sapiens
tttctagaactcctgccctatccaacccggacttttttgcttcattccccattcctactatcagttgatttaggcgaggaaaaaataagcagagtgaggaaggaccctgtttgggagagctcttcccacttaactagattaacaatttatataatgattatttagtaatcct

SEQ ID NO: 156233 - DNA, 271 bp, Homo sapiens
agaaagaataagctgcgcttcttgcaggtataggactcactgcaacttgtttcttcacagccagcaacggagagagactccaaagctagctctggacatcccctcccctttgccgtgttctgttggttggaagccagtcacaggtcccactcaccaggggaggggatcacagaaacgcatgaacaccaggaggctgggatcatggggtcaccttaagtccatcaaacatagcacctgatagcttgatggccacgattacaattgattgggt

SEQ ID NO: 156234 - DNA, 309 bp, Homo sapiens
gcgggcagatcacttgaggtcaggagttcgagaccagcctcgccaacagggtgaaaccccgtctctactaaaaatacaaaaagtggccaggcatggtggcacatccctgtagtcccagctactcaggaggctgaggcaggagaatcgcttgaacccaggaggcagaggttgcagtgagctaagatcgtactactgcactccagcctgagcgacagagtgagactctgtctcaaaaaacacccaaaacccaaagatttccggcttctcttgataagtcaggggctctgcaccccttatcagctccactta

SEQ ID NO: 156235 - DNA, 393 bp, Homo sapiens
tgttgggattataggcatgcaccaccgcacctggccctacccttaatactttagtattaatgttttagtatatttgccttaaagttaatgacattctccttgctacctgtccacaatacattcataaaattcagaaaattacactgagtcattattaccatctaatcttcagatttcattaaagtttagctaattgtccatgtaatgtcctttttgtccaaagtatctaggtcagaattatgtgttgcatggagttgtcatatgtctttggtctccttcattctagaacagttctttaatctttctttgattttcgtgaccttgactcctttgaagactacagaccagttattttgtggaatcttttttagtttgaattttctcataattgga

SEQ ID NO: 156236 - DNA, 137 bp, Homo sapiens
tcagagaacaatccattctttaatattatacacagtctgaactgcacaggggtcccttctcacgtgattttgagaaagatcattggtaaagagtagacataagttgatctttaggacagtaatcttatccttttagg

SEQ ID NO: 156237 - DNA, 113 bp, Homo sapiens
tctcacacacacaaacataaacgtacacaatcattgaaaccaataagaagcacactagtaaaaaaaatgaacaaatagtccgggtgcagtggctcatgcatgtaatcccagca

SEQ ID NO: 156238 - DNA, 352 bp, Homo sapiens
ttcatggaagatcaagtgggtgatggttaaggagaaaccacgaagagcgtagcctcagtaggtaacgtctgctccagctagagctcaccatgcatgcacaccaaacccagatgccgaaaaccaaaaaatacagcagaacgcacccaactcccaaaccactgagaaagtattttaattttgctttgatcactccagctgcgcttcagagtccccagcatttcagcagcatcatagaagaagacatcaatcactggccatggcacaaggaaactcctgcttggctatcgggctgctcagattctggatgagggaaagcttactttagtggaaaagaatgacttaaatgaattta

SEQ ID NO: 156239 - DNA, 360 bp, Homo sapiens
ctagagtagtccccttctcgtacatggctcgtacatggtctagccacactcgcacttccaagtaggtcctatattgggactaagagtctcattagcagaagattcctgggttccaagatgccctgagacttctctccaactggaaaaaggttgctgaacaaatgaaattgatctttgatttttctcccccttgattatgtcatatgacaacataattcttgggtattcagaggcatcctgaacttgggtcagggtgtacctgtcagtcttatttgttcagtgtcctgtaagtcagacacatttttctgtgtttcttcattcccacagtcctggtcgcacatatactctgagacgcagaag

SEQ ID NO: 156240 - DNA, 555 bp, Homo sapiens
catcacctcagtacaatacgtttttatttagtcaccctactctgctatcaaactctgaatttattcccactattgcatcttttgctgcttaattcatctgtggttaagggttaacaaggaaaacacatccccaaggtaatttacttccagttctctgtatctgtctaatttaaatatattcctctgcaccctacgtcattcttttgaaagaaattaggctactgtgttatttgatgctgaaatgcaatctttcaagctattacctgacatacaatttctaaatgcagttcagaaaagtcatccattttacaatctgtaaaagaaacaaaacttggattctaagtccaaagatatatgccctctatgtaaatttatcttcactccctctacacatattttacacaaagtcacaagtggtttgtgcattcagtatgaaccctgtgtatctaaaaggggaagagccaagatttcagctcctgtcattagatagtccaagaatttaatattataaaagatattgggacagtggaaacaaataaataaaacagaagtctg

SEQ ID NO: 156241 - DNA, 144 bp, Homo sapiens
aaaatgatcccacaaatatatttaaagtgacacctgtgacagaggctttatgatattatgataactgataatatgatcagaaaaatttccctgagaaagtgatctttgagctgtaatcttaaaggataagtggaagttaactag

SEQ ID NO: 156242 - DNA, 359 bp, Homo sapiens
cttggtagagctaggagtgccaatggtatcagcaaggccagcctgcttccctgtgattcatggtaattctcactatgactttgacatgatgttcctacactgtgcctatcaacacttgtagacacactgtataagcgtttgttacatttactttttcttttgtcattacgtcttttattacagaggccactgtgcactccacaatcacacacttacacagctccgccttgccaagcagtgtagaccctgccaagcagtgtagacagattctggataactatctttgcatccttccccataccatgtccccgatgttgaactgaagcagctccttccacgttccctacccgttaattagc

SEQ ID NO: 156243 - DNA, 593 bp, Homo sapiens
cccctcaatcctgctggcccacagaagacctatgtaatcatacttgtaaggcactgatctaagagctttacaaagccttgggccataggagctgccagcattcaaacatttttgacatataaaaacagcaattttatgcagttcaatctattaacttatttaatcctcctaaataacccatgatgtaagtactgctgatatcctcattttaaaaatgaggaaaaggaagcaaagagaagttagtaaaccaccaaggccacacagctagtagatgatgggccttggtggcatcgataaacaccggtgtttatcgatgccacatccatactttgtccttgtggtgagagaggataaaatgtgatataatttgttattcaaagaacatggcaaccgtaacagacaaaaggaagcatggcatctaggggaggagagtggagagttttccatacacaaacacatttaaacttccctgtacaaaaatacctgctgctgctttagaaatcgttttcctttatgaatagtcaggtcttgcagtacaaatccaggtgcagtgccagcaagtatttcaaataaaattcaacgacttgatattc

SEQ ID NO: 156244 - DNA, 120 bp, Homo sapiens
tgctaaaaggttaggatgggtaaagaattagattttctgaatgcaaaaataaaatgtgaactaatgaactttaggtaatacatattcataaaataattattcacatatttcctgatttat

SEQ ID NO: 156245 - DNA, 226 bp, Homo sapiens
aattcggtaccaaaagacaagattttaataaggatcccccctaggggatccttattaaaaattccaaacatccgccatctggttctaggaagggccaaaagatatttggagaaggaagtcatgattattccatcttcaaagcaaaaggaacttaaaggctctcttctctccaccttcctcccgaggcccctttgtttagtatttttaataagattaatagggccga

SEQ ID NO: 156246 - DNA, 362 bp, Homo sapiens
aagtcatgattattccatcttcaaagcaaaaggaacttaaaggctctcttctctccaccttcctcccgaggcccctttgtttagtatttggccgatcaggatcccccagtgagcagaagaggtcaggacatttgctggagtcccagctggacctgtgactggctaaatcactttgagttccttgcttctcctctccatgcctcagtttcctcatctgaacaatgggtgcaagactagagtgcttccagcactgatgttccaagacttcaagtcctggtgcagaaaatccatctggtccaggtcactggggcctactttggggctgagaaatgaagggtaggatgggggcaagggagtgggag

SEQ ID NO: 156247 - DNA, 391 bp, Homo sapiens
ctcccagagactttgggccatgccagggccaggatggcggcaagcggatagaggactatggataagaagctcatcagggcccacccacagtctctgagccgcctcccatctgggtccacagctcccatttcccctcctccagattgggctccctcctctaagacaggtagcacctgcagttagcggtagctcatcggtaccgagcacctgctacctcccaggggcaactgtgcgtgttagacccactgtctggtcttctcactgacattcgcaggtgctcagggagacaaagcagtgtgcccaaggctatcccagaagagctgcaatccttgccacccccaatcctgcctcccttctcttggggcccagagagcttcccttccccctccac

SEQ ID NO: 156248 - DNA, 511 bp, Homo sapiens
tgctgggattacaggagtgagccaccgcgcccggcctttctcaagtaacttagtgagaaagtctgcattgggaattaggtattgtgacgtctcataggcctattttattttttaataggtaatacgttcacatggttcaaaattcaaagagcatgcaatgaagtctctcacactttgccctccagtgccaccctgtccccctcctctgaagtaaccagtattaagttcttgtatgtatttccagagatagccaatgttttaatacacaaaattacagatatagttttcctcctttataaaaatgcaaactttagcatctgcactgttttacaccttgttttgatttgtatacttcggagattgttctttgtcaataaagacattattgtgtaaaagcatctttaatgcctgtacaatatcccattgtgtacatttatcataattcttcttttgatggacattgatgtttctagtctttacacgctatactgcaataaatcactttgtacat

SEQ ID NO: 156249 - DNA, 499 bp, Homo sapiens
cttttcccagagttatgaggaaataaaggggtgtagagctaccccacccaattaacaagcagtgggtctgcaaagataagcccataacaataagtccaccccctgtacatatttgtaagcatatgactggagatgtgcttacatgtgtacctgctatatttatactcacttatcaatctatgatcaacatatccagacttacctaccttccattctttcttccttttcttttttaactttttattatagaaaatttaaaacacagatgtagagagaatcatgtaaatgaactctcatgtccacatgaccagctttgtttaacagctgtgaacacatagccaatcttgcttcatttataatacccccacctccagtgcatctatttaatctgtaattacttcagtatgtatttctaaaatataacgtctctttaaaaaaacaagaaaaaatggaactatgagcttaagtaccacataagtgacaggttaaaaaagaaaaa

SEQ ID NO: 156250 - DNA, 218 bp, Homo sapiens
ctgtcatccccaggtcttggatgatacaagtcaggattagtatgcctgaggtcttttggccttggatcaaactgggatttgaacacacctctgtccacccctaggcctgtgttcttaggcaccataatgttgtagcactcacctgtgaggaatggatttttttcattgccttggatttttttcattgccttgaattattttcagatatgaaaaacatt

SEQ ID NO: 156251 - DNA, 526 bp, Homo sapiens
ccttgctgatgtcaatctttgaaacatgattttttaaaggttacattatatttgatattattgatataccattatttatgtatggttagacataatgattgttctgtttttttgcaatgtggtattttatttattgcattttctctgtcttttagctattctgtgtttatcatctatatagttctcaagaatcataatcttatctttttattagaatgtcaaagttaggtaaatgggcttttaaagaaataactcacaaagattcaacctacaagaagctttttgattgtctcttaaatcaatgcaagttatatatgttcacttttataatatagattaaattctgtcaattaaatgagtatgcttgtatctttcctatttgctgatatgttgtgagatgatgtacaagtcttcattttggattaaaagaggctgcagatatgtgcagaatgggtatgaaagtttccttacaagagagaataaaaggatggtttaactcttgctagaaaaaccccagctttggcat

SEQ ID NO: 156252 - DNA, 112 bp, Homo sapiens
tgttcacagaccatcctttgttcagcaggaggaaccaagggcaggcatcgccaccaaggagtggccagctttccctggcccttctctatgacatgtataaaatctgtaggct

SEQ ID NO: 156253 - DNA, 123 bp, Homo sapiens
tgggattacaggcatgagccaccatgcccggccaattgtattccattcttatgatcagtctttttgctgtaggtttccccatacattttggttagaagaagctcatctgaagtcctcaagaaa

SEQ ID NO: 156254 - DNA, 395 bp, Homo sapiens
atgcattcgcagcctcacagatcctctcttctctcacctttgattccaggtaatgttttctctccttgacaatgcagacctgcaacccatggttctgttctcagctccctccttccttactctgccctctgtccctctgtccctctgtggttatccattgctgtgacctgattgccctcctataagctggagaccagctctccagagctaagaattcagctgccttctcttggacttctctgttgggatatttctacaatttttatgtttttcttgatagttatattcaaatattattttgagattgtcacaatttaaaagatgttcaataaatgttaactattactgtcgctatttttaaaatgtgacaatctcaaaataatatttgaatataa

SEQ ID NO: 156255 - DNA, 422 bp, Homo sapiens
ctaaactgtgttctaggtctcatccaattagagaaaaaaggatcacctcctcccttttgacataggataggaagttgaacagggaattccacaaggcacaattctcagtaagaccaggacttgtagaaaataatgtaatggcacaagatctgaattagatcaagagaaagcatatttccctaagaaatattttctttatatttcctgtcttttgtatataaaaagtctaattttaatgttgcattattaagttctaaatttatttctatttagaaaaggtataattaaacaaagcaaatctacatatgactttagtctcatagctctaaataataacacaattactaaatattcatagcaagttttcataaaaatttcagaatcgtataaacaaattaccctaaatagatatttggtacaaa

SEQ ID NO: 156256 - DNA, 492 bp, Homo sapiens
aaacaaaataaaaattagatgggaatattgctcaagccctggaggttgaggctgcagttaactgtgattgcaccactgcagtccagcctaggtgatagagcaagaccctttctctaaaaataaaataaaataaaaattaaccttctatcatatttcccagtaacaccttccctcctacatttctcctagaagcccttaaattttgtttttcacatatcgtttaaaacttttaagtgctgatgtctgtctgtgtcatccctctttttttttttttttaaatgtctttttgtcacttctagctggacctaccatgaaagacttctgaatccaggaagagaaactgactgggcaacatgttattcagagacagcgtcttgctctgttgcttaggctacagtacagtgacatgatcatggttcactgtagcctcaaactcctgggctcaagtggttctctcacttcagtctcccaagtagctgggactacagacat

SEQ ID NO: 156257 - DNA, 779 bp, Homo sapiens
tgggcccttgacatcccagcctcctccaggacagcccctccacgcacctcttcccagacggcctccgattcagttctcaagacccggggccttgtcccctcctttgagaagctgcccctcagtggggggcagctccctggcttttccgggctcctccgcccacaggattcaggcacggctcagccagctctggtttcatccaccctgaggggcctgtctgtgcataggcgccctcactaaatgcacaagaagcctttactggtgttgctttgttaaaatgtgactgtcatcatccaattccagtttgcccatctacaaaacacaaaacaggtataagaagagacagaaggcctagcatacccaaaggtctaggccggtgtgcttggtaaatgagtattattattacttctggatggtcgcaaaatacatgaactcttctcttcacccttcttcagtttcatttaaaaaaaaaaaaacaggtatgaaatgaaccttagagtcatttatgaccatggccccacagcgaggctacgcagcttgggaccaggcccgtaccagagcgcaggagaacacgacacaaagtgttattgaggccaccacctcctgcacgaccagagggaataaagcctgctctgtgcagggcctcctgggcagggtgtctgccccctccaaggccgccagcgcgaagcctgcattcttgcacgcgcacccacgttcacacccagccgggacgtggcactcaccgccctggccggggcctgagccaggactgcagatag

SEQ ID NO: 156258 - DNA, 243 bp, Homo sapiens
ggcacagcctcaggccctgccccagacctgcagaatcagaaactctggggtgaggcctggttatctgctgtaacagaccttccagtgggttctgatgccctctagagcaggagaaccactagcttagaggttgcagtatgtttggcatcttgccatttgtgttagttcagaggaatggctgacccccatgtctcatttctaagcttcaggcagcttttctcctgggcagctgtcattctgttg

SEQ ID NO: 156259 - DNA, 524 bp, Homo sapiens
gttcacaacagtttgcaaatactatctatttaattctcaacctagcaacagcagagaaagagattattattcctctctcatctatgctgcccccactctcctccccgctgcccccgattttatgttttggttgtgtaaattattgctaaatgaatagaactttcaaataagtcctatgctaggacttcataagtgcctaggaaattccaagctgtatttgtaaatttaaagggaagatcagcagaaaaaaatgtcaagtacttaaaatcgactttttattaaggacgcatgagaccagtgagtaggccttagattggatgtgtccacatatcctctgagtcgctccctggatccagcaagaaataggggtgggtgggacatctttgtccctacaccatagcgttggggaagagtctttgtattttgtatttttattttttttttaatagagatggggtcacacgatgttgcccaggctggtcttgaactccttgcctcaagggatccttctgcctcagccctcc

SEQ ID NO: 156260 - DNA, 378 bp, Homo sapiens
cccccagcttccaggatcgtggcaccacgttgacctccctgtggccattttcctggctctgtcccctgggcttggcaaagtgtcggcccacagcagcttccgagctatgcttatttcaggccctgcgtctatccattaaataaataaacgcacacacatacatttagaagtgacccctttgaaacaaagctaaacaaagacctcatatagcatgagctttgatccagaaagacctgggtatgagtccccggaagccgggtacgatccccctcagctctctattctgcccctgtgacgggagacacaggacttggcttgcagctgtcaaggtcaagggcgagaaggctcaagcacagcacgatgtcccgccctgagcat

SEQ ID NO: 156261 - DNA, 367 bp, Homo sapiens
ctatctgcccaaagcctgtcacaattaatgtataaacctaccgtctacagtgttagctgtgacctcggttctcatacaaagtgctctgctgaaccatctgtttcagatgatttctacacttaaatttgctttcattaaataaaagagggacccataatttattccaagtgagatgtcatacctcacatgtcagcaccttcttcattaacccatccaatttgcactgagaagacttggaatagaacctgtgtggcaggtaatggaggtatggcggggggtggagggtggagaaagcacttctccaataagggtggggagtgatatctttctggaagcagagaacctggtcagaagtggcttgtcttaa

SEQ ID NO: 156262 - DNA, 542 bp, Homo sapiens
ttttttaatttatgtgtacatttgattttttttgtttgttttcatcaaacctatactccatgggcctatatgttacaccaatagccttgaattatacccaccccgtcgccctggcctcagtgagctgaggacattgaagcagggtaggccagtactgtcagcctcactggcatagaaagaaggtggaggaaatgggtgctgctttcatttctgaggtataagtgatgatgtagataactgctataggaaatgcccacgcatagaacaaatggtaaagaagttccaggcagtcagctggtttcaacaatgaataaagcaggacaccctgcttagaagttgaaatcaaaatgaagagccttggaaagagatacctgctctacagtgtggtgagtgctggaatggaggagaaagcaagaggaatagcaatagagtcaagtcttgaaggatgacggcacataaggagaaagtgttccccacactaaggaagagaaagtggaagcacagagttgaaagggtgtggcacatccagggaagagtggaca

SEQ ID NO: 156263 - DNA, 548 bp, Homo sapiens
gtttcactttctgagcttctaggtctgtttttattcaggccctgagatcccagaaagagcctccagggtagagagtaaatgagttctcccaggtcaatgccagatggcagccctgggattagaattcatgggcccttgtttgcagccagctgtgccctcccctgagtcctgcactgtttcttcttctgaatgctcaggattgtattcaatttagtaaggtttgtggacacataatcacagctcctaaataaaacaattactacagagcatccgctgtgaggaagacaaacactgggcacctttgcccctgagagcagactgagagcgagctctggctgagtttaggtctgttccacttgaacaaaacccaacacaaacaaaccctcttgggatctggcaaagtcctcatctgttcttgtttcttctccaggcttccttgtgcattaaaagagcctgtgcttaaacccacagtaagggcctctgctggaagctggaatgtgctgtttcctggagcaagagagaggccaagctgagggacagcctggatc

SEQ ID NO: 156264 - DNA, 310 bp, Homo sapiens
aaaaattagaaaaaaaaaggaacatcttcagacctaaactaagaagttgcaagggtacctgtaaaaggatcacatatcatctattataagccaagtgtatgagagctctttcattcaaagtaacaaatcctctagaaaaagtagatttagtccatgttttaatgtggaaaaaaactgaagtaacattctaacacttcatatgaaatccttcatctttttccttttcctaccttccaatttcgggctctgcctctctggtagtacatggcaaatccaagaattgagtattttttcacaaatttaatatctg

SEQ ID NO: 156265 - DNA, 142 bp, Homo sapiens
ccgagattgtgccactgcactccagcctgggtgacagagcgagactccgtctcaaaaaaattaaaaaaaaaaaaataagagagccaggtgagaaccccttctccctcgcataactggctgaggagagtcagacacacaggct

SEQ ID NO: 156266 - DNA, 318 bp, Homo sapiens
cctctgttcccatctttccttcccactgggaccccatggaacagaagctctgtgctacgccctcctcccctgcctctgcttccagttggcctcagaaggacttgcattcacagtcatccagagcttggcagtgggtcaggccagggcagtgacagccagtaggatgttttcttctggtgccccacctgcccaggtgttgggtctctgtgagccactggcctctagaggaggtcaccacaccacctccatttcacctgtgcaggcaaacatcccctttctgggataccctccatctgaagcccagagccaggctcctta

SEQ ID NO: 156267 - DNA, 201 bp, Homo sapiens
gactgataatgagaaaatgaaaagaagaaaaaaaaaactgccctaatcaaccttgggtcactgtgatgaacaagccctcatttcagaaatgttcatgctcgtgtagattctaagctattttgaaccctcttccctcatcacgatccaacttggcccacatctcactattctctccacacagtggccatgcccacctgcatc

SEQ ID NO: 156268 - DNA, 519 bp, Homo sapiens
tggagaactcagagggcagtcatatcatcctcaggtataaccctctgagctgactttaaaaccagaccccatccatcctaaaggagtgtctcgaggagaccaaaaaccaagggcataaccctggcaacttgttttgaagcacaataggacatctcagctaggaaagacggcaggcaagtggcgtgtgggtcgtttcaggccagcactcacttagtgagcacttactgggtgctagaccctgtgccaggtgcctcattcaatcctcacagcaagaaacaaatctactggtatgtgtgaaagttctagagaaacaaaaccaagatggagtatgctccacagtcaagctccattctcagtagatggttaccttaaaaagaagcaggagttggccaggtgtggtggctcacgcctgtaatcccagcactttgggaggccgagctgggtagaccacggggtcaggagttcaagaccagcctgaccaacgtggtgaaaccccatctctacttaaaaaaaaataca

SEQ ID NO: 156269 - DNA, 410 bp, Homo sapiens
tgtggcccagggcctggctagggtgcacacagtggctactcaaggcaggacacagcaggtgtggggtggtctgggcctgtgggaccgatgggtgagtcctcggagacccagtgcagagggaaggcaggtctcggctccacctagaaccatctgcccctgagagccccgtactgatgtccctatacctccatgagccgcctgcctcctgcatcagcgcacgacggacaccagacacacagacatgggcttgacaacaccgccacctgctcgctgcccagcagactaacccgctttggcttggggcccaaaaattcaccaaccattccagtgactctctcctgagagaaactggctcgactcctaattcctgtcccgtcctgtctcacatgcaagagggacctcactcagga

SEQ ID NO: 156270 - DNA, 370 bp, Homo sapiens
gttgggacggcgggctccagccccagccccagccccagccccgtactgcgggtggcgtgggcgcggccgtgtggccgccacgtccccattcacagctcatgactctgcttccacagggcttcttagactatcctgctagttatcttcattcccacaagaccaccagggcggaattaatccgactgaatcagtcaccaactttattgaacaatcccaactttttctttcccttcagcgctgcgccctgcgctatctacaggaggctcttcagtctttggcaccagtgtatcttttagctccatctcccaacactccccctcatcttgcgctctgggcaccatcatctgtttcctaacaaccggtccttttt

SEQ ID NO: 156271 - DNA, 658 bp, Homo sapiens
gaggggacagagagaggcagggggacagagaggctgggggaacagagagagggagaggaggccggtggggaaacagagttgttttttcctctgttagctctcatccctgaaatcaacaaggaaataggaccggttcactttgccatgttggcttgaggtgccctgctaagagctggggttccatccagccttccttggctgtgacactctgtggaactaatcttcaacttcgcagaagttgttccctggcctctggaatcccaccttggtgacttaaaagctagtggactgatagaaaattcagtccccgttacttaacttggattttgaaaaccgtcccctcattcaggtttacacagaacatgctattgcccgtctaagcctgaggggaccacacaccccagaaacaccagagcagatcatgttcaaaaccgccgactgtcctgaagacagttgacaattcatgagtttgacgcacgttttttccagtccaagagctggagccagatacccacccgtgacgccctcccacatcttccaaacgggcacttccaaaccttgtcctgggcatgtttccaagccagcctcactgctgcaggctcatgtcatgccctctctcctgcgtgctcccagatcccgcagagagagcgtcggtacc

SEQ ID NO: 156272 - DNA, 555 bp, Homo sapiens
tcaggagaatgatccccagaagcatgagcaatgcagatgccgaggcttcacacaagaccctggagggtcttattcctgcagccgggacctgggcatcggtgtgcttgaatgctcataaccgattttgaggggagcccaatcgataagctgtctgccagtcatgctcatcacactgtagttttcacacacgtcacacggagaccctgttcgtatgcacatttgggtgcttgagcagggttgcgcccaagattctgtggttctacggagccctgagttgtgccctgggcagctttcctctggggctggtcaactttgatcactgtacctgacgagaaagggaccatgaagtctaatcagcaaatagagaaaaggaaggggccatttcccacaatcatttccacggaaacaccacgtcggatcaataagtctcactgcgggacagggactgtgcttcagagatgcagctttcgcagctggacaaatgacccagaaattccccaaatgccatttttaaacacacccagtgagattgatttcagggctttctgaatttat

SEQ ID NO: 156273 - DNA, 443 bp, Homo sapiens
atataattgaataaggaggatagataactattttacttattttaagtatcaccaagggataatcctaggtgaaattcccatttttttatgaccagagggctgaagaaccaagaaatgttcttgagcatttagagtaaatttggaaggcaatatcagctgcctccttgtaggaatagtagtgttgcttttttgaagacccatttagagaaccaaattcatatataacctcttaagtgctcgaaaccatatattaaactgtgtatgaatattgctttaccatagatttgtttgtgtgtttaataaaggaacaccttaattggtaacttaattttcttagatttataatagaactctaagggaaaagattgttgtttgacattaatgttaataatccagcattgacttattctctcacattaatttgtcctagttgctttttaatg

SEQ ID NO: 156274 - DNA, 340 bp, Homo sapiens
atcatcttatttttaatggttgtgtggggaactgggttcagcatttttgcttgacagccttgagataaaataaatccataaggaaaaagcccacttctgtttcttttcatcccagagagattaatgggcaatatatgagtgtaagatactggaaaagtctgttgagaaacctagtgaaatctcattctctgaaaagttgggggattacaggtgctatcgaatgcatcatacctaagggttagatgaaatgacttccaagagtttggccctattaaatctgttaagaggtttataatgccagcaggtgatgaaatgaaatttggatgccttagtttcagta

SEQ ID NO: 156275 - DNA, 325 bp, Homo sapiens
gaaaaagaaaaaaaaaggtaataaattcacaatcagctgacaatttgaagttgaacaacattctccagagcagctcctaaatcaggaaatgcccccaaggcaggtttgagaacaaacagaaaagtacttcctatagcaaaactttcttggcacaaatgcaactcatgaggaccaactagactcaacttcatatcccacagcctctccctgacctgatggctttgcaaatgcagtcagaatctgaaatttaacatatccaacaccaattttcttcttcactggcatgtctgtcattctatactctatctcaactaaggctttcacc

SEQ ID NO: 156276 - DNA, 269 bp, Homo sapiens
aactagaaggggttacagaagcttgagccctacccattcaagtcaaagagggagggaaggggagaggtctggtctccattctctccatgcaaataatctgtgcattgctcatgtgcctgggcagagagagagagactagtgtgcatgtgggaacacttaggcatgacactgaatggagccacacatatgcaaaaacaggagtaggtgtttggtgtgtgtgtgtgtgtgcgtgcacgtatgcatatcagtttcacttcttggcatgctcc

SEQ ID NO: 156277 - DNA, 443 bp, Homo sapiens
gatgggggtagaagtttattccacagtgagagggaaactaaaagcaaatgggtccaggagcaactcctgactaataaaggctcgctgcaccaggaagatttccttacccacaaatgactgttccacttgttcactaatgcttggaaaagcttttatggagaaggtactgcgtcctgttttctatatttagaagaaataaaatcccttaaaaaaaaaaaaccctacctataaaaacgatggactgcacagtgtagcttggagttcaaatcccaacttgccaccttagagttgtgtgcccttggaacaaaatcactttccccaaatctgtttctccatcggtaaatgacaccaacctcaggctgtcattgccaagacttgtagatgctcagcagagtacccagcaaacagcaggcattggaaagccagactgaatccaccctaaa

SEQ ID NO: 156278 - DNA, 502 bp, Homo sapiens
agactgcattaaccaacttagaaatgtacaaaccattcttaagtttacagagcattatatctccattatgttcttcatccttgtagtagtcaaaggctcatagttacatctctgaatgtctttataaccagccaattgcataccaatacatctatcaggacaatcaacaatataagcctagaactaagttactatctttagcgtactcagcatcaatgctgagtgcagccccaatgaacagtacacatgcaaacaaatacctaaacagatgtaacagaactagtagtacattgagcctaggaaacgcataacaatcacatcatttgttcatgatgtgattgttcatgatgtgatggttatcattaaccagtcttttactactaaacttaaatggccaattgaaacaaacagttctgagaccgttcttccaccactgattaagagtggggtggcaggtattagggataatattcatttagccttctgagctttctgggcagac

SEQ ID NO: 156279 - DNA, 343 bp, Homo sapiens
accgtttctcctgtgatccactctcttgtctccaaaccctctgaggatgtgtctcattagcagtttcttctcccactactattttaactgtctggtttttactgagtcttctccttcaacctacaaacagacttaagtctcttccatcttaaaacacgaaaccggctgggcgcggtggctcacgcttgtaatcccagggctttggaaggccaaggtgggcggatcatgagatcaagagatcaagaccatcctgaccaacatggtgaaaccccgtctctactacaaatacaaaaattagctgggcgtggtggcacatgcctatagtcccagctactcgagaggc

SEQ ID NO: 156280 - DNA, 295 bp, Homo sapiens
aacgggtgatgcggttggcatcaggtgtacagacattgacgaatgtgtaacctcctcctgcgagggccactgtgtgaacacagaaggtgggtttgtgtgcgagtgtgggccgggcatgcagctgtctgccgaccgccacagctgccaagacactgacgaatgcctagggactccctgtcagcagagatgtaaaaacagcattggcagctacaagtgttcctgtcgaactggcttccaccttcatggcaaccggcactcctgtgtagatacaccccaaggattcctctctgctcac

SEQ ID NO: 156281 - DNA, 437 bp, Homo sapiens
gactcacagttccacctggctggagaggcttcacagtcatgactgaaggcaaatggggagcaaagtcacatcttacatggaggcaggcaagagagcttgtgcaggggaactcctatttataaaaccatcagatctcatgagacttaatcactaccaccagaacagtatgggggaaactgcccccatgattcaattatctccacctggcccagcccttgacacatggggattattacaactcaaggtgagatttgggtggggacacagccaaaccatattattatccctcaaaatagcctgtattcccccatctccctctcttctgtgaagagggaactatgtaagctccatctggcccttccttgagtctcatattttacatggctccatgcttatgcaagttaataaatttgtttgcttttctcctattaatttgt

SEQ ID NO: 156282 - DNA, 493 bp, Homo sapiens
tgagatggagtcttgctctgttgccaggctggagtgcaatggcatgatctccgctcactgcaacctccacctcccgggttcaagtgattctcctgcctcagcctcctgagtagctgggactacaggcgtgtgccaccacgcacagctaatttttgtaattttagtagagatggggtttcattaataatcattaatattagacaactgtcagactcacagtggtggatacaaactttctcaaattctgatttttactctaaagctcaaattttatcattggcaacaaatattgtcagttgctttccctgaacagacagcttcccttctttcatttttgagaaaatatctgccagtatcccagttggtttatcaatcattctttctcttttttttttttgagacggagtctcactctgtcacccaggctggagtgcagtggcatgatctcggctcactgcaacctccacctcccaggttccagcaattctcctgc

SEQ ID NO: 156283 - DNA, 511 bp, Homo sapiens
aggcccaggggattggtttgaccaggtgtgccatttacacagctcgagaaaagactggccctcctaccctaatcttttactgtgcaaatacagctactaccaggtggtcgccagtacacctgcacagatggctttacttgtcctgcgccatgaccccgacacacgtggcaacaaggaaaagggagcaggaatcgccatattgaatgtacctggcttccaggtgcagctgctggcatttacatatgcaagcctctagcttacatagctatacttgcagctagacttttcaggctgctttatattagaaaagaaatggtttggaggctgctttttattgaaggaaaattccaccaaggattcttttactctttctaactgcaaaataatttcttaataactcctgtattagcagctgaatttgcaaagaaaataaaggccgtgtccttgtgaatcttttttctccccttaactctcagaaatcaccacctgtctcaataaactacatcataat

SEQ ID NO: 156284 - DNA, 367 bp, Homo sapiens
cagaccctgccctaggttttcccacgctgctccctaggcccaaagcccctgggactttgctcagaaggcactcttctgctatgaagccttcccgtatctgtgaggccccttctgcgtgttcttacagtgggcattaatcactctgtagcacagctgctctctactttgagctctttctcagtagatggcaagactgtttttcacccaacactgtactcccagcttcgagcgcagtaccttctggcccaagactcagtgcttgtttgttgaatgaatggataagcgtgtgtttatgcatcgtattttattttatggtgcctatgttctaccagctaccctttcccaaatgcaacaccataaaacactc

SEQ ID NO: 156285 - DNA, 524 bp, Homo sapiens
tctcgctctgtcacccaggctagagggcagtggcgcaatctcggtttgctgcaaccttcccctcccaggttcaagtgattatcctgcctcagcctcctgattagctggaattaaaggtgcctgcccccacgcccggctaatttttgtatttttagtagagatggggtttcaccatgttggccaggctggtctcgaaatcctgacttaagtgagccgcctgcctcagcctcccaaagtgctgggattacaggcatgagccaccatacccagcagcattttaaacaatctgaaacaaatgtatgaaagtagtgaccgtgggtgtactaactttctagaaggtagctgagcaatctcagtattgaatttgcacaccctttgactctacacaaggtttgtatctactaagacactttttttttgagacagagtcactctgttgcccaggcggaggttgcagtgagccgagatcatgctactgcactccagcctaggcaacagagtgagactctgtctaaaaaaaaaaa

SEQ ID NO: 156286 - DNA, 406 bp, Homo sapiens
ggagaatcgttggattagttataattatgtgcaagtaattaaaaaatgtctagagacaaaggttaagaaccaatcttgaaggtcattgaatgcctggataagaagattgaacatgtgatcatgggaagcagtcattgtctgcagtaatgtgttgttttggaggattcaatgaataattttaaaggacataaagagttaaaggacataaagcttgaatggagagagagattttaataaggaatcaaatgaaggttaattcttttctttggacctcaggtttgacgatgtttgctgaatggaatgtcagtagaggaggttggcatattgaagggttctccacaaagacaatgaagttgtacaaaagaggccaaaaggaaaatagtaagccagatgccagtgtcctcaa

SEQ ID NO: 156287 - DNA, 201 bp, Homo sapiens
ggggcaggcaactgccccttgtcggaaccacccccacctcggtgaggatcattagcgtcaaaggtgcctgcgacggggtagcaggtcgtgccgtcacccccacaccgcagacacttgtcctcctgcttggacgagtccagctcgtgatcacagccgacaacccggcagctgccatccacacagacatcccgcttaaactcg

SEQ ID NO: 156288 - DNA, 612 bp, Homo sapiens
cagaatgaatgacctaggccatgggaagtaagactgggaagtgtttttcatcttcttagagtttgggatatatggatgaattgagtgaaatgaggattttagtgagtatctctactaggttcctgacagggatggtttctccagggattcaactgaatcttataggtagatctgatctggtgaaagataaggtataaattggcctgtcaacaggacattcgtactggtagttattactaccatgatggctttaagagattttgggggctggcaagaagtagagtaaatgtagcagaacagatggatgttatagggaaaatatagctgtaaggaacagtgagagcttagtgatggtggcagtagagcataaaagacaaattatctttaactttggctttgcaaaaattggggtataaagcgttgagctcaacgctttatacttcctagacgtggacagtcctgccgagtactctggccccgagggaagttattcggcttcgccgtggattcttcgtgccagcgcgtctcccggatgttcttctcgtgggagctcccaaagcaaacaccaccagctgggatgtgggagagggaggtctcaatggatggctctac

SEQ ID NO: 156289 - DNA, 518 bp, Homo sapiens
gcttattgtaaaaagtagtttgtaaattgtataaagaaaatattgaatgtaaaaaattttaaaacaaaggaaaatgccactttgaaagagtactgttctgacattctctttttaaaaattccttctcataattcctacctagaataatgtgagtacttaatagagatttagtaagtttttggtgactttatattctgacgcgctttagtttacaccataaagcactgaacagttatttccaaagaagtgtaatattgtagcatgctgtcagtatttttaaggattttctaatttgccaggtacctgagagcagaaaccatgattattacacttattttctcccagctgtatctcttagccagtgtctggcatataactgacactcactaaatgtttcatagaaatacaagagtaggcttttgtttgttttagtttgcagatacatttctgtttatgaaaatgctcaagttttcttgagatacagattttttgtataaaggagtgtctaggttgtatag

SEQ ID NO: 156290 - DNA, 411 bp, Homo sapiens
catgtaagttgtaccttgattttagggcactgatacccattaagtatactgttgtttatattttacaactctccgtttggtatttctatttgggtttcataatagaaattagaagttagttacacagaataaaatcagcctttggaattgaagtttgagctgaatgagaattcataaaattggtaatacatacttattttgcaaaagtaggtatgtgttacttcctgacttttttgtttttgagacagagtctcactctgtcacccaggctggagtatagtggcgcacgatctgggctcagtgcaacctctgcctcccagattcaagcaattctcctgcctcagcttcccaagtagctgagattacaggccaatgccactgtgcccgactagtttttgtatttttagtgca

SEQ ID NO: 156291 - DNA, 261 bp, Homo sapiens
ttgggaggtcgaggctgcagtgagccgttttggcgccactgcattccagcctgggtgacaaagtaagatcctgtctggaagaagaatgaaaaaaagacagtgatgatattcttttattcattccacaaacatttactgaacatctgctatgttctcaagcactttttaggcactagagatacagcaatgatcaaaaataaagtgcatagtttcatggtgctgatattctacagaagcagacagacggtaaggggtaccgac

SEQ ID NO: 156292 - DNA, 410 bp, Homo sapiens
atggagagtttgctgagcacctactatgtgccggcccctgtgctgatggaacaattttatggagagagacccacaaagacacacacagacaaaccaatggcacagacacctacacctgcacagcactgacttgagaggtgagaaaaatccttcttcaggagcatggggagcttttattgcttaggagtggtaattgctgacacacaaaatggtcagactccccagaacacatggtgtttctggggataaaaattattggaggaagaggatttttaaaatttgcaagtactagagagtgaaaaggaagatctattggtttaattttcaaaggagtttaattgctgctttttaaaactatatggagtatttgaactgagaaggactgtagagattgtaaggtcaaatgtctc

SEQ ID NO: 156293 - DNA, 517 bp, Homo sapiens
atgtgtgtgtgtgtgagagagagagagaacgagaaagaaaataataataggtcttattagtacaaaagacttactaggcatccattaatttttctttgcctatttcaaaagtgggaaccagattcaattctatgcattttcacaaaatggctgtgccagtgttttttaattcccattctttggaaaaggcagatgtcaatatagagcacagggagtggtggagactagaataccttactgagctgtggaacccctttagaaagaaactcagcactttttccaagttcttttttccatccaataagatataagggcaactcaaaattttaagaaatttttgctcccctctcgttcctccttatgattaagaccttgggatctgatcacacaggctgagggtcacaactccacactgccgtttatcaggtgttgtttaaaacgtggggcattagcaattccaggcctcatgcaggcttttctgtgtaggaaaaataataaatagaacagtagcaactat

SEQ ID NO: 156294 - DNA, 755 bp, Homo sapiens
cacacttgactgcatttggtaattttctacccttattcctagtctgcttagaattttgaaaactcaagcttgaaagaggatgcattgacttctcaatgaagaaacaggcagccaacaccctcagacttagtgatgaatcatgagaggcaacattctgaaactgggaacacaatggagactatggaatatactaatttgctaatttctttttcctaccttattgaactggtcaggatggacaaaccaaagtcaaataatggttaaaaagaaacaaagaaaattatttccagatgttactgtcttcctagtggcccaagacacatttaaatttaattaaggagttcagttacaacgtaacattttaaaagataattagctttctcatatactgggaaaaactggttagaaaatatagagatcactcagtgggatggaatcaaatagaaatgtgtctggtaaaggttgtatttcatgttaagtgagaggaatcagagtaacagctcacataacgcttcagaacttctaagtgccaagcattatgctgaagaccttttttttttttgagacggagtctcgctctgttgcctaggctggagttcagtgacacaatctcagctcactgcaagctctgcctcccgggttcacgccattcttctgcctcagcctcccgagtagctgggactacaggcgccggccaccacgcccggctaatttgtatttttagtagagacgggatttccctgtgttagctagga

SEQ ID NO: 156295 - DNA, 371 bp, Homo sapiens
caggcttcactaaacacttgtatgagttagttcctgtgctaaacagcgtatataatatggtgaaattgaatgatgctaggccgggagcggtggctcacgcctctaatcccagcactttgggaggccaaggcgggcagatcacttgaggtccggagttcgagaccagtttgaccaacatggtgaaaccccatctctactaaaaatacaaaaattagccaggcatggtggtacgtgcctgtaatcccaggtactcgggaggctgaggcaggaaaatcatttgaacctgggaggtggaggttgtagtgagccaagatcacaccactgcactggtcgcagcctgggcaatcgagtgagatcctgtttcaaaaaaa

SEQ ID NO: 156296 - DNA, 472 bp, Homo sapiens
gagctggagaggtagacggtggcccaggagagtgcagagaccaaggaagaggagttcgagaaggcagcagcgctcagcagtgtggctgcaaaacagacagcaaggagaatgagccttcaaaacactgtcgggcttggcaaggaggtgcctgacgaccttggagagaaccattgctggggcctggaagccagattgcagggggttaagaagtgagtgggtggagaggaagtggaggcagagggtgtagaccactccttggagaaatttggcagggaaagccaggagagaaaaagggtcgggaactagagagggcagtggagtgaagcaaaggttttctgcacaaggaacaagagagagatgagagtggcccattggaaccagagccccatttgccgctgacacacccaggcccaccagctgaggggctggggagagacgggtactcactaacactccgaaagaagggttcagc

SEQ ID NO: 156297 - DNA, 383 bp, Homo sapiens
gggggtgttacaagataacccgacggatgatggaaatagggaacgagacaatccccagcgccctggtcaggtcacggagcggtggcaggcacagggttacaaggagcacccagctgcctgggacaggacttcaggaaaaggagcatcgtgactggggacagatgtatggtggctgttacatcctggctgagaagttcagctgtgatgacctggcctagatgaggtcatcctttttggagcatgggggtgcacacagggtggcagcagaggcggcaggattcactggggacacagcagactatgcccaaggctgccaagttctaggtgtggctctgcttttgtgggtggcacagaagtgagtccatccaactcatggcctctag

SEQ ID NO: 156298 - DNA, 368 bp, Homo sapiens
agagtgagaccgtgtctcaaaaataaataaatataaaaataaagcaaaaaaaaaaagaagaagaaggaaaaaagattctagaaccttctgatggcatcggtgtgttttgctttcagataattggttaagtgcaggcagccacacctttgacttccatttcaacttacctcccaggcttccttctaccttcaccagcaaatttggccatgtcttctatttcgtacaagcttcctgcatgggcagggaacacattttagccaagaagaggatgtacttattggttcaaggaacttccaccttccacaaagaaaccccattccaggtaccgatgggggaaaggtggaggtgggaacaatctccaagctcca

SEQ ID NO: 156299 - DNA, 608 bp, Homo sapiens
ttttaatagagacgggggtatcactatgttgcccaggctggtctcaaactcctggcttcaggcgatcctcctgccttgacctttcaaagtgctgggattccaggcatgagccaccatggccctccatccttctgatagggacccttacggtgacattgggcccacctggataatccaaaagcagccctccatctcaagaccctcaacttaatcccatctgcagagtccgatggaaggtgggacgtatacaagtcccagggatcaggacgcagtcatctttggggatcatagttctgcctcccacagggtctgcttccctcagtccatttctttgctgtcaatggtcctatatatgcccagattataggttataaagtccttctacaagcaggtgacacatgaacacaggttcagggcaggcagaccccagccatcacctcatcatagttaacctagttaaattagcctggcatgtggcgtggtgcctaatgcctgtggtcccagctactcaggaagccaaagcgggagatttacttgagccaaggagatcaaggctgcagtgagctatgatcataccactgccttctagcctgggcaacggagtgaga

SEQ ID NO: 156300 - DNA, 370 bp, Homo sapiens
taaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggacatttttaagactataaaagtgaaattatagaaacgacagaagtctattcaatacaaacataagggctttaaaagaaaaggctttgaactaaaaagaaagtgacagctttagtg

SEQ ID NO: 156301 - DNA, 232 bp, Homo sapiens
tgaattataaaaagtagatacaaaacaggcttttaaagattttcaagtcttgctttatggtttttagagaaataagtttttttcaaaaatataaataacacctttcgtatcaagattgatttctcttgagatctttagtgacctaaaattcttaaaactttctagagtcttccaactttggcaatacagaattattttttagttacaagctctaaatctctccctcaaaaaa

SEQ ID NO: 156302 - DNA, 412 bp, Homo sapiens
gcccagcatagttccaacttacacctgctgtaccagtgtaatgactaatagtcccctctttcactctgacagtatcccaatttggatgataaataacatcactatactatctaaaatgaaatttctctctcttgctcttcctcatttctgaccaactttctctttcacatatattgatggttaatgagttactcatttaaattccagcttaggagtttgtttattctgcgttctctctccctttttaatcaattattgcagactatttactcaatttgtcttagattagtccttttgtttctttaccactgccaccactctagtccaaaggttcatcaaatcatacctagattatgacaactaccatcctaacacctagattactataactaccatcgtaactgttcttgtt

SEQ ID NO: 156303 - DNA, 1269 bp, Homo sapiens
ttttagtgacagccttgaaatgtggtgacccataatcaaatgttctaaaccacgtttcatgatagactttacttcatgaccagttacttagtgtcatcatcaccacatattactctgcacgtgtacttcatactaaattttggattttagaaatgttctgaaggcaatacctcaagaaatatttatacagaaaacaaaagtttagttctattgaaatttaaacttgcttctctctacattgctttgcatatttcaaaaaaagaaaatatattcaatggcatttttatcaaccacttatatatacatagatacatacacacattctctttggcaaaatttttttccagcatgttttaagaaatttttttttaagtccttgctctgctctttttaaaaatggtctcattcaaagttgtgaaatatggggtgatgatatggaggaactctcctaagtttggttcatcaggaactctctctgtctttctgagacttttctccaaggatgttttgctgcttgtttggttatttgaattttgaaatcaggatctgtagatgttcttgtctcttctgccttatcaccacactctaatctgctcaccctgaccttccaccttgaagtgaataagcgcttaggcaggcatagtcctgtaagccgatagtgccaccggcctcagctaaatgaaaggaaaggaaattgtcctatatgcatttgctgtggattcatggattggctttctgtgatagagaaagcttgtttgtatctttggggtcttaaacgtgcatgggaaataccattctaacacactgcttgcttctaaggtaagactataggaaacacaggaaagttgccccattgagtgacatttaagacgttttctaaaaatagatggacagtgtctagcaacatcaaatatatgatgcaattatgctttgtgggtttttcatattttaatgtgatttcaatatgttataactatttttatatgtatttgtcaaatgtgtgttatttctataactctttagaattttgaaccacctccaacatttaaaattacagctggagcaatagtttttgatgagcactgtgtggtcataatgttactcaacatacatattatgagaggcagaactgagctgcagtttagtagagaggcgtgaggcaaaagtgaatggatagtcttagtatttaagcagcacttaatccaccagaagtaattatatcataatagcttctgcaattaaataatcaccaaaaactaaaaaaaaaaa

SEQ ID NO: 156304 - DNA, 1137 bp, Homo sapiens
  misc_feature (1)..(3): n is a, c, g, or t
nnnggctgggggcataaggatgtcttttggagtcagattcactggaatattttttgccactggcctgtacttcccttgtcctgttaataagcttaattttattggtacttcattttccattttcatttcaaaatgttctcatgagtttaaaaatcaattttaccataatgtaaatacagacctttggataggcaccaatctctaagagtagaatactgagaggcttgtctattttttttaaggaatagctttttctaaacacatagtcaagataccaatctgaagtctttcattagctttgaaaaaattataagcagtataatgtacatggtctctgtccattttgactaatttaccacaaaaagcaaattgagaggcttgaacctcaaatctgtagtaactagaaatgcacgatgtgatgactcctacgatattaacataccttatatgttacagctggcagatttgccagccaaaaattcattcccagcgataaactgagtaactagccacccaaatctctacattttgagcttttcttcacagaaacttaaaatcatcttggttaaagtgaaaatgtaaaatgagatcttggtagaatttaaaaagacaaaatggctttattaaagaccacaattgtgtcctcacttggaattattttttcttcctgcttaatctcatgacataaacacaagagcagggagagtctcaattaaaagcaagaatcctggaattcatcctaggtccaaatccctgctttgccacttaataatggtgactagacaagtcactaaacctctccgagtctgtatcttttcctacataacataaaagcagcagtgatcacatggcattgttgcaaagattaaaaaattcctgttttactctttcattaggcatgtggaaagttttcaataaatattagttattgtaacttctaatctagttccccttgtttactagtgaagaaaaggagatcccaaagagttgagacacatgtgcccacatttatccaactggttgatagttctggaactagaagctgctgcccctgatgcctagaacagagctctcattaagctgcagggcagctagggagcttttggtatctgtgttccagacatttccctactcacc

SEQ ID NO: 156305 - DNA, 475 bp, Homo sapiens
tccacacttcccatcctggtccaagcctcccagattactgcagtggccatggacttgcctccttctttcatcttagttccccagttatctgcagaggaactcagcggagtggttaggaaaatgcatttaaaacttagatcagactacatcatttatctgctcaatattctgcgatggttccccatgctcttcaaagtgatggtctaagttgttacaatggctgtcattcttacctgattcttgttgcctttctggccttatttcctaatcctcaccccctgattcactctgctcaggccacattgaccttcttggtgttcttccaacacaccaggcacgctcctaccttacagcatttacactggctgttttctcttcctagaagccattccacagaaatcagaggactccttcactttttttcaagttttgctcaaacaccccctcaattagacctacattgaccatcctattt

SEQ ID NO: 156306 - DNA, 257 bp, Homo sapiens
ggtccaaactctaagaatccagtcttagacagcaccaacccattgagtccctgcatattctgtcacaggtaagctctttcttgccttagggatttaagctgcagatggaaaatactaattgctgatttaccaacccatagacatactgccctccataatatttaatatgtaacttggaaaaacgaaacaattctgtagaaaacctctgatgtgaattacatcacactaacaatgaaaggggcccaggccttagcaaa

SEQ ID NO: 156307 - DNA, 357 bp, Homo sapiens
tccacagggaacaccttgtcccctgccacagcacagtaactaccatgccccacgctaaggtccttcctctgaagactccctgtcgcccggcccagcctccacatcaaatcagagataaccctggaccactcaccacatgcctggctcagttctaaacacgacatgcttttcctgccttaattttctaacaactctgagcaagtactactgttataatccctaatttccagatgagggaatggaacccctggagccatgtgatggtcaaggtcaggtcactcagctggtcctgagagctgcgatttggccctgggcagcttgggtgatatgcggcacccaacctgcaggccccacccc

SEQ ID NO: 156308 - DNA, 409 bp, Homo sapiens
ggcacagaattgttcgtagagttattttattatccttttaattactatgggaactgtagtgatattccccctttcacttatgagtaatctgtgtcctctctctctttctcttagactggctaaaggcttattgattttatttatgtatttttcttttttttaaaaaaaagcattggatttcattgagtttgtctattaattttctgtttttaattttatgatttctgctctaatttctattacttttttttcttccgcttacttggagtttaatttgcttttctttttccagtttcttaaggtagactctcaggtgattgattttgatcattattttctaatatattcattcaatgttataaattttttctaagcactgctttcactacatcccataaattttgataag

SEQ ID NO: 156309 - DNA, 320 bp, Homo sapiens
agggacccaggctttaccgttctgtgggactaatctccttctgcacccagctgccagcagggaaaagaaggcaaagaatggacctcttcagacctgttcaggagtggaacgtcactctgttcatcttcttggggctcagtcatggggctctgccagttgccaggaagcaatggagcagtgtttttggccaaccttgagcagacctctgctgccctgtgctaatgctgaaagtggctgcctaatcttctgggctttgtggactaacttccgctggccaactgtgggtcataggagcttttcttgcccccctccttaaattt

SEQ ID NO: 156310 - DNA, 322 bp, Homo sapiens
ggttttcatccaagtgttttaaataatattaacttgcctgaccatcaacttttctcatctgaaatacataaaccacaaacatgattttaaaaaattagtgaacatgaaagtgctttggtaaaccatcagacactttgcaagtcttacgtcttatgattattgtctcataagaaaatggagtgttccaaggaagggaaagagtagtggcagatgctacagagtttcagaagaatatttatttctagcccaaattgtttggcttgtaatttaaggaagttaagtcaaagaatgaatttgttctctaatcacttagaacagtatt

SEQ ID NO: 156311 - DNA, 175 bp, Homo sapiens
tatactgcccattttaataagctacactgaggtgatttctatttttctctgatttattaaatatatgtaatgaatcaaaaaagtcatagagaagtcagactttccaatgagctacagtccttaatcacatagtatttgtgagcattaactttttacaagatactcttggatgata

SEQ ID NO: 156312 - DNA, 398 bp, Homo sapiens
actgagagagaccttctcttccaccttctagacgagctagcaagacatcagattttgaaggctatatactgaagctcaggaagtccgtaacgagaagacaacataactactctacagttccacaggaaagcagacacttccagttgcgcccagaactcgaacttgtcaagaagaagttgctagcagaagtggtccagggacaaagtaggagccccagaataagtaccccccattatcgaagaggaaacaaaaggagattctgtagaggaaaatcagggaactcaacagaggcaattattatcccgaatgcaaatcgagccacaaaaggacaggaaacaaagtctggccccatgcaaagtgggtagctggtactgaaaggatccctctgactcaggaaa

SEQ ID NO: 156313 - DNA, 164 bp, Homo sapiens
cagtgtcgctttgtggctagtgttgggggtccagacttgaggcgccctgggctgtaggatgcccacagcctcaccactcccatgaactcctccagccccgtttcaccccaggccaccctccccgcagcctccccctgctcccttgccgtcagcgctgcccattt

SEQ ID NO: 156314 - DNA, 654 bp, Homo sapiens
aaaaataccttttatttaacattactatggaatgaggttctccacattaagtaataatacaagcctaactctttataaaaaaatttttaaaacttatcaccctttaaagaaaaacatttctgaaaatctgtttaggatggctgaaaaaacatacttacaaagttatcattaataatataaattaacatttttctgatacaatgatgatctatctatctaatgaggtggcacaaggaaaaggtaaaggggcttaatatgacagtcttttaggaaatttttattctcttttcctgccagatgtcattccacatcactatctactttattagccccattctcctacaatctgctgcttctagttttgtataatttatgacactagattctattagaagtgagtataaaaactagattttcaatccttacttattatctctattttaagtcttaggttttatatttagtattaagtatttctagatttttaagggttattctgattagttccaatgttgaaaaattttccctttataagtaaggcatgatacttggtttaccttaattcttccataaagaacatatcaaggctattttgcaacactgtgctaaacaaaactagcattaaatatatagtctgacaatatactaacaaaa

SEQ ID NO: 156315 - DNA, 353 bp, Homo sapiens
atccccctctcccttcctccctagcaggaactggtcattgtctaagggtcgtgattcttaaccgttctcagccccttccacacaggcaaaagcccaaagcatttcttccttttttttccattctgaggccaccttaggtgctagtggccaggtagtgtttatagaaaatctggtctctcttgggataaatatttttaatttttaccttttaaaaaagagaacatctttttttttttttttaagacagttgggctctgtcacccaggctggagtacagtggtacaatatcagctcactgcaacctctgcctcctgggtccaagcactgctctcgcctcaaccacctgagtagct

SEQ ID NO: 156316 - DNA, 227 bp, Homo sapiens
gccacggctgtaggaactcaactactgcttagactggacagtggatagagagagggtgaggagtacacacccagaacattctctccaagaccccttggtcatgctgcagggcagaaaagggtaaataatggctgtgggaggacagagggagaaggcccagcacaccagaatagacatagaaggtagaatacaaaattcacatgagttttaaaagcatcacatcagag

SEQ ID NO: 156317 - DNA, 159 bp, Homo sapiens
attcatctttcagtgaacacttgggttgttccgcctcttgctattgtcagtaatgctgctgggaacatgagtgtccaagtcactgttcaagatgccgctaatttttgagatctgtgtttgagctaagtgaagctgttgtctcctggcgatcccaaatag

SEQ ID NO: 156318 - DNA, 148 bp, Homo sapiens
taacatcttacattcacagagcagaattaccaaagctaagaaattaacattggtaccacactactaactaaattacaggctttattcagatttcagctgttttcccacaaacatccttaaaatattttaaaaaattaatttctccacg

SEQ ID NO: 156319 - DNA, 172 bp, Homo sapiens
gaaggaaaagtataacaacaaaaacctgtcaacataattttctattcccagcactccaaaaaagcaaaatgatactacttgaaaatttggatttacacgaaggaaaaaagcacatgaaatgacaaatatattagtatatataaaatacttgtcttatttttaaaaatctctc

SEQ ID NO: 156320 - DNA, 730 bp, Homo sapiens
cattaatctgttgtcctactgatattctgttcttcaatatttaaaaaaatgtattataaaataaatattgcttttaacattactgccatattaggctccttctgagtcaactgattaaaatttatttaacatacttttttagaacagttttaggttcacagcaaaattcagcagaaggtacagagattttccatatacctctgctcccacgcatgcatagcctcacccatgatcagcatcccctgcgcgagtgggatatttgttacaactgatgaacttatactgacacattgtcaccaggagtacattagggttcactctccgtgttgtgcattctatgggtgtgggcaaatatataatgacgtgtattcacccattattgtatcatccagtatagtttcactgccctagaaatccttatttatataacttttatgaatatttggttttttagggtaaattctggatgagcactgctaagtgaaaagatttgtgcattttattatcagaatgctctgatgctgtttcacaaatagtttataagcaactgtgaataatggaaagacttttgaactgtgggtattctcataaaaaatggaactcccagctgggcgcagtggctcgcaccagtaatcccagcactttgggaggccaaggcaggcggatcacctgaggtcaggagttcgagaccagcctggccaatgtggtgaaaccccatctctactaaaaa

SEQ ID NO: 156321 - DNA, 602 bp, Homo sapiens
agtgcctatactagcacttcatacacagcaccctgcagtgtaggtgctggtctcattgcataaataaggaaacaaggtcatacagtaagtggtagacatagggtttctatctggtcccagtccagctctgactgaccctaaagggtccttcttcacttcaccgtgtggagaccctgcttgcttctcactatagtgcagtggaagtagagcataatcactcttcctcccctcccaagtctcaacttccaatatgaaattgtgctttaagtccttgtttgaaggggcaagtgagatacataatacaaaagaacagagtagttctcaggagtttggcacattgtttagaaacctggactctggcagctgtacttctgacctcattctcctttgcagaactcagccctcccttggttcaggtaacactgcaggagtgttgattctccttatacccttctaccccttctttctctagaagattttgtttcctgagacttctgctaacccccaccaaaccaggagctccttctgagcaggaatttgtctccctcatcttatagcctcagcatatggcacagtgacctgcacagaggaggcaaccaata

SEQ ID NO: 156322 - DNA, 463 bp, Homo sapiens
gctccccctcctcagggctcaggccttagggcttggattagaagccacaccagtgactcccctggttctcgggttttcagactggaactgaattacaccaccagctttcctaggtctccagattgcacacagcatattgtgggacttctcagtcttcataattgagtgagccaattcccatagtaaatctcctcttatatgtctgtatgtattttattggtttttttctttggagaaccctgactaatcagtgttatatctaagaaaccattatttaatccaagattagaaagatttactcctctgttttcttctaggagttacatgcttttagttcttacagttaagtctttggtacattttgagttaatttttgcatatggtgtgaaggagttcaacttcattcttttgcacatagatatccaatcatctctgcaccagttgttgaaaggactattctttc

SEQ ID NO: 156323 - DNA, 1334 bp, Homo sapiens
agaggaagttgttaagggagaaaaataatgttacagcatacttctatttttgtgtgtccacgtgtttttaaaggagggcaggggggaaaaagcatagagccagccaactatggcctagcaaaacagtcacatttcaacctctgttgataaaagttataatattctgaatcttacactgcttattgccattgtcacaccccaccactatggggtatttgagtttcatttatctactataaaatgttgtcattttgtattttgctgcttggaaaacgatctcataaaatgggtttaaaatgattagcaaacaagtctattttgcatttgttgttatttcactttctaaacatttttgaaaacacctactatgatgcagatattgagctaaaataactgaaacaatctgtgcctcagagagtttattaaacaatggagtagaatacacacattattacaatacagtggaaactattgcagtagtcccaaagagagagaatgtgggctaaaattaaggcttcaagaaacatcttagacatggaactcagcctcacataggccaaaaacatgtgagtccccctagcataatcagctagccatattaaggaaaaaagctaaagaaaaatgtacaggatgctcctcattttgcgacggggtcatatctccataaacccatcttaagtttgaaaataactaagtagataaaaatacctcctgaacacaacttagccccgtgtagcctaccttaagcacagtcgcttacattagcctacagttgggcaaaatcatctaacacaaagaccattttacactaatgtgttgaatatcttatgtaatttatgaatactcaaaaaaacggaatggttgtgcaggtattcaaaatacgttttttactgaatgaatgcataccacttttgtaccattctacagttgaaaaattgtaagttgaaccattgttaagttggggaccgtctgggtttttttgtttttgagatagagttttgctcttgttgcccaggctagagtgcaatggcgcaatctcagctcaccgcaacctctgcctcccaggttcaagcaattctcctgcctcagcctcccgagtagctgggattacaggcttgcgccaccacacccggctaattttgtatttttagtagagactaggtttctccatgttggtcaggctggtctcgaactcccgatctcaggtgatccgcctgccttggcctcgcaaaatgttgggattacaggcgtgagccaccgcgcccggccttttttttatttgagacaaagtctcgctctgtctcccaggctggagtgcaatggcatgatctcgg

SEQ ID NO: 156324 - DNA, 163 bp, Homo sapiens
tctttggcaagtccagttgatctatttccttctagctctcaatatatggcttccccacaggtatgccagaccatttatgctgcttcttaaggtctgtccatcagggaacggtccatctggttgatcacaacaagacatcagcatcatcacgtgctattcgtct

SEQ ID NO: 156325 - DNA, 399 bp, Homo sapiens
gcccagattcccctaatcattctattgactttggctccctttcagggtaactcaggtatttcttcactgatgttaatgaatgcttcattttgaaagcacaattagaatttgcaatttgggggcaccgacaccctttaaaaattgtaatgttcctaacgttgctggcaataaatataccttaaaaaattcagttaaagggataagttactcaactaggatgcttccattttagttttaaatttgtgtgttaatgacttctcaaatatttcatttcatgaactcccctcagtcttccctctaattgtcttataggcaataagtgttattggtttgtttgttttaccagtgtctaagactatttgattgtggtcacgagagtcttaagtgtgacatcactga

SEQ ID NO: 156326 - DNA, 445 bp, Homo sapiens
cccatgtgatcatctcaatagatatagaaaaaggatttaaccaaatctcacatcctttcgtgataaaaactttcaacaaactagaaatagaagggaacttcctaaacctaataaaaggcatctatgaaaaacccacagctaacatcatacttaactgtgaaagactggaagctttccctgtaatatcagaaacatgatatggatgttttctctcaccacttctattcaacattttactagaaattttagccagggcaattaggtgagaaagagagttagaaatgagagaagtggaagagagaaagagagaatccagattagaagaaggaagttaaaactacctctattagtggatgacatgattttctaaaaaatcctaaagaaacacacacgtgcacacacacacacacacacatacatacacacacattattagagttaatga

SEQ ID NO: 156327 - DNA, 346 bp, Homo sapiens
atattacatggcaaaaggggctttgcagatgtaattaaacttaaggattttaaaatagggacgttatcttggactttccaggtagacccaatctaatcacatgagcttaaagagagaactttctccaactaaaagcaaaagagatgcaaaaaaaaattccaagtgtaagaggaattcaacatgccattgctacctatgagatggaggggatcatctgacaatggcacaaggaaacaaaaagaggctctagaagccaagggctgatccccacctgacaggcagcaaagaagtgggcacctcagtcctacaaccaatcacaaggaaccaaattttgccaataacctga

SEQ ID NO: 156328 - DNA, 448 bp, Homo sapiens
acggaggaggtgatggtgctagcgttctagaggacccagcactggccgactccttggaggtcatgtccactttttcacactccttgctaactgaagtagccaagaacctaggtttgggaagacaacctttcttcagataaaaccacaagtaaaccagaccagacttaagagaatctaccttattataaggaccccagagatagtaattccaaaagctactgaaaagaaacaaaaatgtttagttactgtttactggaaaatctccccaacacatatatacaaattcaattctaatccctgattttaaaaataagcctgttatacagtctgcctggcttgacaaatttgacttgggggcaccttgagtgggcggagggcaatcaaagtgataggaagtgatgtcccagcgccactaaagccaagacaccacctaactgctcacagcgac

SEQ ID NO: 156329 - DNA, 443 bp, Homo sapiens
gtcctaaccttcctctggtttggtgggtggtctgaaagttttcttcttggcaaggtcatgtccactttttcacactccttgctaactgaagtagccaagaacctaggtttgggaagacaacctttcttcagataaaaccacaagtaaaccagaccagacttaagagaatctaccttattataaggaccccagagatagtaattccaaaagctactgaaaagaaacaaaaatgtttagttactgtttactggaaaatctccccaacacatatatacaaattcaattctaatccctgattttaaaaataagcctgttatacagtctgcctggcttgacaaatttgacttgggggcaccttgagtgggcggagggcaatcaaagtgataggaagtgatgtcccagcgccactaaagccaagacaccacctaactgctcacagcgac

SEQ ID NO: 156330 - DNA, 533 bp, Homo sapiens
aaccattagagtgatgggcccacgagccaaggaacgccaaagactcccagcaaaccaccagaagccaggagacaggcctgaacagattctccctcccagccctcagaaggaaccaaccctgccgaaaccttggtctcagacttccagtctccagaactgtaagccaatacaattctgggacctaagaagccacccggtctgttactttgttatggcagtcctaggaaactaagacaaaacacatctctaaaaatataaatccctggtctcaagaactcagggtatgaagaagcataaatctgaatcttgtccaagtggcaaaccactgctcacagccctggttccttcctgctctcagcgctctcagctcacagccgtcatgcatccgaagaggttgatatgtgtgagaaagaccgaaggaaaacaattgctcatttgattccccgtaatcttcagtgatgttccctatctgtttacccatgacaagagcaaatcttatttcctgacatcttcacctacttaaccaatgaacc

SEQ ID NO: 156331 - DNA, 569 bp, Homo sapiens
  misc_feature (126)..(126): n is a, c, g, or t
  misc_feature (143)..(143): n is a, c, g, or t
  misc_feature (176)..(176): n is a, c, g, or t
agaaagaacaagctcactgaaggctcagaagattgcatttttagccataaaatatgttttaattaagatatgtacactgttttatagacataatgctatagtgcagtttaataggtatagtatacnagtatagtataacacanacttttatatacacgtggaaaaacaaaaaaatngtgtgactcgctttattggatatttgctttattgctgtagtctgggaccaaacctgcaataactccaaggtatgcctgtacaagtcaacttttccaagcttccattgagacctgcagaggagctgcttgagttcccatggccaagtgctgggattagaggcgtgagccaccgtgcccagcctttccttgctttttaatgtgtttttctgtgtccctatattgatgtctctgtattcgatgaaataatcagtgattccaaatttcctagtgtgcctgttctagaaaaagactttagagtttcattttattgtgccagttgggaatagtgtggtgattttgcttatggatgagtgtagtaatataggctctgtgcagacttttctcccttttatt

SEQ ID NO: 156332 - DNA, 321 bp, Homo sapiens
tagttcagtgggaccacaccagaggtcctcataataatagtgtgtcctctaggaatgccctccaaccaccaagtggtgggggctttttttgtttttgtttaagtttatacagagacagtttcgctctgttgcccaggctggagggccttgaccgcctgagctcaagcaatcctcctgcctcagccctccgaatagctgggaccatagacatgcatcatcacacctatccaatttttctattatttgtagatacagagtctcgctatgttgcccaggctggtctcaaactccttggcttaagcactctgcatgcctcagcca

SEQ ID NO: 156333 - DNA, 578 bp, Homo sapiens
gttcaagaccagctggcaaacagggtgaaaccctgtctctaccaaaaatacaaaaattagccaggcatggtggtgtgcacctgtaatcccagctactcgggaggctaaggcaagacaatcactggaactcaggaggcggaggttgcagtgagctgagatcgcaccactgaatgccagcctggtctcaaaaaaaaaaaaaaaatcttaatgttcttcattggctaacttcatataccaagcctacttttagaggaaagaggctgaataatcacatacccctaaagcggtacccctggaaaaagtcagactttgggaacataagaagttggctttctttaaaacgaaaaatgtttctctgtttcataaacaaaaaaggcctgaaagactactcccaggaagaccattaaaatgctgaattcacctagaactaaagttaacattttaaagctggaattcaaaggaaaaaaagcacatatatatctgacttttatagcttttccaattcccaatacaggatttttaaaatcctatttgatgcaatacaatttaacgagattccagttgtgctaaaaataatt

SEQ ID NO: 156334 - DNA, 539 bp, Homo sapiens
gcgtgtggatgtgcgtgtgcagagacgggtgtgtgtggacacgtgtgtgcagagacgggtgcacttgactccatgcgtgtgtgcagagacgggtgcgtgtggacacgcgtgtgtgcagagacgggtgtgtgtggacacgtgcgtgtgcagagacgggtgtgtgtggacgtgcgtgtgcagagacgggtgtgtggacacttgtgtgtgcagagacgggtgcgcgtgactccatgcatgtgtgcagagacgggtgcatgtggacacgcgtgtgtgcagagatggatgtgtgtggacacgcatgtgcagagacgggtgcgtgtggacacgtgtgtgtgcagagatgggtgcgcatgactccacgcgtgtgtgcagagacgggtgcgcgtgattccacgcatgtgtgtgcagagacgggtgcgtgtggacacgcgtgtgtgcagagacgggtgcgcatggctccacgcatgtgcagagacgggtgtgcgtgactccacacgtgtttgcagagacgggtgcatgtgaacacgtgtgtgtgcaga

SEQ ID NO: 156335 - DNA, 263 bp, Homo sapiens
ccctacgtgacccagcctgtttacccctccagtcttgttctcatgttagtcctctcctagttccctacatcccaaacataatagatttctgtgaattcttccaaagtgccactgccttcccaatgttcacacgttcctcatgtgtaggttcctcagcctacatagccattgtgccagggaggcctctcctgactctccagaccaggtgagctctcctgctttgcagtctgttggcaccttgctcttgctctgacattacacgg

SEQ ID NO: 156336 - DNA, 183 bp, Homo sapiens
gggaagtaaagggaatcctcctttttaaatgcatatgcgaaagttaagggaatcctttcactaggcggtaagcctctgtctagggccgtgggaccattaacaccactcgcctcgtagaaggtgtgtgtcattcaaggtgataatgcataggaacagctcagctatgtcagggccaggccatta

SEQ ID NO: 156337 - DNA, 288 bp, Homo sapiens
ttggcctggaaggtctttagaggtgactcctcctctcatgggctcttttgagagttcttctgaggctcctcctgggaacattgaactatatttcccatgacaacacatgttgcattttcctctggctgtttttcccaatggcccgcactatatgggccctctcagttggggtcagtcactttctcatggaatcctcttatgtgggatttcaaatcaatgcagtctggctctctccccagtctgccttctcttcagcctatgaaaaacactcccacattatttgctccg

SEQ ID NO: 156338 - DNA, 347 bp, Homo sapiens
ggagctgaccggagcgatctatgtggttctgtgtatttcatctcttggcctgtgtgtccccatcctaatatccttgaagtatcaaagcattgctaaataaatacccatgaagtttgctacaggggaagccagcaaaaagttcttaatttaaattcttgttttggaagagaacaagcagagagaagagaatgctttccattccctggtttaagtctcaatgaaaatggccatgtgagacattttgggtaaaaatgaccttctttggctcccattttggctgatgtgttcacttcttttccacggattgctacctcccctccctgctgcccccgcctgcaaagagacag

SEQ ID NO: 156339 - DNA, 613 bp, Homo sapiens
gaagaaggctgcaaagccgaaggaaaaatgcgaaaagggtcttgctgcatatcgagctaaaggaaagcctgatgcagcaaaaaagggagttgtcaaggctgaaaaaaagcaagaaaaagaggaggaagctgaggaaaatgaagagggtgaggagggggaagataaagagatgaagatgaagaagacaatgataatgaataagttggttctagtttttttttttcttgtctgtaaagcatttagcccgcctgtacacaactcactccttttctcaaagcacaacaaacaatggacatatggtcaagcgctggtggtaaacattgggtgttcttcaacaccaattacattctcatcttttctcggctatcaattaaccacctattaccggaaaaggttcctcttagatacgccgattcgtctcggcggggctattctttttcctcttgtcatcatctctggaagactgggagtctccatcgggtccacccaagtgctggagtgcaatggcaccatcttggctcactccatcctctgcctcctgggttcaagcgatttccctgcttcggcctcctgagtagctgggattacaggcacacgccaccatgccctgcta

SEQ ID NO: 156340 - DNA, 402 bp, Homo sapiens
taaagaaacttgttttccaagttctttaatgtttcagctccacctacctaactgcttcctccttgctggcaaaactggcatgtagcccctccagccattactcatttttcactcccaggtctcccttcccattctccagtaccagcaggcagcacaaaagggctcttggaattagcatcttgagaaaattaggttgatataatgttgatttaattttctgagctccaaatgatttcctttaaacccctgcctggcagaggagctctgtcaagctgatgggaagtcacagtgtcttttttggcttttgtatacaaatgcctccagcagctggtatctggttattgccttttgctgtcatgaaaatgaagtaggcaccagggttgtaccattcaggttgagggt

SEQ ID NO: 156341 - DNA, 545 bp, Homo sapiens
ccccaggaagccattggtccttggctctatggtccccagacacttgacaaggccaagtacatcgtgcttaaatatcaaacacccatgcctccagaatccaccccaggacccggctctaatgtggatggctgctggtcctttattctttggcccctgtggttaatatcttggcgatttccttactcttacgggaagtattgtcagtaatttaacaaggctgaggagatcagtctcccaggggcagcagaacagaccacagcgctggcccctctgggtctgcctggcacgaaagagacagaacgacatgtttacctcccattctgggctccccctaacattgaatttctgagaagaacccagggcctcctgagaggaggtctctacagcaggttaccttagatcaacctgccactgtctagtggtggctggaggccatcctggccaaaatggggactttgttttagatcagttactcaactaggtccctactagagactctctagaattcacgttggaaacttgatttcaagcctggaataggagaa

SEQ ID NO: 156342 - DNA, 432 bp, Homo sapiens
tctgaccagcttttggcccctttggccattttccagagccagtcctttttccagcaagtgttaagcactctattgtgtgtcttgagctatgctaggcaagagataccttggtctggcttctgccctgagaaagctcacggtctagaaggggagatggatcaataaactgacaaaacagtgttcgagaagtgctctgggagatcactgagtattgtgagaactctaatgggcagcttacctagatgggaactgagggcggccaggagagcttctcatgagttaggtttgagctagatatgaaagacgagcagaagttaaccacatgaagatggtaaggaggggatttctgggcagagggaacagcatgtacagagaggcacagaggaatgggaaagtgtgctgaattaagagaggtgcaaacacaagtccata

SEQ ID NO: 156343 - DNA, 367 bp, Homo sapiens
agcccttctgagacatctctattcccttctctcgcttggtcttcacagcacttatcagaaccctaaaaacccagatttttcattgtctgtctttctggccaggctgagagtccccagggtgcaggctctttgttggaaatgttcactcctctgtacccagtgtctggcacaagatgggtacttccacacatggctgcttgctggcctgacatccactccctcccttcttcctcagttttgttccagaattccatccttcctcacttgactcaggggaagatgactacagccccagctacaggggtacatctcagctagtccaagccagtcgtggtggagcttgccccaactgcagttggtttaggtg

SEQ ID NO: 156344 - DNA, 246 bp, Homo sapiens
tgagccttctagaggatcccaatcagtttacacaaaaagtagaagaagacaacgttattatttgaactaatggttaaatatttgaaggcagaaatttattcagttgaattttgatcaagatcttctctaatatatttgaaaggcaagcctcccttatttccttaatcttctagagacagattgcccaatagaactttgtgtaatgattgtacttttgtgtttttgttgttgttgtgtaaactgatt

SEQ ID NO: 156345 - DNA, 309 bp, Homo sapiens
agtgtgtgagaactaactgcaggcaatgcagcaatcagtttctgatgacatccctacctagtttacctctgtgtttagctgcctgatagagtcactgtaagatactttgttaatgcagataatgaagccagggttgtttgtgctttgccatgttaatttcctctgatcatcatctatcagacttgtattaattactgctgatgcagcccttgttagtctattttgtatgttaattactgagttaaatcacttgaagctagagtgctctctcttcttgactccttcctactcccttcctttcttcgattc

SEQ ID NO: 156346 - DNA, 290 bp, Homo sapiens
atagaggacggggattcatctaagatacaactcagtgatgccgtgtactacttgaatctcatgtatcctgtcgcagcgttgtgccccaaattgctaggatcttctagacttgagctgcagggcctcaaagtgtggcactggtcactcataaatggattctctcactatcacggtataaactcgtctatattgtgggatatggcgtgcacgtgtgtacatgcttaggcgcatgtttctccatgttttcccgagccacggtgcttcttcccccgcaggggctctggtcgatt

SEQ ID NO: 156347 - DNA, 665 bp, Homo sapiens
tgaaactcagtggtctaacaagtagcataccccaaatttacaatatttgtagccttctgctgttgggtacattcatgaaaaggtcttgcatccttaaagtgaaggctgaaagagttttatgtcattggggcgagtgggctaccaagctcccataaattctaggagctgccttttgtctaacgattaggattattgagtactattttgatgccttttgggtatcatctgaaatgtaatcattgaattggaaatggaataaacaagagaaaggctagtttactcattatttgacaatagctctttaaagtagttaatattatgaatattcctactactaaggtttataagagtttgtttttttctttaatgttatactttaaaaagtattattcattcactgggcaaataatttttttttctagaggaatacctttccaattttataacagtgaaggaaggaatgttttacttatagaaactgtactgaaactactgttctattaagcaagggttggagataagcacccctgtcccccttccctgcccaggcacacacatatacagatacagcttattttatgactgtattgttcttgtgtttcttcttctagataaagacataaagattgatgaaataatttacctggagttgcacagtaagctag

SEQ ID NO: 156348 - DNA, 707 bp, Homo sapiens
ggtttgaggtatagagggcacggggaagagtgatggtagatgaagctaaagaagtaggtagggaccaaattttgacttttcttagggtcatagaaagctaccagactgaaagtaacaagatcagattttcttttatgaaagcattctgccatggtatggatgggtagtttcttaaaatttgtctacttgcataccaaacaaggaaaaatgaagcacataccctttgatgcatttgtgtgtacatatggatgtgtgtatatgtacccactaacacagtatgtgtaccagtctttctataaatattttaggatttaaacaaagttgttataaacaatttttaaatgtcttgctaatcatgatgacttcactgccagtatcttattgaatgataatatactttagaagagtttcattaacaatgatagaaagtataaacccatatttcacatagcttccttaagaatttaacctttttttggcctgatttcactgtttttacttcatagtatagtcaatgaagagctcatactagtgatagcagtgtcagttatgcctttttttatgttgctatttgctagtgcttacatttttcatattattctcactctgtaattttttagcaatactcatttaagccagttatttatttggtgagttgctttattcaaattagatgacaatccataaatccaatagataatctatcc

SEQ ID NO: 156349 - DNA, 209 bp, Homo sapiens
ctcactcacctcctcagtacccatgctcttgctcctgctgttccgcctcctgggatgcctgccctggcccacctgaatcccatccatccctgcaggccaggcctaatgcccatttctgtctgttattcatccatgtaaacaaccattgtttgtgaaagcactttctgtccactcagttcaattcagtagatatttcctgcctgtctact

SEQ ID NO: 156350 - DNA, 415 bp, Homo sapiens
cggatggaagagctcgggaaagctaaatcattgatgtgtgcatgtaagaagaatgatatatgtacatagggagataagagtgcaaaacttgtaagaggtgtatggtagagatcctagaacttagtaaacaaatatacttcaaactataaggtaattctcagatggaataatatctcttgggaaccaagggacacagtaagcaaaatgtgtctgttttcctttggatatgcagcattcaaattagtctctcttcagcaatgtgtgttttaaccagttgaaggaaatttttgacagctaggtatcttttttaaacctatttaaaaacttacatgtctctgggcacttgatcatacctggcattttgcgctctgctttccctgtggttttcctaatggtgtattgtttgtgcttcttg

SEQ ID NO: 156351 - DNA, 557 bp, Homo sapiens
cttattttagagggcagaaagggaggaaaagaggcaatgttcttcatcgaataaagctcttcactaaagtgaagtctccctaagcctttacccatgaccatagcctcgctgactgagtggatccatgtctggtaaactgatgcactaatgtgacaagatacccaacatctgcactcatgtgtgctagatactcaataggtggatattgctagaatcagggaagccttcagagacctgcttccatagaaacatagacatctagatttgctttgtccccatctctccagatttgtctgtctcctctgagtattgaaatactgtgccattcttctctgaaccactaaagcctgaccatagattcaccaaatactctttctttggagcccttgctgatcctctagtctacttcatctttggattcctactattttgttttcactgaggctgcacaggcaggccctgattaagcccaagttccagaaatcttttatttgacacccgtatctagtttcagctagtcccctgacttatccagagctaagtccacctgttccttc

SEQ ID NO: 156352 - DNA, 440 bp, Homo sapiens
gtcagcccctatctctcctggggagtggaggctgctctggagtggggccaagatcgggaggcccaggagagaaaagggcctgcaatctacctcccagtcaacaagatgctataataaaaacatagccaactgtcactcagcgtttattacggtgccagatgaggaaacaggtgcagaaccgtggagtaacctgcgcagggtctccagtagaaaaacaggcccttggtcagatgaatttacccacttcggccaccaggggcgctgttggcacagcttgaactcgagaccagcgctgtccaacggaaaccgaacgtaagccacatttctaaaaagtacacaagaaaagtgaaattagtgttatattttctttaactcggtatatccaaaatagtatcatcttggcatgtaatcaacacgacatttattagatactttacttt

SEQ ID NO: 156353 - DNA, 204 bp, Homo sapiens
ccctaataccacacagagtttgtccattagttttattacttaaggggaatctagtgagaaagtggtgtcatgcatttttctgtagaaactattgtgtagtattgtactgtgatggaaatacacagagacattggagaaaattctcaggcagaaatgatgttactttcggacaagttatgtgtgtacatatacgttacatttagc

SEQ ID NO: 156354 - DNA, 228 bp, Homo sapiens
gctaactctggctctctctacatctttatattaaagggtcctggacctgtgattgttgaggtggcagggaaaactgctacctgttcccattcctaatagaaaccatcttttgatgccattcccattgtatttttccacaaaaaatgtatttacagatttctgggactgaaaaattgctgaatttgttaaaagagaagaaaaaggtggcccagcaagatggctcatgcc

SEQ ID NO: 156355 - DNA, 394 bp, Homo sapiens
ccaggccggagtgtagtgatgcaatcttggttcactgcaacctccgcctcccaggctcaagtgattctcccacctcagcctcctgagtagttaggactataagcatgtaacaccacgactggctaatttttccatttttagtagagatggggtctcgccatgttgcccaggttggtctcaaactcctgagctcaagcaatcctctggtcccgtcctcccaaagtgctgggattacggatatgcgttactgagccaggccgaaaccatttctaatgattttatgattcttttattgcattaaagtacaaagatacagttgggtttttaaatagactttatttttttagagctattttaggtttacagcaaaatcgagcggtaagaacagaaagtt

SEQ ID NO: 156356 - DNA, 193 bp, Homo sapiens
tgcctcattcactgaccccatttctacagaactccctaaaccatccctaaaacctgccttactccctgaacctattccctcaggagcccccaaattcttcctataacctgcctcatccattgaccccatttccccagaactccctaaaccatccctaaaacctgccttgctccctgaacctattcccttagga

SEQ ID NO: 156357 - DNA, 344 bp, Homo sapiens
aggggtcagcatttcaatatatctcttgtagggggacacaaacattcaaaccatagcactcacatcattaaaaattcaatcaaggctgggcgtggtggctcacacctgtactcccagcactttgggaggccgaggtgggtgcatcacctgaggtcaggagcttgagacctaggaaggagaatcacttgaacctgggaggcggaggttgcagtgagcccagatcgcaccattgcacttcggcctgggccacagagtgaaactctgtctcaaacaacaacaacaaaaacctcaaacaaaatcaaacaaaatctatccgtggcgttctggtaggaccatgggtactg

SEQ ID NO: 156358 - DNA, 389 bp, Homo sapiens
tcccagggttagatgtcccgtttgtcttgccctttagtattgtgatgtatctaggtgtggatctctggtgtgcatcgtattgggctatcagtaagcctcttagattcatagattaatgttttgtatttgtaattaccaaatttggagagtttttactcatcatatcaacaaatttttttcctgcctcagcctcttgagtagctgagattatagatgtgtgccaccatgcctggctaatttttgtatttttaatagagacggggtttcaccatgttggtcacgctggtctctaactcctggccttaagtgatccacctgcctcggccttaatgttatccaaaatgctggggttacaggtgtgagccactgtacctggccaaaggttcctt

SEQ ID NO: 156359 - DNA, 458 bp, Homo sapiens
agcggtctggggcgggtcagctgggctggcagagcacatgggaatcctctctggaggaaaatgcaggcgataccaggtatgtagagagtgggattggcctgtgcaacctcaccagagatcagcagaaatatacctccctccagcgagagtggaagaaaagaaggcagatttggattcctgaggatatcaggtaaggaaaataaaaaggctgcctgtgaaatgactacataaaagacgaagatgcaacaatgagcaaggactattttccaaatggtgaaatgagcaggaatgttctcaaaatgttaactgtaatggacagaacaaaaactcaatgggggccgggtgtggtggctcacacctgtaatcccagcacttcgggaggctgaggtgggcggatcacctgaggtcaggagttcgaaaccagcctggtcaacatggtgaagccccgtctctactaa

SEQ ID NO: 156360 - DNA, 455 bp, Homo sapiens
ttaatttatggaagtactgagatgaacgataaatcattaagaagccaacactttatacaactacatttctaagtttacacaaatacccatatttaattggcttaactcatatgtaatgctagaaaatattcaaaatactaaagttgacttctaaatacattttgttttcaaatgttttcattatctaaggtttctaaccaatacaaaagagcagttaataagataatgagtttatgtataacccaatacccaactctatcagctttgtcatttctaagaaaacaaaatcatagagtggatgtctcctgtttagcattctcaaacctaattccctttccctgttaatcagaaatagccaccattctgaactttagcatatcaatttaaagttattttagaacattttttacatatgtaggtaaccataaacaacgtccagcattactttgcatatt

SEQ ID NO: 156361 - DNA, 572 bp, Homo sapiens
ttgaacctgggaggctgagattgtgccactgcactccagcctgggcaacagagtaagactgtctccaaaaaataaaaaataaataaaaaaaaagggggggtggtgaaataccttcaaagtactgaaagaaaaaatgtctaaataaatttaaaagtattctagtcatgttttctggttatgatgtaattaaattagaagttagaaaggtataaggtataggaaatattcccagaatatttggaaactaaataacacacttctaaataacacataatcacaaaagaaatctaaagggaaaacacaatgtatcaaattttgtgggcctggcatggtggttcacacctgtaatcccagcattttgggaggctgaggtgggaggctcacttgaacccaggagtttgagacaagccagagcaacatagtgtgacccccatctctacaaaaaatttaaaaataaaaaattagccaagtgtggtagctcatacgtgtagtcccagctacttgggaggctgaagcaggaggatcgtctgagcccaggaattcaaggctgcagtaagccatgatcacaccac

SEQ ID NO: 156362 - DNA, 208 bp, Homo sapiens
ggggagccagtctatgcacagaatcaaggggccctctgccaccatccccctccctgacggcagaattccagcagctgagcctacgcctgattcctgctttccagcactttcccagggcagcaagggacagccactttgtgtaaaaagccatttaatactatttgatttctaagctatgtgcaatacactatgttaacatatatatata

SEQ ID NO: 156363 - DNA, 545 bp, Homo sapiens
gaaagacttaattagggcttgttcgtgctgtcgtctgggagcatttcctgtggaagggaggggcgagagggggagtgagagagattctttgtcaagctgaaaaggttatgcaggtgcatgatttgctttcagcccttgccaagtcacagcatattgaaagagactacagaatacaattttcattgttcacagcatgctgccagcatggaacactacacatcccagggaagagtctgaggcgccacaaaagctgagagccaagctcctggctgtgaaaatcgctccccactattcgtcatcatcaacatcatccacagaacttcgttacaccacactcagttacactttgctccaaactgagagaggctctggggcagaattcaagtgaaatggcaaaacctgacttctgccttctttgatatcactattaagatatttggacagaggcagaggtaggggaagggacctctagagggagcagaacaaaacagaaaagctggctgtaaaaaaaacggttgtcatccgcaagtcaagaataggccctg

SEQ ID NO: 156364 - DNA, 138 bp, Homo sapiens
ccctgtactgcccctcctctccaagcacacatagggatagaagagccccattataacacagtttactattgcacagatttaagttatgtcacaggtcatatatctctgaaaacatagcaattacattcacatgtgtat

SEQ ID NO: 156365 - DNA, 697 bp, Homo sapiens
gagttcgagaccagcctggccaacagggcgagaccccatctcaaccaaaaatacaaaaattagccaagcgtggtggtgtatgcctgtagccccagctacttgggaggctgaagtgagaggactgcttgaactcggggtggaggttgcagtgagccaagatcgccccactgcactccagcctgggcaacaatgcaagacccctcaagacaaaacaagcttatttgatgggccttaaggaatattcctgtactccaactgttatgaaaataaaagagagtagatgaaaagatcgactacacagctacaagacttaactaatgtaagatccggaaaagatgtttaggtgatcagggtggcacacttgatggcaggtagggtgcatcatctgagactgagggtataacccatgacagtcagtggggttgaacggagtccacaagctctctgggtggcctgctccattggcaagatgagggccacctcctctaagaattcttcatatctttaaaactgctctcttcacatttttatgttttttccaaatttattgtccttcctcaaagacactatgttgtgtccatatagaattgattattacatgattcatctagggaaaagcttgagtagaaagtgagaaaaatgagagaaaacaatgttaaacaactttaacaaatattaatgtttcacttaattcatt

SEQ ID NO: 156366 - DNA, 589 bp, Homo sapiens
caatctccatcccagttttaccttctcctaagtatctacatctcatttcctaatggatgacccccaggcaccccaatttcagcacaattaagataaattttcatcatttcccctaaccagctctttctgctgactcctaactcccccagtgctccaggctcaaagtcttaatgggatcttagaattctccctctgctctgccttcagggacaagccttcagtgaggacatgtcctgtcacatccccaacactcactccttgctcacccagttggccactccaaccttcccaatggtgtgaacactcagactgaacttgaggtgctttcctttcctcatcagacacacctttacagaacacctagtcagtgccaggtactgcagggtactctgtcaaactgggtttctgcagggagaagcaagcagaggcccaagtcagtgccatggaaaggtatttgaatgagggccacttcccatccaaatttgtcacccttcatcacctcacacctggatggctacagtttcctaattggcctccctgcctccaatcttccttgcctatcaccaccgttcaattttcttttctttct

SEQ ID NO: 156367 - DNA, 448 bp, Homo sapiens
cttgaactagttctttcaaagatgaatgggaatgagggttttcttagcttggactttctttgtttggaattttctggaaacggcaagtagtttggtgtggctggaaggactggtgtgagtcgtggaatggtagactcgagtgtggtcagatacgcctaggtcagtcgtgaatagtcttgtgtgccctactgatgatcagagtccttgaagactttaaaagcaggattgaggcatggcatacttgttttgagaagataataggcagcggtgtggagaatgtatcagagtcaggaagaaactgagaccaggagagattagttacaaacagggtcctacccacatggaatgcagagcctatcaaagaaggtgaaataagttgcaatattgtacaataactacctcctgccgtgctccgctttccctcgcacgcagctattcctccctcctc

SEQ ID NO: 156368 - DNA, 1058 bp, Homo sapiens
tgcgtaggcaggcatctgtgcatctgtgctgtgtgtatgtgctgaccatgtgcaggctccccccatcaacccccgcagcaatgcagggccccctccctggcctgcctgtgtcgtgggagcctcaggaccctgagggagggaagctgttgctggcggatgtggccaagatgggctggatttatttagattaaggcggtgggaaaggagtggagaattgtacgtgctgggaggagggaagtctggggctctgagaatgactccccaagcatgcttgctctcctggacttggggcacccactcctctcccctggacttggggtccttactctgctcctttgacttggggtccccactctgcttccttttgacttggagttcccagtctgctcccctggacttggggtccttactccgctcccctagacttggggccccccactcctctcccctgaacttggggttccactctgtgccccggacttggggtcctcactctgctcccctaaggggtccctctgagtcacgtgaggagctgggcatgatctccactttgggcctctgagcctacaacctggccagaataggaggaatcaggaggggttcctggcacatagcactctcttcatgggcaaaagggggacacctaggggtgccctccctctctctgctctagaggcctccctgggcaggagagtacagcagatagggggagtgcctgctctctgactgtgacatccagcttgtcctaggtggcccttccctagagtacagtcctcctaaagaggggaagttgtcacaggcaagcccactaccaccaagtcagctgcctgggcctccctgggattggctggaaccagaacagcctctgggaagcacaaagaggcctaacacatttggtggaaaatgtggggtatcagggagtcatccaggatggcctgggaagtcatgtctgggtgccctaagcccttctctgccctccctggccctccagcctcttgtccctaccactctttccttgccacctcctggggttccacgtcaccagcggaaagtcccct

SEQ ID NO: 156369 - DNA, 603 bp, Homo sapiens
ctggcaagacccaggttcagtgtgagaccaaggggaggaaagagtggatagccgtctcaccagttggcataggttggaactcagaattaatttcaccatagaaattgtgccctaatagtgattaagtgctttaccactgttaatatattatttcaggtacttttatttgaggagaggggaatggtgaggaaaacataaattgcctgcagttagaaaccatgtgctttgttgacaaaattttgatcctctgtgttgccccattttcagatactctttttcataaaattgggaaaaaatgggaataaatgaatattaattttctgcggcagtgaataactgatgccatctcagtccacttgtgcattaaaaagagaaacattctgtggttccgtgcttctcatcaatagggtcttttacaaacatgttactgtacgtggctgatttcgtttactagacaattctgaggaaggtatgagtgcttttagacttggccacgtagtaactccaatttatctagatcacaaacaataggaaagttcaacagtctgggagtttccaaagccctataccatataatggtaacctttgaatcagaaaaaaaaa

SEQ ID NO: 156370 - DNA, 223 bp, Homo sapiens
tagaatcttaagcacgttaatgctacttactttgaccaacgtacgctggatatttgtaaaatgtatacttgcccttatttagacaaaaaagaaagcccctcatgtttgttctaaaaaaaaaaaacccacgaaatacaatcccacacaagctaccctgactgcacagtaagtacttttccagctttggccagagcaaactaataaggtgcagtttttttttaaa

SEQ ID NO: 156371 - DNA, 290 bp, Homo sapiens
accagctctctacacctgccctgcaaccaagggtatcttctcaaagcacaagtctgatcattaatgaagctcttctctccacagccttcgggggctccccatcaccctgagcatggcacaggggcccacacacccatcctcatcccctccacaccttcttctcccactaggtgacagggccctactgacctctctacagaaccacttccagttctccagcactcgctggtgcatttcacatgccctggacttcgcgctgttacatcttttgagactgcctttcccctcct

SEQ ID NO: 156372 - DNA, 274 bp, Homo sapiens
acagatactcactaagcactccacagctctggcctgtgctagaagacaaggactcagtcatgaggagggcacaggtggtgccatctcctgagttacaagacagtcgagggagatgtagacaggatctgacccatgaatgaagatataattcccaggtagctcactaagttgagaatagttgtacaaagagaacacttaagggaaaggcggaattatatgctctatggaccgtgaggtggtaggatgcaagaagttttggcaaaactgaaatgag

SEQ ID NO: 156373 - DNA, 132 bp, Homo sapiens
ctgcctcagcctcatgagtactgccacctgagtagcaccacaggtgtgcaccactacacccagctaatttttttaaaaaaattttgtagacatgtgcttgctatacttcccaggctggtctcaaattcctgg

SEQ ID NO: 156374 - DNA, 330 bp, Homo sapiens
atatttctcccacccccctcaagagatcacgcagtggacgttcccgagtttcttcctgttctcagcagtcggccccattggccccagggaagggtgtcctggctccccactgtcttcctcagttgggcagctccgccgcgtcctcttcttcttggcctggctgacttctgctgtctctcctcagatttctaccacgcagaacgcgcctcatattaggcgcgttctgcgtgcgtgtgctgcgtgtgtgcgctgcgtgtgtgcgtgtgctgcgtgtgggatcttcacatcggtgggagccttcggaaagcctgtcttctgacatgggatgac

SEQ ID NO: 156375 - DNA, 305 bp, Homo sapiens
agaggaatggggatagaggggaggtctggattcagaagcagttcatagatgacttgatagttaactggataatttggtgagggagaaggtagaatccatgggtaacttaaagcttctagctttagtgtctaggtgagtgttgatgtcaccaagacagaaaagaaaaggaatagacttgttgcagaagataaagtgagtgtgcagtttagagtacagtgtgtctgaggagcttatagaacattgagttgggaaagcatagagtggtgattctcaaccagaggcaattttacctcccccaccccctg

SEQ ID NO: 156376 - DNA, 249 bp, Homo sapiens
cacatttgaacatgagtgtatgtgatggtcagggaatttcaagggaactaataaagacaaagcatcagtgagactgcattgaggacatactgccatgttatccaacagtgtttactaggaagggcagtcctccgagctggttatagatgcctggcttccatcttttgtaggagtagagtgaaatttagatctacattcatctaaatttataaagcacctctggataacaccctggacgctctcatgtaa

SEQ ID NO: 156377 - DNA, 546 bp, Homo sapiens
  misc_feature (103)..(103): n is a, c, g, or t
taccccattatgtgaacacatggtcacaaaacacaataaagcaaaggcaggaaacaagatgtatcagtctttgatagactctgacaatctctatctttgaatnggtacattcataccattagcattcaaagtgattattgatatcattggattaatatctactatatttgttactattttctattcattctcctcagtctcgattcttttgtctaccactctttttctgaggttgcagtgagccgagattgcgccattgcactccagccagggcgacagagcgagactcggtttcaaaaaaaaaaaaacaaaaaactggcaacttcagaattatgtccatgttggcgggtgttttaactcaaacggggacataaatcctagggaagtaacccatatcacggtggttctaataacggcattttactattgaccatgggccttaaggaagtcatttagctcctgttagcatcagtttgctgatttgtaaaatggttaaacagtagtatttgccgtctacaagtcacaaagctattgtgaagatcaaat

SEQ ID NO: 156378 - DNA, 624 bp, Homo sapiens
tttgcggagacagggtttcactatgttgctcaggttggtctcaaactcctggcttcatgtggtgctgcacttcagtctctcaaagtgctgagattacaggcatgagccattgcacctggccttgttgttgttgtttttttgtaactgtagttagtttatcaagttatctattgatgaatatttggttggttgtttccagtttttgaaaattataaagatgattaaaatcatttatgtgtatgttttgtatgagcatatgttttcattcttcttaggtaaataccaagaagtgcaattgtttatatgtttgacttcattatttaaaaaaactgacaactgttttcaaagtgattgtaacatttcacattcttaccagcagtgtagaagagttccagtttcagttactgatttctaattaaattgcattttgttggagaagcccggtatgtgatttcaatcctgctggatttattgagactagtttcatggcccagcatatgatgaacgttccatctgcactgaaaacactgtttagtctgccattgcagggtggagcgttctgtaaaagttaattggatccagttagttgatagtgctgttcaagtcttctgtattcataccagt

SEQ ID NO: 156379 - DNA, 550 bp, Homo sapiens
atgccctgaagattgtggatttgtcagtccctgtaattgcatgagccagttccttaaggtaaatatcagtatctacccccacccccaccactctctctctcaatctcaatctcagtctctctctctctcaatctcaatctccctctcaatcgccctctccctcttcctcttcctctccctctctccctcttggttctgtttctctggagaaccctgactaatgcagataggaagataaataaatttaagttgtttggctccagttggtattagcagaaagctgcatcaggcttctctaggtgttcttggtgtgtgcgtatattgctttttgtatagatgagaatagtgaaatatagaagggaagtgatgtacccacagtcatgcagacagttgatgggagagccaaggagaaaactcaagtttcaaacctctggtgtagttcagtcgctttcttgctatttggccctcatgtttttattagcaaggtaataaagttattgagtttgccatgcgtaattattggtaatgtttatggaatgttctctgtatg

SEQ ID NO: 156380 - DNA, 341 bp, Homo sapiens
tggccaagtacagtataggctggaaagaccttatctgaaggtcagaaacattgactcagaaaaaaggtatgaagtctttccataaaatcttttcacaatattactcctatttcttttagattttaatgagccattacttatctcttcagaagacttaagtcttcctttatactcagtgaaatttcccagaatgtaatactgtcactgttctgccaagttccaatcaccaagatcatgattacgaatcccaatctgaattctatacccatggtgactctgatgctctcaacttttgagtgcctcaaaaaatgctaaaactttggctgggcatggtggctcac

SEQ ID NO: 156381 - DNA, 530 bp, Homo sapiens
aagattgtttacacaatgttcacactgctttccaacaagaaaaagtaagattgtaaaaagaacaaattccaaaacaaaacctacccaggtctcctgtctcctcctctttgctctctttgaaaaagcacaaggtggcccttgctggagggacaggagcaatgacagagctggaatggtggggaggcggctggtagtatatgccacatcaattactagtcctcatgctcaaagaagtcaggagaccagagcgctctaagccatgcattcagagggccagggcagacagttggtgttccagaaacagccagtaatcagagttgcagcctgtgacttacacctctggccttccacagacatttctattttcctgagcctccatttccttatttatacaagttccccaatgtgcagggtcttggcgagaaataaataataaaaacgatgtgtatcatcccaggtcagggtggcccatctgtgacactggcactaaataaactccaagatggttgtgtaaactgattaggtggctt

SEQ ID NO: 156382 - DNA, 213 bp, Homo sapiens
ttttgagcttaaagtttccttcttgtaaaaaagttattagtacttgtagacttgttacaaggaatgaaaataaggcacgaggcatgcctagcacatagaaggcattaaaagccataatagcctataaaaatggccaccattattatatttaatagactggaatttcttaccaatatccaactgggtccacatttccttttccttgtatttctc

SEQ ID NO: 156383 - DNA, 468 bp, Homo sapiens
ctcagtgggaaagttcagaaaccagattcctaggtttggagctgagtttgaattcacaaagctatgtccagagtaattggtcaggagcagattcaaaggcagggaacactatagtagtcaggactaggcctcaggtaaagtggcttcagcagtctaccctgagcccaaggaaaacaccagagagagggagagtgaagggtcctagccagtgtagtttggacggaggctttccagttccaaaccatcctgccaacttgccaatgcttcattacaaacaaccctggggtcctgaagtcaccatgattttatcctctgtgttaaaatcctggtgtttaaagttgaaacttttttccttatggtggccccactatcttccaacagctgagctgaggtagattgaaaattcatttgagagtgcatacatgctgccctcatggtgcctttcttcttcttttagctccaaggcac

SEQ ID NO: 156384 - DNA, 220 bp, Homo sapiens
ttgcccaggctggagtgcactggcgctatcatggctaaccttagctttgactcctgggctcaatccatcctcccacctcagtctcccaagtagctgggatataggcatgagccaccatgcccagccagtttttgtgctttttgtacagacaggattttgccatgttgcccaggcttgtttagaactcctgggcttaagggatccacctgcactggcctcc

SEQ ID NO: 156385 - DNA, 259 bp, Homo sapiens
acagttttcacagtaaatttcaacattttatcccatttcattcttacagaaattctgattcctattttataaacaagaaaactaagtttgaagagagcaaatgactttgcccactctatggagggagaagcaggactcgaacacagaacccttgcctccacatagcagtgcccctgggtagcaccctggggcaccttcagacttgccctaaacagacacattttcctccgtggcctctcctcccttcctaggttagccc

SEQ ID NO: 156386 - DNA, 760 bp, Homo sapiens
gccaccgcgcccggccggcctcatctcttaatgggacaattgcagtcctaattagctcactgcttctattcttgcctcctctattccatttctggttttcattccaaagccagaaatgaaatcatgtgatataccccatgtataaagccttcagtggtttcccatttctagcattcagggtctttgagtctcaggtaaaagaaaaccaaacccaaactgtccgaaggaaatggagataacatgatggaagtccagggataacctgctttaggtgcagcttgagccagagctcaaataatgttattactaatgctgggtttttctccttgatctcccaagttggttccagtctcaaattggttgtcctctgatagttatgattgcagcaactctggcctgacatcaggtctggtggaaaaagagagagtgagttctttttttcttgtggaactttctgcagaaattctgaagctcactgtgagttggcttgggtcatgtgtccagctgttaaccattgctatgaccagggaggggaaggtggtcgattggcttagttagacctgggtcaggtgtggaaccccattgacacatcatgtcctgaaagtggggatcatctggattgcaaatgaaaatagtgttctttttaggaacagagacaatggctgctagggggaaacaaatcagttactctctaatatgctccagtgcttaaaataactttcaaaaatcctgaccaggaatggtggcatatgcctgtagt

SEQ ID NO: 156387 - DNA, 293 bp, Homo sapiens
tagctcaaaccgatagcttaactgaatttcaaaggtgaaattcagcaaagaccaggccgacttgtcatcatttacatttaaatcaagtttaattttccactttctaaatatctggcactttttatcagacacacaaaaaaatctctaaaatgcaaactcttcaaagaggttttctgtttctaaaagtagtgtatgcccactaagtagaatctcgttaaaaaacagaaaggtacgaagaaagaaagaacaatgaggccaggcacggtggctcacgcctgtaatcccagcacttt

SEQ ID NO: 156388 - DNA, 341 bp, Homo sapiens
agagatccacagattctttcccgcatgagtctctaagttaagcactcaaaggcaaacatgcctttccaaagccttcttgccttggctcctagccagtgttctctgtaatctcttccactaacgttcacagagtcctaaactgatctgtggactgctggtcattgcctccaatccctctgtcatttctaaatcaacatgtttaagccaaactcatcctccaatctcctatagaccatcagcctctcctgcaggtcacctcatgcctgtgaactatttcccccattcttccaggctttaaactttaaccacccacttcccaggcaggttgggaaaatgagaca

SEQ ID NO: 156389 - DNA, 463 bp, Homo sapiens
gtttcaaccaaaaggccacaacccagatcacattactcagagacagaaatcctctcatttagtgtgaacaggtacgctacgcaggctttcatttcctataatagccttaggtcgcttagtcacatggaaagtggagcagaaaggacggttagatcacgagaggcaattctctccaacattcagctctcacggcttctctcactcatgaccgcacacatgacctgcttttcccctttatctgtatttaatataaataaggtaccttaaatggatttagtatttatgtgtctgttaatacatgactatctcagaaaccccaagtcagtcttaaatttgtaaagtacccaacacagaggcacttgatgaagtcatttgattgtgatggcttgcactctccaccatgctgcccaaatcatagctttgatactacctggtactcgagagagctagtcctattttctta

SEQ ID NO: 156390 - DNA, 361 bp, Homo sapiens
tgtgtccccagacccaccatctctgcctggttgactctttttcaagccttggttcaaatatcacatcatttggcaaccctttcctaatccgcaaacagcaaacagagagtcactttttttttttttttaaagacagagtcttgctctgttgctcaggctagagtgcagtggtgtaatctcagctcactacaatctccgccacctgggttcaagtgattctcccgcctcagcctcccaagtagctgggattacaggtgtgtgccaccacgcccggctaatctttgtatttttagcagagatggggtttcaccattttggccaggctggtcttgaactcctgacctcatgtgatccacccgcc

SEQ ID NO: 156391 - DNA, 495 bp, Homo sapiens
ggaccgaatgctcttcgtggcgccttcaacaggagtggctcacctacttttgtatattggtgaggatggtaggggagtgggggcattttgcccttgctttgaaaaaattcaagagtgctatctggacttcctctctcttcagccgtgcagttcagtagaacaaactgggaacagtttgggaattgtttacaccatgggcattggcaaccctgtcccttcatagaattttggcttagttctagacacactgaatgccttgagtgtgaggattaactctgatggttctgttttaactttccgaatctttaggtattggcctggagtgattccaagctctcctggaacaggaggtgcccccactctgggcataaatatctctccctcatccctcgcagacaacgatctttgagtaccatccagtcataatatagacatggccaaggtaacggaggtaaacagaaaacaggaaaaatactaggctgtttgcactggaac

SEQ ID NO: 156392 - DNA, 580 bp, Homo sapiens
cgtctcagccctggcctgagaaccctgctcactggatgccaggcaacgtctaggagggggaacccactgggaggatccctgctcatcagaccttctgaaggtgtgtaaagcccaagagagaaaagtcagaagctgttctgcccactggaaggggtctggttgcccctgcaggacagagtgtcccaatccccttttggagtctaggtgcatgatcctttctaagagcaaggagaacactatcacgaatggcgaaggggcaggccagtaacacccctgcactccacacacacccaggaagtgtcagctggaggattaggacaccctaggtcaggtttttcaacttcagcactactgacatctggggccagataattctttgttgggtgggtggatgggtgggagggaggatctgcagattgcaggatgtttagcagcatcctggcccctacccactaggtgctagtagtatacatccataacaccctctcaagttgtggcaataaaaaaaggctgcggatattgccagatgtcttctagggggcaaaacggcctccagttgaaaaccattgccctagatatt

SEQ ID NO: 156393 - DNA, 708 bp, Homo sapiens
caagtgtgtggatgcgctgattagagagacaagggtccactggctctgtcagtacaggtgtgggccttggtttcctcatctgtgaaatgggtaatgtttcctcctacgccatacgaatgttgaaaaggttgcaggagatggtagaagggatgtggtttaggaggacagtccatggagtcaaactgcctgggtccaaatcccagctcctctacaagctgtgcacatgaaggcctcagggacacgctgatggtacctacctcagagtgctggtataaggaataaattaattgggtgggatcacaggtatgagccactgcacccggtgcatcattattattattaaaacctttagcacagtgcctggcacatagtaaggactcaataaacctcaaccatcacaacaacataacaccaacaatttgctgttatccacagtcactcagctaaacctatgccctgctggtcctccttagatgctgtggcttccacctcgggtggggtagggctgttgtagagagccaaagactggaaacacttggaagtgggttcggatgtttactctgccacctgcttgctgagcaaccttgggaaaatgaacttacctctctgagcttcagtttcctcctaccttcaatgggataatagaaaatgaggtctcatgagccaggcatgatggcacatgcccatagtcccagttacttaggaggc

SEQ ID NO: 156394 - DNA, 631 bp, Homo sapiens
ccgattatgaggaacccgggccccgatgcacagttgggaatcaagttttagctccccttggggctattattattagctaaggaacacagtcaggctcctgggtgaagaatcaaactaagtgacagtggtgtctgtgacctgggctcctccatgggcccgtgtggccggcagcctctaggactgcctggtgacccccactgctgttgtcacagcctctcatcgtgcccatccctggagcgtgggctggatctcaggactcgcttctcgtggatagaccacagactacagcaaaggtgacaatatgccgcttccgtgatgaggccacatgtcttgctcactgtcactcatgcctttgcttggtcactcaccctgaaggaagtcactggcctcgggacaggcccccatgtaaggaatcgaggtctccagccaacagctatgtgagtgagcttggaaccaaatcctaccccaagcaggccccgagatgaccacaggttgtcagcttgattgcagcttgtgagatgcccggagccagggggaccagctgggcactcccaggtccccgggccacagggactatgacataatctacttgtgttgcgttaggctgctgaacttggggaaattcattgca

SEQ ID NO: 156395 - DNA, 357 bp, Homo sapiens
gactgtgccaggcacgctccccactcagggcctttgctctctgcctggaaggaatgctcttcccccagagctaccttctcacctcctcacccgcttcctgtctttgctcagatgccactttctcaatgagaccttccatggacacctatttataattgaaaaaaacaaatgtatcccctttctgcccttccctgttttatttttctccttagcacttagcattcttgatcacaatacctgttgcttccttattatgttttttgtctgtttctgtccattggaatgtgatctacagcggggcaggggtgttgtctgttttgtccactgttgtgtcccctgcacagagcatggggccta

SEQ ID NO: 156396 - DNA, 508 bp, Homo sapiens
atgattgcaccactgtactccagcctgggggacacagcaagacttcatctcaagaaaaaaataaataaataaaaaaccattgtaaaatagaagctcccaggagtaaacctgtttagatagcagaaatttcaatctttaaaagacagagacactacaagagaaagtaaggcatatgttgtatttgtttctgtttttgtctgtatataaatattataccatcacctactaaatctctgtaacaaaaatggtttttgtccaaggcattgttggtgtgtgtgtgtgcccatgtgattttgaaatgcttaagtcagttttataatgcaacggagtacaggcaggttcatgcttaaagattcttggacccaccagttgtacttcctgaaagcaagcccatctctctttcatttggcttcagctgttctgggtatatcaaccacttcccctgtgcaccctctctggacactattcagacttcatgtcatagtttactcctggaaatccatgccca

SEQ ID NO: 156397 - DNA, 125 bp, Homo sapiens
cacagagtgtgttcttggggtgggactctgagctctgtgttcacacgggactcacctggattcatccatcaggaacagaacaggctcctatgaggagcagaggacacgtgggagctaagcttggg

SEQ ID NO: 156398 - DNA, 567 bp, Homo sapiens
atgatgctggcctgatagaatgagttagagagaacttctttgtcttcaattttttttggatggttttaggagaaaaggtaccatctcctctttgtacctctgctcaaattcagcttgcttggtaggctagtttttactgcctcagtttcagaacacattattgatctattcagggttcagtcttgtggagggtttattttgcaaggaaattgtctatttcttctagattttctggtttatgtgcatacatatgtttatagtgttctctgattgttgttcatatttccatgggatcagtgatgatatctcccttattatttctaattgtgtttggttctcctttcttttcttatttatttgcctagctagtgttccatctagtttattaatttttttcataaaaacagctcctggatttgttgacttttttttttggaagagttttcagtgtctctatctccctcagctctactttgatcttggttatttcttgttttctgctacctttctggttagttttcacttggttttctagttcttttaatcaagatgttaggctgttaattt

SEQ ID NO: 156399 - DNA, 390 bp, Homo sapiens
ggcttctttctgactgcagaggtgggcatgtaactcggggctagtcagtcacagactctatatatttgccacatgattttttttcaggtgtagttatgaagggataatcagagtgcttggggctggaggaagcataaccttttatctaaagatcataaaaatgtgactggtacgcagttctggagctgccagatgttacgttatctccacgtggagaaaacctgtcaaggggagagaatgatgtcaagctgaaaagaggaatgggtggacaactagaatatggaaaactagtagttgaagttctggaactcagccatgcctgagcctagcttacctctgaaactttatagaaatgagcaacaatacctatttacattccgacaagattga

SEQ ID NO: 156400 - DNA, 135 bp, Homo sapiens
gttaccaactttaaggtaggaccagggaaagaaagaaatactgtgtgaacagagagccaggagaatttagggtcatgaaaaccaaaagatgatagcaaggtcgtcagctttagagttgctggattagggatttag

SEQ ID NO: 156401 - DNA, 466 bp, Homo sapiens
agtatcgtttatgtcatgctgaatttcttttcagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatat

SEQ ID NO: 156402 - DNA, 287 bp, Homo sapiens
gaggtcatcctgggaccttccctgtccccctacctttctctggaaggccaagaaagctggaggagtccctcataactaccatgcccttggaacctggggtgaactggatgagaaggattggttcttgggtgagggaagaggggaggaggaagcaggaagtaggaaccagacagagatgtggctgctctggctcctgggatgattcctgggttagaaatacacgtactgccaaagcttttcttccttctttgccaaatgttccattcagttgattgccagcttctggt

SEQ ID NO: 156403 - DNA, 198 bp, Homo sapiens
aatttttttacagctccttcaccagtgcaaccgccatttttctctgaatgttcattggggtatttttctccagcaccatctctttctttgcctccaccacctcaggtttcttctctgccacctttgagccagccttatgtggaaggcttgtgtgtttctcttgaacctctacctcctctaccaccattaccacctctc

SEQ ID NO: 156404 - DNA, 517 bp, Homo sapiens
aagttcttattgccattctttaatcccttggagttagcaggcagttatagcaagcctgaatccactccaacatatgtcgttgggcctcttaggccctggcactctcgtttcctccctgggtatgtacaatattaccacactttcaattccagtggattttgtttgccttatacagatattctttttcttcagctccagaggaaatgttcccagatgaacaaggccagcagatgctgcctctcgtaacaatatcatgcaaagaaaaatgctagttaaaagtttaaaccatcttaactcaataataaacactggtttgggaactcaacaacagccataggctttcccaacctactgattttcataccttacctatacataccttaatagtgttaagttggaggcttttcttcttttcctgaactttaattacttatttgatgaacacaattttttaattgattggggtatttgctaagctaccttcacaaaaatcactgttcctaattctcaaatacag

SEQ ID NO: 156405 - DNA, 505 bp, Homo sapiens
gaaaaaatagaatgtggaaatgcttgtttggagcaacctgttgattttgaggcaatgtgtcctacccattttaaacttctaaaaggaataattacaaatgttggcagtgacatacaagtacatttaatatattcgcctatcttcttgagtttccaaaattacttttcagaaatgaatataaattcttacaatgctgaatagtgattacattaccagttaattataaaatgaaattattgcctatatgcataattatatttttaagattagactcatcagtccattctttaacacagagaaagaatgcagaatcttatcagataaatttaacaaagagaaaaaaaaagaggtattgaccttaaagaggaggttgagagagaaaatgagatggaaagtttattcaaagtgaaaataacagagaactttccaaacctagagaaagatatcaatattattattatttgagacagtctcgctctgttgcccaggctggagtgcagtaatg

SEQ ID NO: 156406 - DNA, 495 bp, Homo sapiens
cattcctttagccatacattatttattgctctcaaaccagagtggaggtttggatatccttcataaaactttttataataatggtaataacagtagcctctctaatttataagtgtttcatatgaaccagctacagtggtaagtgcattgcattatctcatttaattctcagcacgaccctaggaggtaggcactatcatgattcctatttttacagatggagaaagtggaactcagggagcttaaagagcttttctagctctcccagttaaaagggtgcagaatgaggatttgaactcagatgtactcaatctagagacagtgaaactgactacaagagcagaggcttcggaacttcagtgagggttatctgaggatcttgttcaaattgtgggctctcagaccacacacaaagagttacagtttgaatggaactgtggtagagtcctggacctcaggatgactctgagatgtgtgatctttttttttcctttt

SEQ ID NO: 156407 - DNA, 593 bp, Homo sapiens
tgccccttttgacttctcattatgtaagtttgaaaattttcaaatataaacaaagactacgaaaatagtacctcccgatgtatgtgtcccatttaccagggagccatgttcccatcactcagctttaacggttcccaacattttgctgttcttttcagtgatctccctgcactgttcgttctccatcttgtcctcttccaccccttacagcaactctctgacatcatataattttatttgggaagatatcagaatataactctcacagagaaggctttgtttttaaacataaccacaatactattattgtacccaaaaagcttaaaaataattccataataccatctaatactgggtccatactcaatcttccctttaaaagtccgtgttaagatctggagattttaagtcagtatttctgagctccaatgtagtgcacaggagtaggatgtttagcccttcttacggagagcatgagcagtagaagaggaggctggaatcctaaagtgtattcaatcttctattgtcaatgggtcaataatatacctattagagaatattcttagcttaaaactgaaaaagtcagccaggcg

SEQ ID NO: 156408 - DNA, 270 bp, Homo sapiens
tgaatgggcacagaaattgtcattatttcctatagggtgtcggaaatttagtctattggtaattttgccttgactgccttaaatttacttataaatagaaatatgtgaataatgtatttttcctctttattatgtaggtttaattgaagtagtatattattttcattacacattaacatgtagtatagtactatctcaaatataactgctgggtgatgaaaaatagccttcacaaactcatgttccaaaatttctcaggcccttattcaa

SEQ ID NO: 156409 - DNA, 375 bp, Homo sapiens
ctcattgctggatattcaggctgtctctaatctggagtggctgtaaaccatgaacatcctggagtgtaaatctctgtgctgatctctgatcctttccttagatatagtcatataggtacaacgaataggtcaaagggaatgcaccttttttaacaaggggattttaatgacaaatttaagtgttcctaaatacctatcagtgcagcatctgattactgggatttattgaaaattatttttttaaagatcagagaggccaggtgtggtggttcatgcctgtaacttcaacactttgggaagccaagacgggtggatggcttgacctctggagttcaagaccagcccgggcaaacatgatgaaaccctgtctctaca

SEQ ID NO: 156410 - DNA, 915 bp, Homo sapiens
gatgtaccaacatttatttgtgtgttcatcacttgattagcatctggattgtgccaaagttttggcttttatgaatcacacaattgtgaacatttgtgtgcaagtttttacatagctcttgggtaaatacctcttttttacattgctcttttacattgctcattttagattttacattttacattacatagctctttttacattgctcttgggtaaatacttaggaatggaatttctaattcacatggtaagtatatatttaactttataagataccaccatactgctttccaaagtgtctgtacactttgcattcataccagcaaatgaggattttctccaaatcctcatgaccacttattattttcagacttttttaaaaccacgagctcatgttttattggaatagagaaacttggccataattacaatatagtatgattagtgctaaatatgtcagtcttttaaaacttcagccataccagtggctgtgtagtagaatcttactgtggttttaatttgcatttttctgactagtgattgttgagcatacttttatgagcttattagccatctgcataaagtgtggagaccttccctcagttttaattggattatttattctggatacaagccctttgtcatgtaggtgttttaaaatagtgtctcccatttggtggcttgccttttcattttcttaacagtgtattttgaagagcaaaatgtttttatcttatgaagttcatttcatctatttttttactttcatagtttttgcatctttgtgttctagaaatctttacctaacccaaagtcgcaaacattttatccaaatgacttttttccctgaaagtttaatcagttttaccttttaaatttagtcctgaaagggtagccttatatgtccaaggtggg

SEQ ID NO: 156411 - DNA, 403 bp, Homo sapiens
cacggtggctgcgtgttgagctggtgagagcgacataggcagggtggtcagtctagagactgtcgctgtaagccaggaaacgacgctgagtggtatgggcccagggccaggtcccagtctcagccccagcgcagcagcctctgccacagccctctgcagacctggggtcagtagccggcctagggaaagccagcaacccactcaggatccctcagggcccctgacctgggcgggactctcagcccaggaagagtccctccggattctctcgttcagccagcggcccctggtggccccaagttgcattacacagtctcagagatgacagcccagcttggagggtgtcaggcaccctgtcagccccagagaaacctgcttagctctagagagcccagcccggctc

SEQ ID NO: 156412 - DNA, 366 bp, Homo sapiens
agacactcaaaactcactgctaaaagatgatgcataaatatactgtcatattttttatctttctatattaaaagctgggaaatcaactttattgttagtaaaataaactctgaagccagtatttttctacttagaaagcaaaatgtaacataaagtcatggttctccacttaaaggaatacaggaatgtatacatatatttacttttcctccatctgatgtatttaaaatacttgatgaaacagcctataaataatctataacttaaatgatggacagtcataaaatgactatcgttgttcaccaccaccatggatgcctttgaacataaactcccctgaagttttaaagctaaagcaaccgatac

SEQ ID NO: 156413 - DNA, 340 bp, Homo sapiens
gactttgtactgtgcattaaacctaggaactgtcttctgtgccatgttccagaaataatttgatgtaagtttcttctattaagtgaaatcattagaaatgtttggaggctgggcatggtggctcacacctgtaatcccaacactttgtggggccaagatgggtggatcacctaaggccaggagtttgagaccagcctggccaacatggcgaaaacccatgtctactaaaaatacaaaaattagctgggtgtagtggcacgtgcctgtaatttcagctactcgggaggctgaggcaggagaattgcttgaacccaggaggcaggttgcagggagccaagat

SEQ ID NO: 156414 - DNA, 376 bp, Homo sapiens
ctcccaggttcaagcaattctcctgcctcggcctcaggagtagctcagattacaggcacacaccaccacgcccaattaatgtttgtatttttagtagagatggggtttcaccatgttggccaggctggtctcgaactcctgacctcaaatgatccacccaccttggcctcccgaagtgctggggttacaggcataagccactgcacccagccagaaacagtaatctctaccagtattgtaggaggcagaacagatatggaaagaaaacagaggtctttttcactatggtaagtttgaagaattttagttaatatgtctaataagcagttgaaaatttaaattggctcacagagaaaggtactgaattggcaacaga

SEQ ID NO: 156415 - DNA, 383 bp, Homo sapiens
ggaggcagatccaggcctcatccattcccctcacttgatagataggagatctaaaggcaggtaaatcacctcaatgcctatgggcatttttattgggcattagagtcaagactatagtgatttgtgggctcagagtccttgacctcactttctttagtacatctaagtcgatgaaaccaggtaaatcactaaacttagggccttctggcatgtgaatcaaattgagactttttgaagataaaagggcatctcctcccaagtagtcaaattagttatcaaaaagcacagattggattgattgattgattgtagagatgtggtttcactatgttgtccaggctggtctcgaactccttcgttcaagggatcctcctgcctcagcc

SEQ ID NO: 156416 - DNA, 181 bp, Homo sapiens
tacagattagaaccgagctgtaacccatcgcgaatcacacaatgtcatgtcatcactattcacacatgtcacatttcacacgttcacacacatcacaatcaacactaatccctgaagccctgaattctaaagaaggagaacaatcctgctgctgttgatcctccatcgttccacgctggtg

SEQ ID NO: 156417 - DNA, 347 bp, Homo sapiens
gcagaggcaggtggatcacctgaggtcaagagttggagaccagcctgaccaagatggtgaaaccccatgcctactaaaaatgcaaaaagttagccaggcttggtggcgcatgccggtaatcccagctagttgaggggctgaggcaggggaatcacttgaacctgggagccggaggttgcagtgagctgagatcgcatcattgtactccagcctgggcaacaagagtgaaactccatctcgaaaacaaacaaacaaacaaaaaaacactggggccaaagaactctgtgtgctgtatcacctaaccacatttcatgacacggctagagaagaatcatgcaaataaaaat

SEQ ID NO: 156418 - DNA, 359 bp, Homo sapiens
cacaccccacccgggaatactacccagcactgaaaagtaacggacaagtgattcactcaacagcatgggtgaatttcaaaatccttatgctgagggaaagaagctggggcgaggggaaaatgtagcgtagggctccacttatataaaattctagaaaattcagactagtccataatgccagaaaacagatccatggttttgtgtgtgcgtaagggaagattacagtaatatacacaaaaacctttcggggagatgactatggtgatagtttcatgggtatttacagatgttgaaactgatcaaattgtacactttaaacaatgactgtatttcaattgtacctcaataaagttgcttta

SEQ ID NO: 156419 - DNA, 198 bp, Homo sapiens
tgtgtttcaagcgtgagaacccagtgggagggttcctgacacatcaccactctgaccctcagtgtcttcatctgtcaagtggggagactgatcatcctgccctactgtgaggactaaataaataatacagtgcacccagctgttatccttattattagacggagcctaaatgtccagcagtaagagatttgccagtat

SEQ ID NO: 156420 - DNA, 117 bp, Homo sapiens
cctggcgaagaatataacatcatttatagtagtctgaaactgaaaatcacccacataatcatggatagtagatatgtaaatcatgtactgttatactgcaagaagacaaaccacaga

SEQ ID NO: 156421 - DNA, 185 bp, Homo sapiens
acctgccttggcctcccagagtgctgggattacaggcatgagccatctaataaacacttttattaggttcttgggtttgagtgtttgtgtgttattccccaaaccagataccttttgaagggaataaatctctataaaatgaaatgactgctatttgactaggattgtaatctgcagccacactg

SEQ ID NO: 156422 - DNA, 415 bp, Homo sapiens
gtggcggccaagcccctgtgaggatggccaaggattgaggacagcagctcctgggccaaggacacaatcctgtggaccccatgccactggcccagagaccagtggtccactctgaccccaagctctgtaggaaagaggtctgtgtggtcctcccattctcggctggatgacttcctgccttcatgggggaccctttaacggtagacccctcttaaccctgccagggtcagccaccctcacgagccagccactctctcctcttggcctctgctcccctccccaagtggacagacacccatgaggcaatgagagggaggcaggaagagtccatgtggtcggcttctgaggaaactcatggtcacccaggctggtctggaggaggaggaggagtatgagtgtcagagagagagagaga

SEQ ID NO: 156423 - DNA, 444 bp, Homo sapiens
gtagcaatcccccaagtgtgagctatgctctcaccgtttcactccccgattttcacagctccagcattctctcattaccagatccagtcattaggggaaatgctgttggtgtttgtggcacagacttccaatatttgaccacacttgttcccatgttttccttgtgtgtatgtttttatatcataaacaaaataaaccatgcttaggagcatactatctttccttcaaaacagcagcaccctcatataccgctaaatggaatcacgtattaaataaacaccacctccaagtttacctgtgcttcacacaagaacttcatttgctaaccaagggtattcattttaaagtgaagctctcctttcttattaaattatgcaggatagccttcaaaggttgctgtcttactgagacttggccatttttcttgcatacatgctctttgga

SEQ ID NO: 156424 - DNA, 475 bp, Homo sapiens
aatatacccagaccctcttccttctcatgttgctaagggaacattataggtttgtaacttgcccccttaaattgttgctcagccctaagaggtgttagaaaaatgctagaataaaaccacaaccattactggcagagcataccttactaccttctactagatgatatcctttctctctctctctttgtagttttaccacacaggcaaacacaggggaaaaaagtggaagggcaggatgatggagggaaatatttactgaagcagaacattagaagttagctgattagagttaaaactacagaaagtaagctaagaaatctaggaaaggaaataaattcatagagcccacagtgtaaaagcaaatgacttagttaaccaaccaagaaaactggaaggaacctgaacctctgaagtggcatagaaatgctttaggaagcaaggacaagctggtaatgaattgaacaacatgtggcag

SEQ ID NO: 156425 - DNA, 137 bp, Homo sapiens
aagtgggattatgccaagtgcctgtaggggtgtaggatgtgggaaccacctatggacggggcacccagccattcaggaaattaggtctgtgcaaccttgggacccagtggtcccactctatcccaggtcccactata

SEQ ID NO: 156426 - DNA, 247 bp, Homo sapiens
gggaggtcaaggctgcagtgtgccatgattacaccactgcactacaggctgagcaacagaatgagaacttgtctggaaaaaaaaaaaggttagcaccaagtattacggtgagaggatagaaagggaaccatgtaaattgaactttgaaagtccagaagatttctgctgggatgtggcactttaataattagttaattatggttaacagaagtaaaaagttgaaaggtgattcctaaaagaggtaaca

SEQ ID NO: 156427 - DNA, 338 bp, Homo sapiens
caggaggagctctgtgcctcgctggtcgccgagccccgcgcacgctgcctgtgctctgtgcctcactggtcgctgagccccgcgcacgctgcctgtgctcagggctgctcgtggttttagggagcggccaccaggctgggaggcgagtcttaagtccggccacacggtgccttcaggggtgtgtgtgctgcagtggctgaaccgccgtgcgtctcctgctcgatagattgcatctcagtgtgtcctcccgcatcagacatggggcgaggggcctgcgtagctgtggggtggagatgccaggaaccctggacggtggccccagtgcactgagggtccac

SEQ ID NO: 156428 - DNA, 171 bp, Homo sapiens
accgttatgtagtgctgaattgatgttaggctttaccctgagaaagccattacagagtttgagaatgagacacacttgaataggcagtcaggtaggtagattaggggaggagcttaaagagtacaggatcagaggcagaggccgggctggctcccctctgtaatcccagca

SEQ ID NO: 156429 - DNA, 233 bp, Homo sapiens
aaatggggcagaggaaaaatgcagagaatctgcattttacatatgataacacaggcaaaaatggggtaagggaataatcagatatgcatttgtgtctggtgggctgtgggtaactgcacctgtaaagataagctatcaatttgcattgccatggtgaaattttaacagaaacaccttaaaagatcttgcagctcatcaggaatttccttgtaggcaaaatataggggaggcat

SEQ ID NO: 156430 - DNA, 292 bp, Homo sapiens
acctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgccct

SEQ ID NO: 156431 - DNA, 284 bp, Homo sapiens
agactgaatccacaggggctatgatggctaacattcagatctaccaatgtaggacagagcaaagggattcaattacagagataaatgaggatgaaggcagaggatgaaaataaacacaccaatcattcaataaatggccatttattaaaaatccaagctaagcactatgctgtgatagaggctagagtggaaaactacataagaccaccccacttctattcctagtaccctccagtttattttccccagggcagcaatgttgtgcacttaaaatacaaatctga

SEQ ID NO: 156432 - DNA, 640 bp, Homo sapiens
tccctttgtctacgctgtaatgagatgtttttcttacatgtttatatttgatttttcgtttgtttattttctccattgaaatattgtggagagttagagatggaaaaagaataccccaaagcagaggacccctactctctccctcctaattctgcttgtgttctgtaatacgggcagggggagagggaagcccttttatctgcccttggtatctaagataccacttagtaaatgatccctcagaacccccttggctgcctgcctccaacatgtgccttttaccctaactcttccagaaacacagatggcccaagacagcctgcactggaatggcccttctcagtgaaggtctcttgcacctggcggccacggaagtctcactttcagactcatggggcagactggaggtgcaggatggacttggacagcaataaccctacactgttccttttggttctaggacatattatgaggggattctttttttctggaagtaggtttaattcaattgatttaattaaatcctattggctcagattgataaaataaggggtctgtcttctctgagaatccctgaggttgaggagagaacatgtggacccaagggaggttaagtgaatgtggtaaagccttgtgactg

SEQ ID NO: 156433 - DNA, 736 bp, Homo sapiens
gtcattatatatacttcaaggtttcagagctttttggaatggcagataagggactgtaagcctctatcactcactgggaataatctaaaatttttaggttgtaatctttgggcaataagagtttgtatccatctcatacgcagtttttcataatgtagactctttactggtagaatcaggggaagatattacattttatttacagtcaaagggccaaattctaatgaggaacatcatattgaacctagaccttccttatgtttgatacacgctatagtgacccccttgagatagagttattcattcatgtcatactcttctattccaaatctagctgtaagcataaccaacaccaatggctgctatgaacattcttcacagaaactgaaattagcagggatacacattcagattattactacaccctaacaatttggcttagatccagacttatatcttaggtgaagaaaatgctaaagtaataaaatctaaatttgttatttgctaaacatgctaaattatgtgtgagagacaaatgaagaaacttattgtgtacaaataatatactttaaatacaaaatattcggtaaatatacaggtgttcatggtaaaattttcctcaaatttgctatgtcaaaagagtttcataatgttagaaaaaaggaagcaatgaaaaagaaaacgtactatcagtgctgattcccattttttaaaacatgaaataaagtttgttatg

SEQ ID NO: 156434 - DNA, 211 bp, Homo sapiens
atacacccatctcgcccaccagtggcaaagccttcttcacaagcatacatgctaaagattccagcctgttgattaaaacaggtaatactcaatggtgcaaccatcctaagtataatgaatagatacagttgaatgttgatttaaaaacatagcaagtcaaaaacaaaaataaaacccctttgttctctattgaaatgctgacaatagacca

SEQ ID NO: 156435 - DNA, 225 bp, Homo sapiens
gagacatgaaagaaatctgaaggacttgtaattattgagacttaaatagaaaaccccacgctgtaagttaacaagtacatttaggtaattatcaccattaaaaaatttgaatgcagttttaaagccctgaaatttcctagtgtggatggttgtagtctacttccctggcatgaaatattccggagctgtaaggataaatctgccagaggcagacacatgctggga

SEQ ID NO: 156436 - DNA, 299 bp, Homo sapiens
gctttgcccttgggactgttctgtccctgctggactctgcagcctgctttgtctcactaaattgttcctgtctgggctcggtttggggccatgccctttactatgtgttcccagtggacagtcccctgggttcccctctgtcccttcatagcctcatccctttgcttgacatcgtcgaagagaagcatgcatgatgtcagcagcgggacagttggaacttcttgggagacaagcttaaagactagccagagataacaattattttggttttcttgttggcattacttcactcattcatt

SEQ ID NO: 156437 - DNA, 157 bp, Homo sapiens
caatagcgtgcttaaatttccctgctccctgggctggaaagaaattacctaaaattctgaggactccattttttttttaccattttgcatttcccccaagcccaaatctaagtaatttgctaacaataaccattcatgcacccaagtgagtgcaaac

SEQ ID NO: 156438 - DNA, 389 bp, Homo sapiens
acctggcccggtcagtcggatgtgcgggcatacggaggtgtgaaaaattgttaaatcttcatctatagtatgactctaatgcgtagtgcctacaactgaaagatcaagaagcagcaatataaacatgttatttagaaatgtggataaaacaccaagagaatcagatagaattgttaacagtagttgcccctggtgggtgaggaaatgggaggaagggaatcaagaggctgttgtttttcacctcaagcctacatgagtcatttggctctttaaactatatacatgtacattgttgaaaaaaatgatgtttttaaatatttgttaaaagtccatactccccaacatagttttcaatattcttcatagaattacacatccgtactggcccg

SEQ ID NO: 156439 - DNA, 328 bp, Homo sapiens
cttgaactcctgacctcaggtgatcgtcccgcctcagcctcccaaagtgctgggattacaggcttgggccactgcgcccagccttaaccactttaaacagtacaatccagtaatgtttagtgtgttcacaatgttgtgaaaccattaccactaattccagaacatttccattaccttccccaaaacagcccagtacctccaactctcccctgacaaccactaatcttctatctctatggatttgcctttatggattttatatcagtggaatcatataatgtgtggccatttctgtctggcttctttcagttagcgtaatgttttcaag

SEQ ID NO: 156440 - DNA, 490 bp, Homo sapiens
ccttctccactagcctaatcacattattcctattttcaacatctggaatccaaatccgtaatgaaaatggaatatctaagaaataataatctcaaaagctattccatttttcttcttccttactcctagtcaagcctagggtgaacgtctccccatccaagaagggtcctctgaagcaccacaacctgtttgtctgccacgtgacagatttctatccaggcagcattcaagtctgatggttcctgaatggaaaggaggaaatagctggggttgtgtccaccaacatgattcataatgagactagaccttccagatcccagtgatgctggaaatgagccaccagcagggagacatctacacctgccaagtgaagcaccctagcctggacagtcctgtcaccacggagtggagtgagttagtctctgatgaccctctaaaccccacctctgaagagcaggggactctctggctctggggtccactcatcttg

SEQ ID NO: 156441 - DNA, 426 bp, Homo sapiens
gatgtatgttcgttgagttattgtcttcaataggggaggtgattcctttgcactgtgcaatacatgcaacctttaaggagaacgggcagtcaggtggggatgcctgcttggtaggggctcattattgaaagactacatgttgagatcatagcaaatggacttctgaacaagtttcctagagtaaaagaagtgtgggtggtggctcatgcctataatcccagcactttgggaggctaaggaggaagactcgcttgagctcaggagacagatgttgcagttagccgagattcacatgctggcctccagccagggtgacggagagacttggactcaaaacaaaaacagaaaacaaactaaatgctgtgcctcccatcagttcctccctaggaattcatcttgtagatagcacacagacaaagggaaaca

SEQ ID NO: 156442 - DNA, 230 bp, Homo sapiens
aagaaacaattgggtggagtttggaaaggcagggatttgatagagtgcacaaaagctccagaggaatggaaatcaaatgcaagaagattttggttcaagataagaaaaaatgtaccaaaaggaagacttatacattcataaaatacctgtcagttccctattagcagaagtttttacatttagaattgattggaaattttagaataacaaacatttttaacagcacataa

SEQ ID NO: 156443 - DNA, 383 bp, Homo sapiens
  misc_feature (41)..(41): n is a, c, g, or t
ttaaccctgcggattgaggtcgtaaacagaaaatttggaanccgatcaaagtgctgagaagtcgattcgcttcatccatttggtcacaggttgtgtcctgggctcctcgggaaaggttctgcccaagtggggctgggagcagttggaagttacttgcaccccatacctgaaagaaaccctcaactccatctggaatgtggaggcgagatcccggcgccgtgctcagaaccctgtgaaggtgtcctggcttgacgggagcgagaatccgccgcctgtccagcctcccagccctacacactgtctccccgtctgcctcccagctggtcttggacccctgacacggcccccagcctgcgtggccctgctgcagttttcttccccag

SEQ ID NO: 156444 - DNA, 297 bp, Homo sapiens
acaggcgtcagccactgcacccaaccttgtgatttttacaattgttttttgcttatctgaatttcttaaacatatcttattatttaataaaaataagttaaaatgttaaaagaataaatacgagtctctgcccacaacaggttgctactgaaagctgttcaaatgcagcccatcatcccttgagtaaacctctgatccttacggctgtgccatgcactgttaagctcactgtctcctttgcagggacgaccgtctttgggatgagcggctttgtgctgcaaagttaagaattgggtc

SEQ ID NO: 156445 - DNA, 363 bp, Homo sapiens
tagaaatgaatgggtttgttttttctttttcctttttgactctgtcctgatgagagagagggagagcaggacggaaaatgagttgttttgaaataggtccttcccgtctcacttacggggaagcagagccaagtgtggggaagttccatgcgcacgtggacggcactgtctcctctcaaatggggcccccatcgggatggcccctgcacacccccaagtagttacctggctctgccccagtcagcatctcaacccattcaccagtggtgccatcatctgactcagctcttagcaacaatacttagtcctacatttccttagtctgataattcccttacgtgaaggaaataaaaaatatgctat

SEQ ID NO: 156446 - DNA, 326 bp, Homo sapiens
tggacagaagcagcaaatgtcgtgagtgcagagtagagcagcgcttgggagggcctgggcaccgatgcccatcgacacctaggcagagatggtgtggaccctgagatcaacagggagaagaggcatggggagctttggctttgggggtgcaggtgcagagagggattccaggcaggagtgtgctcatcccattcccacctgagaatgtccagaggcgatgaggattgtcacacccaccccataaaggggggcccctccaggcctcctggggctttctcccttccctggcacctggaagacccagatacccatgacccagggccctg

SEQ ID NO: 156447 - DNA, 296 bp, Homo sapiens
tcaagatatatagtatggcactcctcttctcagtaactattcattgataacttatctattttcttgagcttaaaagggcaaaaatcggccgggcctgatggctcatgcctgtaatcttagcactttgggaggccaaggtgggaggactgcttgaggccaagagttcaagatcaacctggtcaacatggcaagaccctgtctctatttatttatttatttttaaaaagggcaaaaatccatacaaatcatttgagatatccaagacctgtcaatttcttaaacagacaacatttcag

SEQ ID NO: 156448 - DNA, 404 bp, Homo sapiens
ggctcactgtaatctccgcctccctggttcaagcgattctcctgcctcagcctcctgaatagctgggactacaggcacgcgccaccacgtccagctgatttttgtattttcagtagagacggggtttcattatgtttgccaggatggtctcgatcttgacctcgtgatccgtctgcctcggcctcccaaagtgctgggattacaggcatgagacaccgtgcccagcgacaagataattttaaaaggagagggaacgtctgcttttgttgcctttctcgtcttttgtggttccacatacaacacagcagtgtctatgggctgtcaatcgcaacataatgcaaacaacacaattgtctctggggtccactgaatccaaatcacacacgcaccacacttctgccttt

SEQ ID NO: 156449 - DNA, 557 bp, Homo sapiens
gcaatccagtttttaaaatatgcagagggaaacaaactagatgtttacaataattttctaggggtgaatttttctcttgtattttccaagtttactataataaaagctttgggtttctactttaaataatcgctctcctccaccatactccgctgccatcctcccaaaaccctgagtatgggtccatggggaaagcaaataaagtgggaagagggatgtgaagacaggggattaggggggtgaagacagggggctcactgttggacaagaagtgtcgagacaggataaattccaggtcctggaatttaaagaaggaattaggtaaggaaggaaggggaggaaagttccagaaacactggagacccactttgataacactatcaaagcctcctagagagagagacagagagcttctcagtcctctgagaatccacaacatagtctgcacctgtacctcctaaatgcccagcagcagccaccttcacctcccacctctgagggaggtgccagcctggggtgagcaggcctaggtaaaagtggtagaaggcctggcatgg

SEQ ID NO: 156450 - DNA, 405 bp, Homo sapiens
atctttgagctcatgctcccattctaaaaggacacatccaagtcacaaggggcgggtaatttgttccccctttagtctccctccatggtgggagaagctctttgttttttactcagaatcttagttggcacctcgttatgttaaaaatcagattgaaagaactatttcatcgctattaagcacaaatgtatacaagctacttattaaggagaacgaggttgttttgataactataaaatgttgcaactgggttgaatgaatagtctcagcggtctatttctatgttttagctctacaacaacaagaaggtcctgatttgcacggagatcagattaattttatgaaagtgtgtacatataggtctaaagtgtaaaaacccagcacagtccacagctatctgaagct

SEQ ID NO: 156451 - DNA, 638 bp, Homo sapiens
tgacattctcaccaacaacattgagtgtgcttatttccccatagcctccctaacagagagtgtaatcaaacttttggaatttaccattctgatggatgaaaagcaatatgtcactgtggttttaatttgtaattttttcattatgaatgaaattgaacatatcaaatatataaagggcataccatgctcatttattttcttcaaaccatctgatcacctatttttgcccatttttatttgggggttattattttctatgaatttctaacagttctttatctattagagtaataacccctttggctgtggtgccagttgcagattttttttcctccaatttgttctttgtcttttgatttttaaggtgattgttttaccatgcatacattttctcttttatttagctgaatttatctatctcttttcttatggcctccggattttgagtaagttataaaggtcattcacactcccaggttgtaaaagactctttccaagtttctttaggtcttctatggattgaggtttttgtttttgtttttttaacattttaatcatttagccacttagaatttatcctagtatagatgtaaggaatagaccctgctttttttcaggtggttatttgatccaacaac

SEQ ID NO: 156452 - DNA, 504 bp, Homo sapiens
agccagaggcacaggctctgcagagaggcagtgatgatgccatagagcgtgacaagggcagcaatgctggggttgcccaaggaagggatcaaagtctcccatcttgcagacagagatactgagtcccagagaggggaagtggctgtctgggcactggagactagaacccaggagtcttctacctctcccctcttccggctctgaccccgagagcttccctggggaacggtaggtgggctagggagccccataaggtagaactgaaagcagaaactcctcccctgttaactgactcctcccagagcccccgaatctctgcttccagggttggggttcatttgcttctgcgatagtctgggatgggtgggactggcacaagatgggtcctctatcaccccaagtccaaggggcgccccaagcggggtgctgctgtgccgtgtcgggccagcatggcagtaggccagggcccccggcagcgccgaggcagctggacagggcggccgc

SEQ ID NO: 156453 - DNA, 131 bp, Homo sapiens
gcactgccttccccgacactccaaaactgatggattcgaggatgagggtgacaaatatctcaaagtcctctcatgtctgttacctagtatcttcattttttcaaatttagcttcaattttaattttttttt

SEQ ID NO: 156454 - DNA, 241 bp, Homo sapiens
cctaaaggtaattttatatagtatttttaataatttaataatttgtgtccagacgcggtgcctcacgcctgtaatcctagcgctttgggaggctgaggcaggcagattgcctgagctcaggagttcaagaccagcctgggcaacataatgaaaccccatctctattaaaagtacaaaaaattaaccaggtgtagtggtgcacgcctgtagtcccagctactcgggaggctgaggcgcgaga

SEQ ID NO: 156455 - DNA, 302 bp, Homo sapiens
tggtaaattacataggttatttgctccaaagtaagtgttattatatcctgtttcctttacctgctttgtatttatttctaccttaaaaaattccattattctcctgatgtttactctgaaaagtcttaaaaggcactaagtttctaattccttgttcatttttgcataagctgtatgatatctattttcttaatagatatcatgattaatgtatctcacacaatatacattcctaaatttttttaaattttattttaggtttggtgctgcatgtgaaggtttgtgacacaggtaagcatgtg

SEQ ID NO: 156456 - DNA, 393 bp, Homo sapiens
tcttttggagtccacatctaagtgaggtcgtgcagtatttgcctttctgtgctgggctttctttattagcataatgttttccagatgcatccatgttgttgcaagtgccaggatttctttctttttaagactgaatagtgttcaatttttaatacataaaccacattttctttatccattcattgttgatggacacttagattgattccatcttgtgaataaccctgcagtgaacacggggtgcagctctcccttcaactactgatttcatttcctttgaatatatatcttggaagttggatatatcctttggaagttggattactggattcgatggtagttttgtttttaattttttgaggaactcctatatgattttccatagcagctgta

SEQ ID NO: 156457 - DNA, 411 bp, Homo sapiens
caaggaacccaattgctatgtcatatggtcacaatacgtttagttttgagaaattgccagatggtcctccatagtgcccatacctttttgtatttctttttttttttaaattcataatcagtgtttttattattttcgatgatggctcatttctaagttaagtgatgtatactgtctacatttcccatctataagcttttgtttttcctggacttttgttacctaattttgatttgcttaggttattattttttttaatctatggcatgtcttcctatcgctgtgtacaatggctttcagtagaactttttacatcttcaaactcatcagataactgtgttttaatatctttttctgaggacattcctcccaaatccctctgttctgctccacttggggctgataggtcct

SEQ ID NO: 156458 - DNA, 417 bp, Homo sapiens
tgcaaccccttatgttttgcgttaaagaaaaaatggaattcaggctaccaaatcccttttttaatggcataccagcaggcaaatacagattttccagcaataagcaatttctactatcactgctaagggagggaaaagaaacaaaaagcaaaacacagcctttcttttttgctgctgtcaggatggacaattagagactagaataatgcatttttagtttttaaaaaagctttatcaggaaaaagctgccataaagtaattcatctacgaagcaataagagatgccatcaattttaccttacacttgaatcacactcttgattcctattcagctgtatttcaattatgccttttatttgaagacaagcccctacaaacacataatgtcgcctaaaagtgatctctcccgccccccca

SEQ ID NO: 156459 - DNA, 399 bp, Homo sapiens
ttgccaaatgtttctgactctattccttctgtacaatatgagactgcacattctaggcccctgggctgcatgactagttctgaccaatgagctgtaagcagacagcaatgtgccattttagggatacatcatctaattactagcttgatacccatcagtgttctcatttatatctaccacaatgattgacagtgatcaagatgttggctatttctgctaagcacagtgagcagagaccctccttccaactagtgttgaacaggtaaaggaagcaaaaaagggaatagttattattttaagtcattgaaatttgggggtggtcattaccaccatataacctcctgactattgttataagtaaaacaaaaaacaaacaaacaaaacaaaacaaaaaataaa

SEQ ID NO: 156460 - DNA, 280 bp, Homo sapiens
ctccatttttgcctgcactctgcctacaggaaaaattttgacttatcactagactcaggtaatgtgtctctcctgcctgggcctggaccacagagagcattgttatccattgctgggctcagcacccaggtgatgtgactctgctgcctgtgtcctgctttcagaggaagtttgttacatattcctggctaaatattcaggtgatgtgatactcctgtctggtctctgccctcagaaaagactgtgacatattcctgacccaaaacgcacgtgatgcgac

SEQ ID NO: 156461 - DNA, 248 bp, Homo sapiens
caggcgtcagccacgtgctcggcccattgaacctttttgagtttgtacagcccttgttgccttcaacagtgctccagagacccttctaggcagtctttgtgtgatcttctagacaaaatgtccttaaaggacatgtttgggtgtgtacggtaggcctctgggtggtgtgccacaacctacctctgtgtctacactccagaatcatcattgaactcaccaatactggtgttcctactggactttgttag

SEQ ID NO: 156462 - DNA, 657 bp, Homo sapiens
tcccatgcaatttaatagtactccacatcaaaaaggaacagggtattaatacatacagcaacatagataaataatgaaaacattgtgcagagtaaaagaagccttacgtagaagagtacatattataattccatttatacaaaattctaggagaggtaaaactaatctatactggaaaaaatcagaagagtggctgcagggagctggggattgactgggaaaggacatgagggaactttcagggatgatagttatggtccctatcagtggttctaaaggttaccagcattacctggagttttattagaaatgcaaattcttaggccctactccagacttaattcatcagtaactctgagggtagagcccatcattctgtattttaacagtctctctccagatgattcagatataagttgacgattgagaacaactgttctgtatattggtgtagggacttgagttacagtggtgaatgcatttgacaaaactgagcaaatgtacactaaaaatttgtgcattttattgcatgtacattttatctcaaggaaaaaacggggagtatactgaagtctccagtttaccttgaaatgcattgaaagtaaaatggatataggtgtgtgtgtatgcatatgcatacatgtatacgtgtgtgtg

SEQ ID NO: 156463 - DNA, 626 bp, Homo sapiens
aattggaacaagtggagataaggttctttctacacaacaggccggttcagttcaccgtaatcagcaggacaattcctccttcccattttgtccctgtttatgtgcttgggtgaaggggttatggaagggaatggatcaccctttgtatatcgcatgagttctttcaaggtagctaggagccaaaagacttgcttttctggttttctcattgtttccagtgccaacaaggctccctggaacctccaagctatgacatgattatgctcattatgaagggcaaataggaccagccctccagacactccaacaccaaaactatttttattaaggattttctccacttacctgggagtggttaggttttggagctttttggaggtatttcctctcacattcctaccatcctggcatacaattgttggacacctgcctatttcacatcctccttcctccttttcttatcgctccctgaggtgcagtttaccctcccctgcatcccccaccatctggaccagagtttctgcctctctgaacctaattatttctcttattctcttgaactactgcttcccttttgcctatgactcataaccttttattaacaaacaaacaattctttgctctta

SEQ ID NO: 156464 - DNA, 412 bp, Homo sapiens
tagtttgatggagaagagggaaatcaggtctgcccagcacagaggaaaccaacctaccctgtgtgaactatagagacaggtgtgggtgcaaggataggcgaatctgagcacagtaatgccaaggaccctttctttgcaaaaatagcagaaacagagcagatgggacagaacgcgggtgcctcagaagcaagtgacctgattgccagcacactggccctaccacctagaaaatcaaagcaaatttcttcttcagcacttttatgtgtggcctttgaccaaatgccacaacatgcagttaatgatgtcagatgacagggtgatactgcaattctgtgcattgcagacaccatgtgtaaatcacacatctgaaacgtcagacttcctgcccacagtcggtaactcatgtccagac

SEQ ID NO: 156465 - DNA, 118 bp, Homo sapiens
taggtcagttttacagatgaggaaactgaggcacagagaagttaattcagttgccaaaagccatgcagctaataagcggtgaagctggaattcaagcccaggcaatgtgccctggagc

SEQ ID NO: 156466 - DNA, 241 bp, Homo sapiens
agtctccaccaacttctgctcggccgctcctctcagccccttcccttggcccagggcgacctcggcagcccagagggcgtggaccctccggagtgcccagaaagcccccggggtggccctgcgcctcctggctctttctggatggaggcgcctccggaaggagccggctgcacgccgtggccttcacctcgcagcctctgctgaccacacctccctagcgcagaggctgcccgggagcagg

SEQ ID NO: 156467 - DNA, 399 bp, Homo sapiens
gaacaaggggatccaataagatctggtcctcactggcttttggtttctctccataggcacatcccctacactcagcttaaatcatttctgaccccttcctaccagtgctgaggattcttcccacctttttccagcccctacatctgcagtctggtgacctcgacctcaaagaaagtctcctcctctggactgggatagaagagatggagcctgggcccagttaggctttcagacatgtccaggcccggatgttagggtcagggtggtgaccccaggaggcagagtcacacgggaatcttcacagagtacattccttggcactaccacttctggcaggaggccaggcagcatgtccctatcccctccccaaaggcagtggcactggctgccctgaaggag

SEQ ID NO: 156468 - DNA, 172 bp, Homo sapiens
agtccgtctagtcacatagttcacccaggacagaaaaatacaggagtttcttaaggccaagaacagctttaagagacttcaaaaggtagtaggcagggagtggaggatcagcttgcaaggaaaacagaggagtgaccagagatgtaaataaaagaggttgtaccccagaagc

SEQ ID NO: 156469 - DNA, 567 bp, Homo sapiens
tctgcctcccgggttcaaatgattctcatgtctcagcctcctgagtagctgggattataggcgcacgtcaccatgctcggctaatttttgtatttttagtagagacggggtttcaccatgttggtcaggctggtcttgaactcctgacctcgtgatccgcctgcctcagccttccaaagtgtattttttacactttttgtatttttagtagagacggggtttcaccatgttggtcaggctggtcttgaactcctgacctcatgatctgcctgcctcagccttccaaagtgctgggattacaggcgtgagccaccgcgtccagcaagccaaacttcttagaagcgtctgtattcctgtctttgtcctgcaagctccaatgtggcttccaccctgaccttccacattcacatccccactgagcttcctggagactctgtgttgccttttccaggggaggttttccatcctcatctgctgcgctgtctctgcagtactggagatgctgattattcttgtggacactctctcttcctttgccttctttgccaccgcagtgctgattttcct

SEQ ID NO: 156470 - DNA, 698 bp, Homo sapiens
atgcttaatatctagcactggaaatcagtgatgggaaagtgcaaggggaaggaacattttatatgctttacacttgacaagaacacttcatcctctcccattatttgctgtgcatacagggcagacaaaaatattgataaaagctggaatatactcacaagttgtatctttgataacagttcctataccagttaatagaattttcttggactttatgctgtctatgcttgtgcttaatgtaagtctttgtgtacatgtaaggagataatatgttgaaggaaagatcgttagtttggaatcccagataatccttgacttttagtaacacagttacttaactttctaagtattagattactcattttgttattttttttagatgatctgtggtctaccttcatataagtatagaatacatattctagtagggaggcaaatttggagtttggtgggttttttttattacaaaaatacagtagtgcttatgcatagggtaaaattttatagaatatgtggaaaaataaccatctccaagcccatcagtgttaatattttgacttatttcctcctaaacttttgtttttatgacctgcatatgtttaaaataacataggggccatctgtattgcattttatctccttcagctaatttgttagctggatctaatgtaccaagtactgtgtaccagatctgaatt

SEQ ID NO: 156471 - DNA, 426 bp, Homo sapiens
ccacacttcttttccatcttgaagaccagttaaaactacctctggccaaaaatgttagtgttactagatattatcaaggtgtgagactaaaaagttagaaggctttaagatgtaaattatataagttaatgttttctttccctaaaagttctgacccttgctgacccctcaatcaaatgtttttaattgaaaggggaaagaaaatatcagagaacttaaagatggccttcgtgactttgactcaaaatcaatgcatttcattatgtatgggtcctacaccttgcttcctcaagtggccatgaaaaaaaatctcacgaccatgcaaactgatgccaccccaaagtcatggtaacgatttgaattgctctcagtattgatgtcaaactccctcctgttgtcagcagcttattgcaaactggccattct

SEQ ID NO: 156472 - DNA, 773 bp, Homo sapiens
gctttttgatgccttttgttcccagcactccagcttcaatcttaactagaaatcacccaacaaactgaaaaagctcccagttctggaaatggtactttgcagctttcattctgcccgtaatacatttgaaagcaccaagtttagggtctcagcaaaaagccaaagctgtctccatgtttcatttgaaggtacttttgttttcagttgtttctttgtgcatgtaagagcattttttgccctgtttttgtttctttccttcttattgaatggaacaattctttaaaaccttgtacctatcctgctttcagtttcttctgtttatttaaagcctgagtatttcttgtttagttataacagcagtagtacatgctaatgggaaagaaaatggagaagtgtgtaaactggaaaataaataaaaatgtcctgaataccacattccttccctcccctggagggaaaacattatcttttttttcccgcatccttccagaaattttctgcacatatatgagcattttaagcacacccacacgcacaaatggtttcccgctatacgtactgttctgccagtatatcttggataagtttccgcatcagcaaatgtagattgacttcatctgttaacagctccttagtaattaggggataatttctcacaactcccctattttttctgggtttccaaacaagccgccttggatctattcccagggttctccccaaatagtgctcttccagttctgcttcctttaggaaggagtttcatcttctag

SEQ ID NO: 156473 - DNA, 114 bp, Homo sapiens
gggtaagggctgcattccagacaaaggaggcaatagcctgattcaagacaatagaggtacaagaccctatggaatatgacgcagagcttaccaagggggtcacttaatgggata

SEQ ID NO: 156474 - DNA, 217 bp, Homo sapiens
ctctcacttacactgtaatgattcaaatcgatttgcaaccaagacttctatcccaatctcagacttgatcatttaaaggctaagggacaattctatctggatgttcaccggcatgttacactcaacgaacactaaatggaacctaccttccctagtaaatctcttttactcttccctttcctccattggtcaatgaaccactttctctctgattctc

SEQ ID NO: 156475 - DNA, 382 bp, Homo sapiens
aatgaggctattgggttaagttatagtttccaggcagtgggtgatgagaaccaagatgatggggttcagatcctcctgagaaccccttagaggcagctgttgttttgctatgttaattgtaaacgaggattctgcagctaataaaatgcttgaaactcacgaggccatgtaacttaaaggccttttgaccattaaattcagtgttttcctcctctttctgtctcctgcttctctccctcccctgaattccttactcaaatccctgagtttgctggcagagacttcatgattcttcagggttgcagccctaagtctatcttgctatctctctagaggctggactctgccctttcacttgcagcatgggagaagaattgtttct

SEQ ID NO: 156476 - DNA, 102 bp, Homo sapiens
aaatggttcatctcccaaggtctgctgggtggttttggcttataggaaaggaatgcacaatctaatagcccttctaaaacccccataaaaaccatcattaga

SEQ ID NO: 156477 - DNA, 249 bp, Homo sapiens
tctagaggatcccagttcccatttacctctgggggaagctttctatgaggagcattgtttggggtctctggagagcacagttcttggatatggcccccaggcagagtgagcttgtaccacaggggtgagggccttgcttagagctacatgggctggggctggggaagtgtgcctcatggcacataattgcgaatggtcttttctcagagacccttcatctgcctacctcatgcttatgagcctggtggt

SEQ ID NO: 156478 - DNA, 228 bp, Homo sapiens
tgggccttctcctgggagagtttgattcattaggtctataatttaacagactccccaggtgattgtgacacagcccgtctgtcacagggaagttaggaactactgcgatagagagtagaaatagagctcaacagagaaggatttgaggggaactttagcaccacaaagggtctgtgttgttctttgtgcgtaggcctaaggttgaacagggaagccattaagctttgt

SEQ ID NO: 156479 - DNA, 411 bp, Homo sapiens
ccctggaagccagagttcttggaaggaagaaatacacatacagaatgggagaaggccttccttcatcccctcaaccctcagctttgtggcctctatcttggactgtcaaaggccagtttaaacaatggtcacacagagattcacacttctcgcaagccccaactcaatctcctgccatgtttttcaggaaagcgttaacccagttgtcctgagttgctccaactttgcagttctcaagaaagccctattctgtggtgaggccttaaacagttcttgggaattgagatcttggaatgttctaacttctaggaatgctttaaacacttgggaccttgagccatattatgccaggctttctaaatagtttgtatgaggaatgtgatttatgaacaaactcatttcctttgggga

SEQ ID NO: 156480 - DNA, 477 bp, Homo sapiens
gatgcacagccacgcccagtgtctcaggatgagtgaggcgcagccatcgccttgggccagggtcaccctctctgctctctgcagagctggctgtggcggggccaagtgaggcggttctggggatcgggggccaggctaggacctgtccctggggaaggagggaatgtggatttcctacacccatgccgctgagccaggctggagggaacccccaacgggagaactttctggaaagatgcagttcttccctcctaatgtctccttcccctgcgccctcctgcagagccaaccgcacctcctcccactaagcccccagcttctctctccccactcaatggagcaggaggggctgctgccttggggacaagactgggggagcgggacactcacctccaaggccaaagaactcagccatcaagggccaggatattttaatcaatattttaaaaagtaaagttatgcagagtccatgctgat

SEQ ID NO: 156481 - DNA, 180 bp, Homo sapiens
tacattggttgacttgaattcagctctgttgttatacagtcattatatacttattcagtgaagcagaagtcctattaagaactgtagctactgaaaactttgtaacagcatccactcaaattggttttggaataagtagatcatacataaacctctgaaatagcggtagtagattcattt

SEQ ID NO: 156482 - DNA, 425 bp, Homo sapiens
gggagttgaggtctccctcaactgtgtggttgtctaagtcatgttgtaggccaagaagaacttgtgttatgaatcggttgttccaacgttgggtgaatatatatttaagatagttaagtcttgttggattgtacccttcatcattatataatggccttcattgtcctacttaatttttattgctttaccatttgttttatctaagaatagcaatgcctgggctggacgcggtggctcagacttgtaatcctagcactttggaaggctgaagcaagtggattgtttgagcacaggagttggaaatcagcctgggcaacgtggcaaaaccccatctctaccacaaaatacaaaaattaaccaggtgtggtggtgcatgcctgtagtcccagctactcaggaggttgaggtgggaggatcacttggga

SEQ ID NO: 156483 - DNA, 393 bp, Homo sapiens
taccgctgggtagggcggatgtggacattgcaagcgtgggtactgtggatgaagacacggctggacagtgtaggagtgggcactggggatgagctgggcagtgcaggtggaaggacctgggagtgaggaaaggctgcagcccctgcactgctgctgccagaggttcccacctagcaggaggtgatttgcattcttcttgcagtgcctgtaacagtgtatacagttgtccctcagtatccttgggagatccttccaagactcccaatctgcagatgttcaaataccttatttaaaacaaattttatttgcatagaacccaagcacatcttcccacatacttgaaatcatctatacctgaaacaatgtaaatgctgtgtaaataggtattctagt

SEQ ID NO: 156484 - DNA, 485 bp, Homo sapiens
attccagctactcaggaggctgaggcaggagaatcgcttcagcccaggaggcagaggttgtagtgagcacgagatcgtgccactgcactccagcctggtgacagagcgagactccgtctcaaaaaacaaacaacaaacaaacaaacaaacaaaagaactctagggacaaggccaccttaggaattgcaggaaggagccagcccagagactagcggccctgtcccttgtactgggacaacttcgggtgggatttcccaagactgcaaaggtcccaggtagcttagagtaaagggcacctaattaggaacaaaaagatccctgttcagccaggcacagtgattcatgcctgtaatcccagcacttcggaaggccaaggtgggaggatcgcttgaggccaagagttcaagaccaatctaggcaacatagtgaaacctcactttacaaaacaaaaatgaaataaattaaaaaattagccaggcatggtg

SEQ ID NO: 156485 - DNA, 204 bp, Homo sapiens
tatggcaatgcctactggggacatggcactttcccctcctgagttctggggttctgtagaacaaactgacttgcttctcgtgggcaccgtccccctcgggcactgacgccatctttcatcccagcaggtcagctgtcattcttttgcctgcgaggtcttcacctcctcctcgtcctcttcgagccgtcagacccggcccatcct

SEQ ID NO: 156486 - DNA, 653 bp, Homo sapiens
cattattttaagtaggctatagagccttagggagatttaaaaaagatatccacaaacttaagtagtggtcaagataggtcctatatagaaggttaaaagaagtgcgattattgaagctagaatcaaatggctatactttgggagagcagagtgaacatgggtagcaaatcaaattttagtttatgagggatttttgaagggaataatgtttttggaaggaaaattaccaataagatggcaaaatgtggactagatgaccagccagcgttggctgattattctgaaatatttcaaggtgagagaagatgctgattgattctatgtaggtttgttttttatttgaccgagagcaaggtgctatttcaggtaatttttaatgcagattgctgttcctggattctgcttgtctcagtgtaactttttttactctgcccagcttctaaatcttagctttttgttctactatttacctctgtatttctaaataacatcatcatactgcagttccttggtttccaattttatagctgtctcttgacttcctagtatgagaaatgaagatttagccatctaaaacctcttctctacccttatttcacttgccctattatctcttaatgcaattatattacgttttgaaaattgagtcatct

SEQ ID NO: 156487 - DNA, 148 bp, Homo sapiens
tagtttactctctgtcggaagggaccctataggctgctccttctttgatacactgttttcctctcaactaaattatgttctttgtatagctgaacagtgttgcctaaacatatctataaaaagtcaggaacatgttagtatgattatg

SEQ ID NO: 156488 - DNA, 406 bp, Homo sapiens
tattcatgaacttggcacttatggtctgcatgagagttgcataaccataactcgcaatgggagaggtgaattgaattcacctctcccattctttcttgaaatcactctgattagactttgcctccaccactgtacttctgtgaagttcattacagcagtgctaagtgcacaagtctgttcccacatcgcatcttacgtggctaacagtggcgcttgattgagcagtttactctttcctaccagaaaccctttctccacctggtttccatgtcactgaccctcttggcttcttcctttattcctggtgctccttctctatttcttttgctaggccctctgcacctgctcagtctccaaaagtcagaaggtctcagggctcggtcctgcgctctcttttcttttctat

SEQ ID NO: 156489 - DNA, 543 bp, Homo sapiens
ataccacttgcatgttctccagttttggcccgcccaaaggggagccccgagtcatccacggcagggtctgccacctgagtccgctgttcatcacaccatactgcagttctcctctgtctgagtttcataccaaggggtacagaggtggccacgttgaaagcggcccatgtgacagtgcatagcagacagtggacgggctgggcaagaacaccaccgagagcaagtgcagggagcattcagaaataacagtggggagctggaattccttaagcctcggggaattgttctccatgttttaggtgatcagccccaagagacacagcttgcaggtttcattaagatggtatataatgggggttcatgtcacaacataagagtaatcagaaaaggggtacagaggtggccacgtttgaaagcggcccatgtgacagtgcatagcagacggtggacgggctgggcaagaacaccaccgagagcaagtgcagggagcattcagaaataacagtggggagctggagttccttaagcctcggggaattgtct

SEQ ID NO: 156490 - DNA, 376 bp, Homo sapiens
  misc_feature (14)..(14): n is a, c, g, or t
ctactactactaanttcgcggccgcgtcgacgggaaatatttctgcaaaatgaaagccaaaggaaaaaaaaacctgatgatgttaattctgcaatttaaaaaatacactttcaaaacatcccatgctttagtgcctagtgcctttaaatacccttggggaaattactttttgcttaaagaaagggacggaaattattaataggagaagtagaaaaacagatggcctggagttgcctatgcaatgcagtgtttcttatctctggtgaactcagctgacccaaagtttccatagaataaatttcataaaacatgacttttaaaagatgaaagttctggtcgacgcggccgcgaatttagtagtagtaggcggccgctc

SEQ ID NO: 156491 - DNA, 598 bp, Homo sapiens
ctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgg

SEQ ID NO: 156492 - DNA, 489 bp, Homo sapiens
agcattttttcttcatatggattctaacatataattcaaaataattaatggtcatttctttgattaaattgctatttagggtagggagtggttttaaattttatattttgtttgcttaagagggctggtgtgaaggcttgacatctccccgcctatcctccaccacacacacacacacacacacacggagagagagagagagaaacagagaaaagtggtggtttgtctcttgtgttgctgtggggttttgttgtgttttcgttttgaacaattttctaaaggtctgtttttccccattaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgg

SEQ ID NO: 156493 - DNA, 330 bp, Homo sapiens
ggaccccaggggtggagaaaaggaaaaagtctagcgagtacctaagtaattgacctcgttcctagcatggctgctatgccacacaattacagagtgtgatattgtaaaggatcagagaactgtgggctctgcttgaggcactttcaaacctcactgctctacctgaattgaagctgaagcctgtgggatgattgacttctgactttctggcagtgaataggcagacccagaagggaagtgggtaggaagtagtgctggcctggccctgtttatcttccccactgtaggcagggggattgtacacttgaaatcagcatgagagtggccccc

SEQ ID NO: 156494 - DNA, 449 bp, Homo sapiens
atgggagtcactccagagtactggggttggttaaaatggctggaccctgtctctccagagacctccaacccctcaatcccacatggccccaagcatcccacagcagctctggggatcaggtgggcagaggaggagttagcatgagaaagcaggggctccaaagcctgacctcagtgggattggtgaggtcctaggggtcagactcacagacggggaagacactggcatctgtgaacaccgaatgggtgtcaccaactcgtacatcaacaagatccaaacagtgtcagggaagtggcaggttcagggactgtggtaaacaggggaactcccatgcccataccatcctcagctcaaccaattgttgccactatcttctaatttttatttgaaatctcccaatttttaattgttggcatctaattttaaaaagaaaaatcactgtatgaacc

SEQ ID NO: 156495 - DNA, 444 bp, Homo sapiens
cattctgactggaagggccagagccgtgtctaagggcgggggccgggaggtggcccgcggtggtgtctctaccaggacgaggcctggggtatctgaagaggggatgacgtccaggcgctttgctaaagggaagccagaagggtatgagttgctagggtcagagatggggctttcggctcgagtctttccctgcagggcagagagtccgaagagcccgagaaggcagggaggacagtgggcctggtccttccccggccggcagagggagtcccgagatggaacgtccagctctcctctaacgaaaagcgtttgcatggctgtctcgccaattctgtacctcccggggctgaggaagagccgaggtgactagaagctagcgacaagtgccggccacctccgacgccaggcgccgggcttggagcccgacgggccgaattctcgcga

SEQ ID NO: 156496 - DNA, 214 bp, Homo sapiens
gatactgagcataatgaaaagtgagataactgtgaaacatccaagcaggtatgtagtgatacacatcatataacagggtttagctgatgaaagctataaatactgctagtatctgggctaagaacacaaggaatctttacatgaatgcattcgttgtttcagatggttgcaaacatgctacttttctgaccaggcccccccttattgctcccgt

SEQ ID NO: 156497 - DNA, 185 bp, Homo sapiens
tatctgtagtcaaaaataatattcaagaaaacattacagaaataaaagtagatctagatctacatattgaaagggcacaccaagtcctaaaaactgacccagaaaaaatcaacacaatttcaaccctagttgataccggtcataaaaaagagttctttgggcattctggcaaaaagactaagtca

SEQ ID NO: 156498 - DNA, 459 bp, Homo sapiens
taacccagggatgtatcatctctccagaatgaaggcatcattaaccttccagtggactcaaaacttccagatgaatccttaatttgaatattctaagatttggttctttctctgctttctcatttcatcagccttagaactggtgaattctaaaagctataggcttttagaatataaggaaacaagattttgcagtaaattaggctttgcattttgaggagttattacttaccaggttatatcttaaagcattggtgcagaaaccgcatatttaaaaacctttcctctcttggagcaaatggtgtttgtctccaatatactactttttctctccactcccgggagtggagagagaacgggggagagagaaggaggcttggcacacttaggggcttacctgcttctcaggactctcacaaatgtctaaccttttcagtatctttatgttctctctgtgca

SEQ ID NO: 156499 - DNA, 370 bp, Homo sapiens
taacccagggatgtatcatctctccagaatgaaggcatcattaaccttccagtggactcaaaacttccagatgaatccttaatttgaatattctaagatttggttctttctctgctttctcatttcatcagccttagaactggtgaattctaaaagctataggcttttagaatataaggaaacaagattttgcagtaaattaggctttgcattttgaggagttattacttaccaggttatatcttaaagcattggtgcagaaaccgcatatttaaaaacctttcctctcttggagcaaatggtgtttgtctccaatatactactttttctctttcattccttctttctttgcatctatattatctgcatc

SEQ ID NO: 156500 - DNA, 250 bp, Homo sapiens
aactccctatactatttctgcaactcttccgtaagtcttacattatctcaaaattacatatttaaaataaataaatctggccaggcgcagtggctcacacatgtaatcccagcactttgggaagccgaggtgggtggatcacctgaggttgagagtttgagaccagcctggccaacctggtgaaaccccatctctattaaaaatataaaaattagccgggcgtggtgtcacatgtaatcccagctacttg

SEQ ID NO: 156501 - DNA, 405 bp, Homo sapiens
ctgacgggtcttcaggctgcctggctgatctgtctcggggcctctagagtagctgcttctccaagcggttccaatggcaggtacgatttgttctagggctctaaaccccagtcggggaaaccctggcttaggcagagtccacccagtcccgcacattttcgcggatctctgtgcctggcagaaggcaagtgtccctgcagcctgttgtcatgttcagaaacaccttccgctggatggcactgtggctccacagatgacagtcacgtcttttccttcccttcccttgcctttgtctttctccatttgttgcgaacagaataaaacaaaaacacacacacaaagcgaagaaacaaagaaagaaacgggccaaagagcacccacctcatctacagcagggctccccac

SEQ ID NO: 156502 - DNA, 283 bp, Homo sapiens
gggccctggccccgggctcagggtggtgaccgccagcagggggaagtccctcttcctgccattcccccccgaccaaccctctgtatttcctctttggaggggcagtgagtgggaagggaggacccacaggtgtgcagcggccatggcccgcatcctggctgagcacctttgctggtgtggagggactccctccagtcactttcagacctcactccccatgctgctcccacaccagggcactgttcccacgccatcctcctttgaagggcactacccatcttcc

SEQ ID NO: 156503 - DNA, 354 bp, Homo sapiens
taccgcatctgatttgatattgtgctgtcagcatgagtccctctcagcttcccaggcaggccttcacttaccttaagccatttcccccatgtgaagaggcagaaggcagtcatggagtaacccatgatgagccagtggatggtcagttgcaccagagtagaaggcttggaggatggtaatggaggtcaggttgcccaaggcaaggctctctccaattagcctggcagcctgaggagggaggagtagctcatcagcagcttgtccctcatttcccctttcacctccaccctggaggcctgcctgtctttccacaataaaaatgaggaattccgtctggaagcaggccaggcatcc

SEQ ID NO: 156504 - DNA, 364 bp, Homo sapiens
agtgctggtaatgtgtggccaaaaacagaaaaaaatgactcttctgtgttttatttttctccaagaacccgagtttccagactcttagtgatctgtgcctctgtcgctcatttctgaagcaggaactttagtgttgctggcaatgtcagtgtcatttgtagactcactcagtaaagagatgtctctttggggctctgttatagcaccattttcttcttagaacaaatatcaagatgaatttctgatatttttcaactccatattgctaaaaagtggaataaagtcacctaagatatggatacttctgaatttggcttttctatctcttgatcatttctagctattgatttccattgttttggtt

SEQ ID NO: 156505 - DNA, 276 bp, Homo sapiens
ttgccatgtcaccattccgaggcagtgttcccattcctttaaatgcacagtgggccaggtagacatagagtctgattatttgttctctctctatcaggtagagtacagttcttctctgtggctagccttgaaatcatttcaggctatctgatgtgtgtgagagatagaatgacattaaaatagcaaaacattatcagctcttatagaaagcgttttctttgtcctttagacagattttttaaagcctttcagtaggcaatgaagaaaaaccccaaa

SEQ ID NO: 156506 - DNA, 311 bp, Homo sapiens
ctgggtggggacttcccagagcgcctgtaatgctgagatctttcctccaggcaactcctccttggtttagcctctgatacagccaaacctctggattcagggaaacctaaggaagccaggcaagaagggtcccgcagcctgtgcctagtctagccccagcctcatctggattaagatgggagggaaatattggctgagggcacccagccagtatgaagacagctagaatgtaaacccagcacagtaagggagagagtatcaaggcccaggactttagagtgcctcaccaccaccaccccgccgctgggcag

SEQ ID NO: 156507 - DNA, 230 bp, Homo sapiens
  misc_feature (216)..(216): n is a, c, g, or t
aaagtcacattgaaaaagacatcaaaaacaaagttaataggtaaatgatgaacttgaacaaaaaaattccagcagatgacatatttttctactatgtaaagagtttttacaaatgtctaagaatatcccaataacaataatggacacagcatatcaacaagaagacttaaaaatcaaaaaagaaggtgtgagccaccgggccgggcaaaatttttntttttctaaattcc

SEQ ID NO: 156508 - DNA, 435 bp, Homo sapiens
tagaggatccccgaagcgcacgaatgggcgtcacagatgtgactttggtcgtgtcatttaaactgactgagtgtcagtttcagtttcctccgatatactaaaatggaaacaatactacctagtatgagagctttaagagatacatacataacttcggtgacacaggcacttggtcatgtaatttgttatagttgttgggggtagcaggatctgtgcttctgcttgatttcctttcatgagtaaacaaagagtaggggaattattcaagaatctctcggcagggtgtggtggctcacaccagtaatcacagcactttgggaggctgaggtgggtggatcacttgaggccaggagtttgagaacagcctggccaacatggtaaaaccacgtctctactgaaaatacaaaaattggcaggatgcggcagcatgtgcct

SEQ ID NO: 156509 - DNA, 421 bp, Homo sapiens
atctcactgacttctcatgagcaccccgtggactggcctgctccccctgtgcagcacacacacctgcccgtgtaataggtctgtggcagtgctcgaacagtggacgtgttcatccagcagtggggacacctaacactcatcatgcatggcatgtgcgtcaggatggtttttcagcatcaggaacatgccactgattaagtaataagagtaatccttccacttgatgaagcagaatgcacagcatttgagctgttgacaggcggccacccaacctgatgtgtcattctgatctgaagcaaagaacctctcccttgtcaccgtgggcagaggtctttgctttgtctcctctgctcactacatccccacacgagaatcaggaacgccctgcgtatctgtgtggtgaacgagtaagtcccgggag

SEQ ID NO: 156510 - DNA, 435 bp, Homo sapiens
cgtatgtgtccaccactaatctatatatacatatgctatgcactgcgctcatgatgtaaagtatctctaattatgggttcgaaagccacaattacaaaaattagccaggcgtggtggcacatgcctgtaatcccagctactcaggaggctgaggcaggaaaatcgcttgaactggggaagtggagcttgctgtgacctgagatggtgccactgcactgcagcctggacgacagagcgagactccatctcaaaaaaagacattcagttggtaatctgaaggattaccaactctccctattggaaacaaccagaaaataaacataaaagtgtctgcaacataaggtagataggtgggatgcatcatattgagatgatactaagtaccatttctactgtagaggaaaatatatgacaattatcactgtcactgcctga

SEQ ID NO: 156511 - DNA, 396 bp, Homo sapiens
gagggcagctgataccttgaggtcgcacagacctgaccctgaccctgtgcagccaggtgtgactagatagcagagaaccctaactgcgtctggccatgtctgtccagcactgcaggggtgtctcaacctctgagagtgctctgcccacagtgggtgacaggatccttaggtcagagcctcatccttgtcccttcaggccaagccagggagctggtggcggggagtgaagaggcccctgagaacggctagtgcacatctcagcaggaatgtgggagggatgcctgggccagagagagcccatcatcccttggcccaatggggaacccgtgaggatgcttagcttagctatccagcttacctggccacagggtaaggatgggagagggtgactgggtg

SEQ ID NO: 156512 - DNA, 681 bp, Homo sapiens
cgtgcggtgtaggcgcatcttcgctctgttggccgtggctttagtaagcacacacctgcctgctactctggttatcgtggcgacggcaggtctggattgccagacaggtttttctttttacctcgaggctttctctgaagggagtcggagcatttaaaaggcggcctcaaggtggattgagtcgggggaggattagcagtatttgcttaggttgtaaaaccgcgactttatctaataaatcgccattcaaggtgcaaatacaaacttggaacagaggtgcgtgacatgtaccccttttgtcctaaagtcaagaatcaataatgtgacttagccctattatcttgcctctaattaagcgattctcacttattctttctctattgctaattctcacgttacatttccccttttctgtgtccacctttctcttttgcgcattgatataggaagtgttttgtaataggctgtagctttttctcttactgttataaaaaccaggacatatagcattactacaaaatgagatactccgtaaacactttaaaagtgccagctatttaatgacccaagaaaatactcgtgatataaaagttgactaagtcaggatattagagtagtgtagcgactatagaagtacaatatagagcgcaactaaaaagtgaaaatggtaactctgctgac

SEQ ID NO: 156513 - DNA, 386 bp, Homo sapiens
gttgcattcaaatggaataaatcatatattctatttctgcccactaacatctgggcaattttccaatgcaataagaattcaataaatttataaactattactagagcatgcaggcctcttgtttttaagtgtgtataaagattgtttactagctggaagaggtaactcatgcctgtaatcctagtattttggaagggtgaggtgggcagattgcttgagcccaggagttcaagatcagcctgggtaacatggtgaaacctggtctctacaaaaaatgcaaaaactagctgagcatagtggcagacacctgtggtctcagctactcaagaggctgaggtgggaggactgcttgagcttcaggaggtcggggatgcagtgagccaaga

SEQ ID NO: 156514 - DNA, 420 bp, Homo sapiens
ggttcccccatactgttctcgtggtagtgaataagtctcacgagatctgatggttttttaaggggtttccacttaacttcttcctcattctcttctcttgtctgtgccatgtgagacgtgcctttcaccttcagccatgattgtgaggcctccccagccatgtggaactgtgagtccgataggcctctttcttttgtaaattgcccagtcttgggtatgtctttatcagcatcatgaaaatggactatcacagctgccaaggtagaataccagactgatctattagcctgttgcattttcactgctaagcatttgagacgtgtacagagcttcaggatatctattaatggaagggaacttattgctcacttgtgggattcagagacgtgcttttgagtcagttagaactaaaaagatagt

SEQ ID NO: 156515 - DNA, 216 bp, Homo sapiens
attgaggaagcatcctaaacccagactgaggtgatgctgaaagggtgggggagggtcactgaagagctgatatctaagccaagtcttacaaaaaaaaaaaatgagagtgggagaagagaatagtatgtatatcaattgggagacgaatttggctagctccgggtttctcaatcttggcactactgacatcttaggttgaacaattctttgacactg

SEQ ID NO: 156516 - DNA, 403 bp, Homo sapiens
  misc_feature (15)..(15): n is a, c, g, or t
tcacatcgagctcgncccattatgtggctcaagcgcagaggaaaaagaaaggataccactttgaaccgtaaacaatagtgaaaggcacctttccgagaaggagcccaggaaacccaagagcccctgcagtttcaggacatccttggagaaatgttttgaaattaagcctagctgtggatgagtctgtctgtggtatcttgcaggtttgcctaggacggaccctcttatttgtcatctgtagcttacaggacagcagtaggagtctttcccgagtctgaaatgatcagtaccctcctctgtttttctgcattccctatggcctatagcctattacttcatttcactccatctccattatttaaactaagctaaatgtaatcttgtattcgatcatctgaaactt

SEQ ID NO: 156517 - DNA, 507 bp, Homo sapiens
accccaccagctggcctgcccagaatctctggacaagctgactggtgaagggctttccctgctgaagccagcgtgcaaagactgaaagagatgcctacttcttcaaacgcacagacatcaacacaaggcaatgaggatcacgaataatcaggaaaacatgacaccaccactaaaggaacaaaataaagcaccagtaactaactctaaagaaacagagatctatgaactgcctgacaagaaattaaaaatagtaaattttaaagaagatcagtgagctacaagagaacacagacaactaagcaaaatcaggaaaacaagacataaagaaaatgagtgagatgttcaacagagatagaaaccataaaaagaaccaaacaaattctggagctgaaaaacacaacactgaactgaaaaattccacatacaaatttcaatagcagtttccatcaaacagaagaaaaaaatctgtgagttcaaaaacaggacatttgaaattactaagccagg

SEQ ID NO: 156518 - DNA, 494 bp, Homo sapiens
ggcaaaatattggaaaagtgacaagaaagggatataattttgatacctggttcacccatgtttcccttagaaaatggaacataggttcatgtttttttaaaaaaaatttactgagtacacattaggtaccaagcactgtgttagaagctgagactacatatgaaaataaaatatctctaccttgagtgagtcatatctccagcccctgctataaagaaacaacatcagtggaacatcagacatttgcatgatggcttgtttccagggcttgggttgaaatactaattatttattttcatttacttcactggaaatctgcatgccatactctcataagtgtcacctaggtgctccactgaacattgaatggtaaaagaggatcactaacagcaaaaacctggaacagggccagctcaccagcactcaatcaatactcatcatgactccactcctgggaactgagcttgggcccagagtgggtcacagcagcacat

SEQ ID NO: 156519 - DNA, 384 bp, Homo sapiens
tttaaaaaaaaaaaaaaaaaaaaaaaaaaaaaaaaaagaatgtctttcaagtgatatttgaaattgaaacatataaaaacacccctattgggaggcattttttatgagtatagtaaataatagcatttggttataaagcaaagtcagtttactttcttgtatttacattgtatattgacagttccaaacatataaatgcttttattgtcattctgaatggaatagaatgctccagtgactggctaatcagtgcattgcagtgatgattgatgcctataatgaatactttgctgcagccctccaagagcctaaagtaccatcaacagtgagccgagatcgcaccgctgcactccagcctgggcgacagagcaagactctaaaaaa

SEQ ID NO: 156520 - DNA, 554 bp, Homo sapiens
gtcagttttcttctccctctgaattggttcttgcttttgaatatatctgctccagcctgaactgcctgaattgtcttacccagagttgtagagtccacccatttacgttctgctgtattcattcactgtatagaagagttatttaaaacctgaacgtgtaaggcaaaaagttgagtggcatgctctttcaatgtcacactggagaagtatttaacaagtccacccaaggatcatttaattttctagaagaatgtatctgtgtttgactttgctatttagatactgtgaagttacatgttaattgtattttcatttctggtaagagagataactccaaaggttatgattttattagcctgcaggacattaaccagtttcatccgtaacctagcaatctaattttaacttttttcattttgaaaatattttttcctggtggattatataaagcccttttcctcgagtgctcttgcaagaatcagctttcccagctaatggctccatcataagctaacgagctgaataaaacctctgacatgtgaaaaaatattttc

SEQ ID NO: 156521 - DNA, 1073 bp, Homo sapiens
gtgttgtatgataatgttttagtgacactgtcctcaacctgaatgtagtagaaattgttacatctttggttcatttgaatttgacatgtttattctcctgcacaccttgtgttacctcagctctcccaccacttttctctattgcatttgctctcaaactagggagattttgtcactctggaggcacttggcaatgcctctgtacatttttggttgtcccaactaagggtgtgatactactggcatctagtaggttgaggccagcaatgctggtaacatctacaatgcacagaaaagctccttgaaacaaagaggcaaaatggcagttaatagtgctgcagttgaaaaccctattctatcagaattaattaaaaactttcgtatatatatgatattgtggtgtcatttgaccttagtacaaacaaattattgtcattttaagtcccaagttatgttgtaaacatttataaagtgctcatctaggtgatccagaatattcacttattactcttctttagagtaccatcaaaataaaaatacaaaattaagggttacccatggagaactcatggactgcctgttcactaatacagaatatatatctgtgatccctggtctaggaaaaatctttagctggtatgatgaatgaatgcatgtgagtttatttcttcatcttaaaagctcatcttacgcattaaaaaaaaaaaaaaccatgtagtacaagtttggttttggttttgttttttggtgaaatgttcttcatttgcttgaaaggtaggctttttcacctttcttcatactgctgttctaatgcaaacagtaggatctcaaaacagaatgttataaatatataaacaaaagaagcacagcactaaatttttcatagttcgtctcttccctgaacttggaatgtctgaggaacccactgggtgcagtggctcatgcctataatcccagctactgaggaggctgaggcaggaagatctgttgaggccaggagttcaaggctgcagtgagctatgctcgtgccactgcacctcagcctgggtgacagagcaagactctgtctctct

SEQ ID NO: 156522 - DNA, 294 bp, Homo sapiens
ggtaaaaggacatgggactggggcactgtaggggggaggcaaaggaacggagtccccacactgggcctgtgttagctctgagcccttcacgcttgttctctcaccctaacttctactcccgccctgtgcaattggcatagccctctccaggcagggcaggctgagtcaaggcagtagagcctagtggttcagggttcctcctccgaatcatggaggaatcacactgtccatgtctcagggttattgggaggataaagggcccaacacttgtaaagctctgagctttgtctgtca

SEQ ID NO: 156523 - DNA, 484 bp, Homo sapiens
tgcacctcctggggtactggctatggccggaggggaccagacaacatgcaggtggtatagaggcaaactgagacccagagggtgccggcgctgtgcccacccctacacagccagcccaccctggcctcagcagctgccctgttcaccagggcccacgtgcaggaccaggatcttggggtgcagatggcccagacctggcagcgaatgccgtgtggattcctggagaccacaggagccccctgcctggcccccaacccagccaaggcagcatcccagccccccactcataatcacattggaaatttttgattagaaaacaaaatctaaatgaggcgcatgaatattcattagacttggagattaatatgcataattatgcaaatcagacagcaattaaacaccaatactccccggggggaatgattaacacaaaggcaccgaaatagaaggatgcgatttgaaagaagtttctggtgtggatgag

SEQ ID NO: 156524 - DNA, 168 bp, Homo sapiens
agaatgataactactgtatgtacttatacagagttcaaacttataatggctgatctatgtataccctgaaaaatataccagatgcataagaacatcataaccattggacatattttcttatgctaaaatatgctagtcttcaactagtatcttctttcacactataca

SEQ ID NO: 156525 - DNA, 186 bp, Homo sapiens
tgtgaagtaaagcagaaagcaaatgacaaaagtatcatataataggacagggaatggcaggcacagagtccagggaccagaataccacatctttggggatagtgtcagtaggaggaaatcacaaatgatctaagacaaacaagaatgaaaaagcagaaaaccataagcatattttttgaaattatg

SEQ ID NO: 156526 - DNA, 1765 bp, Homo sapiens
cagggaggagaaaggaactgagtcaggcaagagctggggatagaaaggaagagtgaggaaagcagcgtccaggaggaagccacaagctcagaggggacaggaaagggtgagctggtctccccagggagcagttgagtgcctgaccctactctctgtcctaaaacacacgcgtgtacacacactcacacttgcctcaaaccaagaccctgtgacttgtggtaccccaccgccacgctcccttagtaaagccggccagtcacacatctgaaagagtccagactgaccaggtgggccactgccgaagtcctcactgacccctgtcctccataagagatgttttatacaaatggagtcttgcatccttcctagttattagccctctccaaaactgccccagcactgtgattagacctaacctagtcttcattctttcttgaatccaaatcccatcctaaccatgggcaaagcgttatacctatctaagttatttctgcctatcaaagcaacctatgtcattatagaaaaatctgagagtataaaatatgaactataggggtggtgggaagagaaggtggcagcaaaaaaaaaaaaaaaaaaaaaggaaaaaaaaagaactataggaaagaaaccactcatgacctcacacctattcaagctgaaaacccaaactagccctgctcttcataacatgacaagcagcgccccatctgatacctaaaccgaccaagtcacagccctccaactcaccctctgcctgcccagacctcaccacatccttgctggactcaaacctcaaccgcactaaatcaaccaaatcccaagtctaaactaatctgaaacttttaaagtaacccagtccttaaacctaacctagcccaatgccaattatatctaccctagccaaaccctaactgcctttgccagtccaaagtgtccactgaatcctcaccttggtcctcacttaaaatcccagaaaagcatatttccccactgcccacatccctccttacagcacccaaccctggcctctggactcctggtatcctgggatgtccaaactctgcagtgccatcagccaacaagcccgactcgtcaaatgcacctctctcccttcctgtccccacccttgcaggctgatggaaaggcctcattgaagtccaacttttccccacctaacaccaagaacggggtgaacctccacactgccaccgttccctgagagtgagcactaaatctccttcaatctaaccccaccctacacttcccacactcaggaatcacatcctagaatatacccaaaactaagccccataaggcagcccgaccctagtggtctaaccctataccttgcttcctatgggtgagtctgttcttggcggccgcctctctcctgcttcctcccttagggctgactgtgctcagcctgccagctctgacatgtgctgtctcccaccctctgactcccctcaagctgcagtgggactgaagactggcaggaagctagggtacaactggaacacaggcaggtcgacctgcagtccctaggcctggccccgtccctccatgtacacacatatacatgttggcacacacacagtggcacacatgccaaagactctctcagctgacactttgcatccagagacactttgcatccagagacactttgcatccagagacactttgcatcgcagagacacttgcatccagagacacttgcatccagtagacacttgcatccagagacacttgcattccggtatct

SEQ ID NO: 156527 - DNA, 513 bp, Homo sapiens
gcggccgcctctctcctgcttcctcccttagggctgactgtgctcagcctgccagctctgacatgtgctgtctcccaccctctgactcccctcaagctgcagtgggactgaagactggcaggaagctagggtacaactggaacacaggcaggtcgacctgcagtccctaggcctggccccgtccctccatgtacacacatatacatgttggcacacacacagtggcacacatgccaaagactctctcagctgacacacagatccattctcaagtatctactgatagacactcatgcgtgccaagtcctcatcctcaaacatacacatgcctctctttctctcccgtcttgccaggagtgtttcccctcctccatcccctctgcctcccatctggtgtcccaccctcaccccccacccagcccaaggtggggacagacacctgaggggctgccagctgcttccccgtgtgggcccgggccgcgctcatgcttctcgtccatcctgcccacaggg

SEQ ID NO: 156528 - DNA, 557 bp, Homo sapiens
ctgaaaatgcctgtttttcacttagccccttgccttcctccctcgactgcagtccccatcttttctcccgctgaaaaggaaaaattaataaaaataggagccaaagaaaattcagaagggaaatgggtgtcaccagaccaaagagaaatgttatccaaacccctcatgagggaaatcctctttcatctgcatcaagggactcattagggacctcaagctaagtgtgatgcagtcctcggggtctacagatgtataggaatttacattttggcaagacaagttacagatagttgcctagtatgtaagaagactaataagcagatcctcagaaaaccacctgttggagggagaaatccaggattaaggctgttccaaattgtccaaattgattatgccgaaatgcccccaattggtcacttaaaatatttattagtgatagatcaccttactcattgggtagaagctattcccttttcaagtgcaactgctagtaatgtactcaaggcattagttgaaaatattatacccaggtttggattaatagaaaatgctgattc

SEQ ID NO: 156529 - DNA, 166 bp, Homo sapiens
ctgccttagcctcacgaagtgttgtgattacaggtatgagccaccacagccagcctgtattctcacatttttgagtgactacatatgctacattgttgtaacttttgggatgcatcagtaaacaggaattcctcactcatggattccatattcttacagggagaaa

SEQ ID NO: 156530 - DNA, 558 bp, Homo sapiens
catgtggcaggagctgtgctagatgctgcgtatgtgtcaatactcctaaaatccccttcaaagtagtagcattgcctccaccttacagttagactaggctcaaagaagttcagggtcatagtcacaggcccagtgagtacaggggctgggatcccaacacagattcacctggccccaaagcctatgcttttctcaccacatcttatcctttagaagagtttagacttttggggcagggtggagaactactgaatgtctttgtgcaggtggggtggggtgtcaggagtgcaggaacactggccgtttgtgctgggcgaagcacaatgctgggaggcctgtaacggtcaaggtcagtgccaaggcctgtccaggttgagcagaggcagcacgtgagggatggactgtgtctttcgcctagcagccggctgagtttcaggccctggggggcactggagagggcgggcgcagtactgtgaaggggcatgccaggagaacccagcatctgtgtcacccactcagcacaatggaaacaacagagagcaagagcacagccaacag

SEQ ID NO: 156531 - DNA, 341 bp, Homo sapiens
tccctccccaggtcttcctggccacagggcgctgtccaggcaagcctgggcccctgggaaccagcgccacttcaatgtatgactgtgtgagtctgttcttgcgttgctataaaggaatgcctgaggctgggtaatttataaagaaaagaggtttattttggctcatggtcctgaaggctatacaggaagctggtagcagcatctgctcttgctaagggcctcccagaacttccaatcatgtgggaagacgaagggggagcaggcatgtcacatggcaagagaggagcaagagagaagtggtggggggtgggggtgggggcaggctcttttaaacaaccagg

SEQ ID NO: 156532 - DNA, 286 bp, Homo sapiens
gggatatgaagcttgtggtaggtgccctgatggtaaccagagcaacagtaaggctcaaacccagtccagcttctaatgaaattaactcgattcttgcactaatagcttagcaggagggaaaaacctgtaggtctattagtaggaattacccatgctgaaatacaaagagaaagaagagtgaaaacaagacaaaataaacagaattaagtatccaagagctatgcaccattatcaaatggtataacatatttataattggacttccaaaaagagaagagagaacaga

SEQ ID NO: 156533 - DNA, 159 bp, Homo sapiens
tagatttatgaaaaatcatcaaaacatttaaggagatattgtagcatccatcactctgtctttttgtttagtaggatgagggctgtggaaaattaaaagccttccacaattaatatgcaattagcaaaatgaaaaagctacgaacaaaactgctttaag

SEQ ID NO: 156534 - DNA, 117 bp, Homo sapiens
gagcatgtttgttgattaaataaggcaggcctctctctcatagcttgaatacattttttaaattcttggtaagtagtattgtatgtcataatttttattgcaggctaagaggaaaga

SEQ ID NO: 156535 - DNA, 240 bp, Homo sapiens
cttcattcagaaggaaccaactgagagtgggtaagatgggaatagaagttctcactctggtcagggactctatctggaactggcagctcagttttcaggctttaaactgtctttggcttgaaggttaggtttcactgggaatctgtctctgtctgcctatgaatatgtctgtctcctgctgctatcaatcccccatctgaagaggtacatctagctgttaggatagggacaatgaccgtt

SEQ ID NO: 156536 - DNA, 526 bp, Homo sapiens
gcttggtggagagtcatatagaggatgattagcaggctcctaagagaggaaggtgctggggagctgagagtggaatgctgggctggaagtgacagtggcgagcacatcaggggaaaagggaaggaagggaatctaggaagtaatgtggccttggtacatcaggaagatgaaaggagtattttctaagggagtagttgaggtagatgaacctattcatgttagaaaaggtgtttctctgggcacagtgggcaggctaggaaaggaggaatcagggctggtgtggaggacagtggggtttagaattgggagagtgggaggcattggagtgcgggtaggagtttatatagtggaagataattccttaatggagtccaagcagatggtggttagggaaggatggaaaggagggaagcctcagccaaggatggcagaggaagaagacaaaaagttcctgggtcctttatggaatccttgagtggattccataaatccactccgctctgatactgcctgcttctagtttctt

SEQ ID NO: 156537 - DNA, 240 bp, Homo sapiens
acatattcctttgaataataccttctcttaacatcaagaaattcaaatttcagagaagttttccacatgccccgggtctacttcatctgctactcactcttcaccctgcactagtcaagccttgcccacactgacaccactgaaacagctctggccaaggataccggcagctttcttactgctaaatccaatcaccatgctaggccctcaacccacctgactgcctgactgcgtctgaca

SEQ ID NO: 156538 - DNA, 1028 bp, Homo sapiens
atctaccccgattatagaggacccccggtccccgatgcacagttaaaaagtcacgggtgcactgcttgtggaagcagtgcagcttatattcactcagtgggggcctcaggaggtttaattgcagaggattgtggagctgttggaagtccttaacctcaggtgtgaagagccaaatgtgattaagtgattggaaaggaaccacaagttggactagtctctgtcctgggcacagcgcccaggagatgggcttgcttgagcagctcccactgtccctttgaaaagtgaggtgacaagagagccaaccccagcctccagggacacattggagataagtggggtctccagggtgggcctttcacagagagtgccctgtggcgtcaaggggaacccatggttttggccaatcaaggccttaccatgggccacaagtaggagggacagataaaaagggtaaaactgtgggtcttgacctcaagcaactactaatgatgtcgactcacccctaaagcaattaagggctggctgtgggggtgctcatacctgtaaccccagtactttggaaggcggaggtgggaggatcacttagaggccaggagttcaagaccagcctgggtgacaggaggagaacctgtctccaaaaaaataaaaaggaaaaatgagactttaaagaagttttggccttttggcgagccatgtgggattgcgccctgagacccccgggaatgcatgatcactctgttgttagaggcaattctttttaaattttttttctttttttttctttcacgtccatctgtgatccaagttaggggcaattcaaaggaggagttgaagcattatcttcctaaagagaatggaacctcacctgggaagatgaaatggactgctggggaggatagaccggtgaggaagtggggccagtattggggtagagagggtgacgtgtctgatttaggacactgttctaggactcatggggaactttggtactttagggaactgtgctgggaccggggatcctctcactc

SEQ ID NO: 156539 - DNA, 240 bp, Homo sapiens
ctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcc

SEQ ID NO: 156540 - DNA, 500 bp, Homo sapiens
caaaaatatcaactgcaaaagtacggttttaatttcagttaaatttaaaggtcattagacaaagtataatcaaacattgggcagacattttatattgtcatatatttagctaaactaggtcttttaagaaagttcttatttcatacacatttttatattactactttctaattattctcacctttcaatggaatatgtgtatacaatacatagatatcacttaaaatataccttataattgaattgcaaattgacaggtggattcctaaagtgaatattataatatataagcacaactgaaatttatttgcacagaagtgttaacagttgttgattctgtgaagattaccaaatcaaaagatgttagtgaattggctactgagactttttggtgtaatttattaaattcaacaccaaatctttaatgttcgtgtcgaatacttaaaatgctgaagactaaatgaataagacgtttatattatatttgaattataaatggg

SEQ ID NO: 156541 - DNA, 574 bp, Homo sapiens
atagcataggggcctgcttttaaaagagggataagcaagcaaggaactttcagtgcttaagggcacaggtggggcagaacatcaaagacagattccatctgtgctaacatttcacctttactccactgaaaattttctaagatgtcacctttgagacacactaaagcttatttttctagacaattaacaaataaattacatttactccaaggacagtgtaatattaatctataaggatattttagattttagaaagcatgagttttgaattctagtttattatgcagtatggtctgtgagccatgaattgtcttcatctttatgtccagcagataatgtggtaaggacttcttaaagctttttgaataattgaattaatgaataaaatttataaagttttctatcatctactaaacatctgcttgtgaattttaaagaagctcattttctataacattaaaaagaggctgtaaaacatcgtttttactaacaatttcattttatacattgcagttgtccttattgataaaagagaactttgtggtttgatgcataaaagaaaatttactattca

SEQ ID NO: 156542 - DNA, 572 bp, Homo sapiens
ttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcatgtgatgtgattgtagcacactacagtgtcgaacttctgggctctagtgaccttcccacttcagccttccaagtagctgggactacaggcacgtaccactgagtccagtgtacttgtataagattttaaaaaagattacacattctaaattatgacgtccacataccatttacttttctgtgggacttataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgacaagtagacaatcacatcatg

SEQ ID NO: 156543 - DNA, 322 bp, Homo sapiens
  misc_feature (14)..(14): n is a, c, g, or t
ctgctctcctcctngtctccgtgttcagaatcacatctgattgttttccacctcagcctggagctgtcttcccacactctctagctccttccttaggtggttagtctcatcttgtagctgctccaccttagatggccctgctgagagagttcatcttgaatttaggtggttgagcaagcacagcgatttacttgagcccacgagcaacctctgtgagagatgtgagcctcatccccgtccatttcacagaccaggaagccggggctcagcactggtgcccacaacgagccaggccctccccactgccctgcaccttcctcct

SEQ ID NO: 156544 - DNA, 517 bp, Homo sapiens
aagctccaggcaagaacctttgttcagcagggaactggcctggccagaggcagttgtaaaggcaaacaagttttggttaagccattgacatttttacaggaggagcagatagacttttagaggcagccagctaacgtcaacacattaatgcacttgtcagatatattgtgagcacctactacatcccaggcactattggccttatctgagtcatcccatttagtcataatgacctattgttatttattcttgttaagaggataccaaagcccagagagaagttaagcccaatgtcacataaaactggaacccagaacttaagctgttagccactctgcctcctggagcacagccttggccccatgcccctggcagtccccagcgggtatgagctgtgcctccctgagagcccctctcccttccagcccccaaagccatgccttcccctccactgggaactcagggagaaaacagcccagctgaaaaattaggccatgctgccgagcacactacttat

SEQ ID NO: 156545 - DNA, 584 bp, Homo sapiens
tgtgtcaaatataagaaaaataaagtcacttttgcataagaacaagcaggccagtgccttaaatgaagtccttcagcagactgcctattctctccttctttctcaataatgaagacttccagttttatttcccagtctcccttacggctaagtgtgaacattctccagccagcaaggtgtaggtaaaatgtatgatgcacaggaaatgtccttaaaagtaggcgacatgcccttctcatccccttgtctcctctctgttaggtaaaatgtagaggtactgacaagagtctggaacaggtatcttggaatacaaaggtaacttggaaatggaggcccacataatttaatgaacaacacggaagatgcctggacttcaagagggcatacaagccctgctccacctacccaaatgtgtccatgagagaaataatctatcttattgaagtcaacacttaacagactttgtattttctgttatttaacaaccaaaactaattccaactaatgtaattcctaatgcatatgggcctagattcatgaagcaattatataaaataactaatacctgtacctacaatcttgaa

SEQ ID NO: 156546 - DNA, 739 bp, Homo sapiens
atttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagagg

SEQ ID NO: 156547 - DNA, 328 bp, Homo sapiens
aataatccaaggagccctgcaataatccaagaggcgcgtaggacactagaccgcgcgacgtgtgtgtaaaaaactaaggcactgctaaaaagttacaaatagactctggtttccaggtcagcggaggcacagaggaaaggacagaatgaaaatgagtcacagtagagcagaaaggagaaaccagtgaaacctagagcgctgcctccatgccttttgctgccaaagcccctgattgcaggaccgtgtgctcacagagtgctgggcaggctggggaggtgaggtccgggtgcttcataccgacagccacggctggcctgtgacagaggag

SEQ ID NO: 156548 - DNA, 387 bp, Homo sapiens
aattgtaagtaatagtgccgatttattgattgagtgctctgtgtgccagacagcatgggaagccctgcgcctgcatcacaacactccacgaggcctgagtgctgttattaccccattctgtagatgagaaaactgaggctcaaaccgttaagtcatttagccagcatcacctggatcggaatgcagacctgtgtgaatgcagagattctgtgagtgacgcggcagttctgttccctttgcatttcatttcctgttacattcctgaagactgatgatgcttcagtacaagattcaactgaaggctgcattccagcatttgcattggccttggagtgccagagtaatatgttctgtcaattatttgaccttttaaaatatgccttcttt

SEQ ID NO: 156549 - DNA, 522 bp, Homo sapiens
gtcagtcggtaccaaatccatttctactaaagtacaaagtagcaggcgcggggccacacctgttatcctagctattcgggagcctgaggcaggagaatcacatgaacccaggaggcagaggttgcagtgagctgacatcgcgccactgccctccaacctggatgacagagtgagactccgtctcaaataaatgaataaatcgatgaacacaactggagattaattattgttaattttcttcttgtctcttcttatcctctagaattagactttcttgtacctaaggctggattcttctgtccaatttgttccctcttctactcagggaaaaatcaaagacaggatcacaaaaattgaaaataataattgttgctgcagagactttagggagttgatttaaaaaaaaaaaaacactcctttcttcctctactaaattaggaagtagttgtgggggtctcacagaagtcagacaagcaaagatcacagtgttttgtgaccgaaagggggtctgagatcatggct

SEQ ID NO: 156550 - DNA, 482 bp, Homo sapiens
ggttgtgcagcctctgatgtggcccctcctggaactcacattctggtataatcgcctaccctttgagtgtgtgctggacctagtgacttgtccctaacaaacagaatgggcaagagtgaggggatgtcacatctgagatcaggttagtaaagacagtgacttccatcttgtttgccctctcctgttccatcacctgctctctttgttgaagctagttgccaggctgtgagtggccctatgggagaggcccacctgcaaggaatagagggcggcctctggccaacagttggcaacaacctgagacccttagttcaacagtccaaaagtagctgaatgtagcccacaacaactgagcttgctcacaaatggatcctgccctggtcaagtcttgagatgagaccacagccccagccaacatctgaattacggccagtgggaggccctgaagcagaggatgcagttcagccacaccagcatccctg

SEQ ID NO: 156551 - DNA, 597 bp, Homo sapiens
ccagttgactaatttcagcttaagtaaactaataatttagttattgacatgtaagggacttaatgtcaactctattctagacatttttacattttctgtaaggcagttagccacaacagcccaccaatagcaccagctggatctcagttacaagaaaaaacagctcagaacattctcaaaaataatttttttttaagttgtggagtcaaataaccccagctctaccatggactggctgtgaaccttgggcaagtcattaacttgtttcctcagttataaactgggaatgaaaagagtagccgtctcacagagctatcatgaagatacagcatgtaaaacccttagcacatggctggtcacacagccagggctcagtcattagctattacggcttttaacatcagagaatgttcctgcccccacttccaatcctgagaatgctgagccagtagatgtttaagagtaggctccccaagacttcagttgggcagaggacacactttaaagaaaaaagggactgatgctcctttgacagacctgtgcttcccaaggtacaagccacatggtgtcatacatactactgcttacacatgcata

SEQ ID NO: 156552 - DNA, 279 bp, Homo sapiens
tgtttctgtgattaacacagcacatcgggggatcaacaaaatcactggaggaaataccctcatgtcatgcgaacctcttctctggattcatctcttgattatctcccaccttcgatgcaggagcctgccacacctaccacacgcgagcacacacgcatgcacacacacgccatgctgtcgttaagctcagtgggagggcgggaaggaaggcctgagtcagggtttttaggaggagcagtaattcaaacatttcaggatatgccgcctggaggttctttg

SEQ ID NO: 156553 - DNA, 493 bp, Homo sapiens
ccccccttcccccccgggccaccgggccaaacacccctttccacaaaaaaaaaaaaaaaaaaaagaataagttacttacaaaaaagaagcaaacttacaaagaccagaggctctagtcagtccactgctcctttatgttgttatctgaccattcattatctcagacacttactactgacttctataagaatccaaaaaacagaatttcactagaaggtgacagtcttgtttcagctaaccattcatgcccaagagcttaattacagggtggacctcagcccccaccttagtgtctctcaggtgggtgggatgaagtcagagaaaaggcagtgcagcaccagcaacacaggtccatcaggaactggagcttttcctactgtccctgcttcctcctcccgtgaatcccaacaatcacagccacagaaatagtaagcaggaaaaaacaaggaggtggcagtagaggagcctatttgtcttatcacagttattcatc

SEQ ID NO: 156554 - DNA, 531 bp, Homo sapiens
attccaaagcccataagcttttcaatgttttccgcaacttcagtccatttgttagcattttcatgattttcttcacatctgccatcacctgtactattgtttacttaatacttactttctctcttttgagacaggattttgctctgttgcccagactgtagtgcagtggcccaatcacagctcattgtaaccttgaactcctgggctcaagtgatcctcctgcctcagcctcctgagtagctgggactacatgtgcatgtcaccaagcccgccttctattttggtggggggaacagagtctcaaaacaacaacaattaaagaaggaaatgaacattttctaggtatgtcagatcattatattaaattttctcatcaattttgagagccatcgttttatcctaattttgcgcttcttttggatgaggaaattaggctcacagagattatataatcctctcaaattcattccaaagtcagtatggatatagttaagactgtagtctaccccagatttatctgattccaaagca

SEQ ID NO: 156555 - DNA, 281 bp, Homo sapiens
tttgtgggtgctttactaacattatttcacttcatcttttcttcataccacctctgtgaggttggtattattcattcaattttacagatgagaaaatttcgcagaaaagtaaataattgtataaggactacattgggattcaaactcaggagtgtctgattctaatgcctgtgctctgtccaggacacctcactgtacattatccaggaatttttattcctcgggtcctcagcagcagtagtgtaaaatgctttgtataagataaaccttaagaaaatttc

SEQ ID NO: 156556 - DNA, 321 bp, Homo sapiens
gtgagaaggggtaagatccagagggcaagtggaggaacaggactccaatttttttaaaagtgacatttttcttttttctttatcttttttgagacggagttttgctcttgtcgcccaggctggagtgcagtggcatgatctcagctcactgcaacctctgcctcccgagttcaagcaattctcctgcgtgtgcctccgagtagctgggattacaggcgcccgccactacagccagctaattttttgtatttttagtagacatggggttttgccaagttcggcaggctggtctcgaattcctgatctcaggtgatctgccca

SEQ ID NO: 156557 - DNA, 527 bp, Homo sapiens
  misc_feature (27)..(27): n is a, c, g, or t
gaggtgatctagaggatcccaatcagnttacacaagttaaggctcttttcacttcttttgtggatctttagttgcttcaggccatctggatgtatacgtgcaggtcactgggaatatgatggcttagcttgggctcagaggcctgacagtaatatgatgggttgagggaaagttatcagaagagaaaaagaacaaaaaaatttctagctttactggagaatgttgaagatggggtaagcagaggtttacgctagaaatggattcaagtagacaaactgtattatttcatcataaatgcctctactttgttctttcctcccattaccctgctcaattcttgtttttgtttttttttttttccattctagttatgaagaaaaacaaaaagagttattttgtcttgacccaatgcaaagatgaaagcagaaatcagatttaccctatgtaatagcttattactgggcaaagaaatgaagtacattagggaggccttttttttcctccaatggctgttagattgtgtattg

SEQ ID NO: 156558 - DNA, 908 bp, Homo sapiens
cggagtgagggtgaggacaggggactggtctcccgaaggagtcccgctgacctgggtcttcggcaccaaatgtctcacatgtgcatgtgaagagaccacaaaacaggctttgtgtgagcaacaaggctgtttatttcacctgggtgccggcaggctgagtcagaaaagagagtcagcaaagggtggtgggattatcattagttcttacaggttttgggataggcagtggagttaagagcaatgttttgggggcagggggtggatctcgcacattctcaagggcggggagaattacaaagaaccttcttaagggtgggggagattatgaagaaccttcttaagggtgggggagattacaaagtatattgatcagttagggtagggcagaaacaaatcacaatggtagaatatcatcagttaaggctcttttcacttcttttgtggatctttagttgcttcaggccatctggatgtatacgtgcaggtcactgggaatatgatggcttagcttgggctcagaggcctgacagtaatatgatgggttgagggaaagttatcagaagagaaaaagaacaaaaaaatttctagctttactggagaatgttgaagatggggtaagcagaggtttacgctagaaatggattcaagtagacaaactgtattatttcatcataaatgcctctactttgttctttcctcccattaccctgctcaattcttgtttttgtttttttttttttccattctagttatgaagaaaaacaaaaagagttattttgtcttgacccaatgcaaagatgaaagcagaaatcagatttaccctatgtaatagcttattactgggcaaagaaatgaagtacattagggaggccttttttttcctccaatggctgttagattgtgtattg

SEQ ID NO: 156559 - DNA, 451 bp, Homo sapiens
tgcatacctaggagtgctgcggccgaaagacatcccattggggcctaagcaagcttccatctttgactctagtttacagaaaataccagtggtggagcaataggctaaaggacaccatggggaggccgccagctaaagccaggaagggggaagctctaaggacaggtgacctggtttctttccaaaataaactgcaaggaaaaggccaggcgcggtggctcacatctgtaatcccagcactttgggtggctgaggtgggtggaacacctgaagtcaggagttcaagaccagcctggccaacatggtgaaaccccagctctactaaaaatatgaaatttagccaggtgtggtgctacatgcctgtaatcccagctactcaggaggctgacacaggagaatcgctggaacccaggaggcggaggttgcagtgagccaagattgcgccactgca

SEQ ID NO: 156560 - DNA, 371 bp, Homo sapiens
cagaggtgaggcctaatgagtgtcagtgaccaccctcctctcttctgacacttttcaacagtaccctttgaaacaattctaccgtttcccaaattgtgaacctactatgtgccaggcactgcatcaaaggtagtaggctggggagtgcaatgttgagaaaaacacaccccttgccctcaagctgaccaacttagaacctggggagagtacgacaaagatctaggtgacttgtacacaatcagaatatacggacaatgtcctccagacgcaggagagggagaagttggagaaaccagaggagtcttcacctggaaagactatgggggagcccagaggggccactgtctggcagggggagggggaggaatgtg

SEQ ID NO: 156561 - DNA, 276 bp, Homo sapiens
attctctccttcctcttctcacagactaatgaaatgagtacttatactggcacttgagtacttatactcaagctccagtccccatctgggcttgtcacagcagaggctgaggccgaggatgacttaggatcctcagcacaagtaaaaccaaaggtaccgaggtttacattcacaatggaacctcaagaggaccctcagctacttttccctcccacctccatgctcagtctcaactccatttgttttttgtttttgaaatggagtcgagttcttgtc

SEQ ID NO: 156562 - DNA, 452 bp, Homo sapiens
ggatccctggtcatctggatgttcctcctcaatccaggctcagctgcagacaagtgttagtttcagttatcctcatagctttgcccacagaggcccctagggtgctttggagtgcaactgtcattcttcttggcccaatacaccctcttgaacctctcacctcaaaggtaggactatggaaagtctggccagaaagcccgtgtctgtgacatgtctctgaatgtatatacacatgtctgtttgtgcatgtctctgtgggtaggcctgagtgtgcacctgtctgtgttcatgtctgtgtctgtttgtacatggtctacacttatgtctttaagtatggctatgtgtgcatgtctatacacatgtgtgcatgcattgtgcatatgtctgtgtatgtctgtgcatgtgtctgcatatgtgtgtgtatgagtgtgatggagtgagggagagtagaa

SEQ ID NO: 156563 - DNA, 577 bp, Homo sapiens
tatacccagcaaaaccgtctttcaagaaaggatgaaacaaagatatttttcagacatagaaaagttaaaagtaatatattatcagcaaacctggactatgagaacagtgtaaaagcctttcaggaagaaggaaaataaagaataatatctttgtgcagatagaaacatggatccatacaaagaaatgaagagcactggcaatagtaacaccataagtaaatatacaatacctgcccttattacttaaatattttttaaagataattggctgtttagaaataatagcagtgtcatgtgagttctgcagcatgagtaaaagtaaaatatatgacaacaataacctagagtaaatggaaatatagtttagtttgtaaggttcttagactgtgtgtaaagtcgtataatgcttattaaaagttggctattacaagttatctttaagttaaaacatttgtatggtgtaatccctaaagcaaatgctagagtaacaaaaacagtgataatattacaatattacacaataatattacaatgcagcgatgaaatagaataaatttttaaatgcttgaaagtagac

SEQ ID NO: 156564 - DNA, 560 bp, Homo sapiens
cttgctctgtcgaccagcctggagtgcagcggcacgatctcagctcactgcagacctctgcctcctgggttcaagcaattctcctgcctcagcctcccaagtggctgggactacaggcacaagctgccacgcccagctaatttttttgtattttagtagagatggggtttcaccttgttgcccaggctcatctcgaactcctgagttcaggcaatctgcccgcctcggcctcccaaactgctaggattacaggcatgagacaccgcacccagccgggaactgaattttatgtgagcaccttgtcttctgcctccatgagggttcccccaaggcgcttggcaacctccctatggtgtctcacacctgtaatcccagcactttgggaggccgaggcaggcagatcacttgaggtcaggagtttgagaccagcctggtcatcatggtgaaacccagtctctactaaaaaaaacacaaaaattagccaggcatggtggtgagcgcctgtaatcccagctattccggagcctgaggcaggagcagtcgcttgagcctgggagcca

SEQ ID NO: 156565 - DNA, 121 bp, Homo sapiens
aacaaatacatcaacaaagtctgacttctctaaaggtcaaaagccagctaagtatagactgtcagcaagccactcctatatataactgtcccggtctcagccagctgtcggcctctctcag

SEQ ID NO: 156566 - DNA, 167 bp, Homo sapiens
ctatttcgatcgttaattcacacaatcaacttttttcacttcaaatagtcaaattacattaatagatcgtaagctacaaaaccaaggtaaagcttccttagaacttagtcatggccacgtacaggggctcataccggtaattccagcacttcgggggaccgaggcag

SEQ ID NO: 156567 - DNA, 319 bp, Homo sapiens
agcctggagaaaggtccagcttccagagttcacctgctagagttttccataacacctgggggagaggctactccatctgggacctgccccacctctgggcctcagaaactatgagagagggattgagagaaaacttgccccacttctgctgcagtgggaagggagggggctgctgtcaggcttctaggcagtgagcggcattgtttattctctcagttctaggaaggggagtttagaagtactggtgaagaaaacaaagttacaagatcctataaggaacagctgaactactccaaacactctcactggacccccattg

SEQ ID NO: 156568 - DNA, 138 bp, Homo sapiens
tcatggccctccctaagcctgcccatgatggccccttggccctcagcttaacaccttattttatctagtagctcctacctctgaacagatgaggaaactgaggtccaaccaaattgggtggtacgggctgagttcaca

SEQ ID NO: 156569 - DNA, 603 bp, Homo sapiens
gaacccgctgtgaatactttctggtagatccagccagacatcctgcctcacgccaggcacaagtgtgtacagacgacaggacacagcacatgtgcacacacacactcccaggaaagaaagtggtcctcggggcacagtggagaaggcaggctgggatcagcctgcacgggttctggccctggctccaccgcgccagctgcgtgactctggacaaaggcttctttggcaagcctcagtttcgccgaacctccctgtggggctgccagcagccaggtggagactcaggggccgccttcccctgctgggctgaggctggctctcctgtccttgccacacggcccctttcaccgccagtggaaacctgcctcaggctgccctgtcccgggccccaccgactccacagagacgccgggcctcgcccactgttctggcagtaggccttcatgggcagggcttgctgtgtgccaggcaagctgggcggctgcttcctgtacaccacctcccctgatatcctcgccctgcctgagcccattctgggacagcctcaagtcctgtctctcctgccatccagcccagggcacgctgctggtatcccgtagccct

SEQ ID NO: 156570 - DNA, 400 bp, Homo sapiens
gaaatttgaccctatctttaaaattcagtccaggggatttcattacatgggattacagagaagggtgttccctgaactgaatttttaaagatagggtcaaattttcataggcagaaagaaagggtgggaagcggacattctcaattaaggggaaaaatgagatcttatggaagctttaaagcctgagacatttgagggaacagaatttgagaattgagtctgcgatgagacaggaaaagcccacaggcagtaaaaaatgccggtggctgagtgcagtgtagcttccactgaactctgtggatgtttatgcttatttgaaccttgttggaatattcctggtttgttttatgaagggatgtctctcactgaggatattgactcagggacgtttcctctttca

SEQ ID NO: 156571 - DNA, 302 bp, Homo sapiens
cctcccactcctgcaatctcagtctgagagggactagggtgctctgtgtagaagcactcctgaacactacccctttcagaaatccattttacaagcattctaggtgctgggtccagctctgtctgcaatgtggcttactttcttaagtgtatcacatctgcttagaacttccttccagttaatgagtctttcttgaatcaagcctgaagggcttttgatctcagtaccaaacgaagggggatggacacaccaagggggatggacacaccaagggggatggacacaccaagggggatggacac

SEQ ID NO: 156572 - DNA, 287 bp, Homo sapiens
taagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaa

SEQ ID NO: 156573 - DNA, 373 bp, Homo sapiens
aggagctagatgtgggcctggaaaggctgattttagtgcatgaacatgcacttggagcatgtttatgggtcaaagaaaatcgagaggagaagttgaagttataggagagaaaagaaatgattaatggggcaagatgaaggaaaccggaggggtcaggatgggatcaagagcccaagtagaagaatgtatcttgaaaaggagatatttgaaacagcagggaagaagaaaaaggatagtgagatataaaaaggctactgggctttttggtctttgaaggacattttactgatgccctctattttctcagggagttaggaggcactattagtttaaatgtggaagagtgggggtttaaatggcacgagtggggaat

SEQ ID NO: 156574 - DNA, 381 bp, Homo sapiens
aacaaaacaaaaactcccaaaataatgaaatcatctaataatccaatcaacttatttaacagacgaggcaaacagaggccccagggagatggaatgatttgaccaagattatatacagcttaggtttctaactttaaatccactgctgtctcaccctcattaaaggctgccaatgctctgaaaaagaccatccttatgacctcttccagaaaacacaacatcatcctcaaatatcaaaccccaactttagtttttgatatcaaaataattttcaaggccgggtgcaatggctcacatctgtaattacaacaatttggaaggccaaggcaggaggattgcttgagcccaggagttgaagaccagtctgggcaacacagcaag

SEQ ID NO: 156575 - DNA, 367 bp, Homo sapiens
cttggctgtgacagtttctcaggcttaactagtttttgatgactgttaagggctgacttgtgcccctctaaaattcgtatcttgaagtcctaacctcagtaccccagaacgtgactgtatttggagagagggtctttaaagaagatgaggtcactagggtggaccttagcccaatatattaataactgctgtccttataagaagagagtaggatacagagggatgatcatgtgaagacatagggagaagacaaccatccacaagccaaggagagaggccttagaatgaaatcaaccccatagagcttacactatacgcctccagaacagtgaggaaataaatttctgttgcttaagccacccagtct

SEQ ID NO: 156576 - DNA, 114 bp, Homo sapiens
ctgatgttgtggggcaggggaaatagtctaacatcttaactacaaaatattacttgaccatatttcacttactttagttgagctagttggaatctatgttcagaaaaatctgat

SEQ ID NO: 156577 - DNA, 301 bp, Homo sapiens
tgcttctgctaataaataatctaaaatcgatgctgacagcagttaattggcacagagattttattttgtaaagctcttggctaacgaccttctttaaattaatagcattaagtgctatgaggaaataaatctgaggaattgcctgtcatttgcttgtcatgtctaataacttccaataatgatggctgatagatttttgcacattccattattgaagttggtgcatgtaattattctcctcattatatgtaaacaattagcaatatttggtatttccttgcagtaaaactgttaagtacaa

SEQ ID NO: 156578 - DNA, 228 bp, Homo sapiens
tctgtctcatatccttccctgtttttacccatcacatacagtaacccccaagacctatcaaacattttcctgctacctttctccccactgccactgcccttgttgtggacttcatcatattttgtttcatcgattttcactcagaatttccaatgaaaccctagaaaggccatgtattaaaataaccacatgccaggttactggctatgtcctaagactaagggcaaa

SEQ ID NO: 156579 - DNA, 150 bp, Homo sapiens
gccaccgtgccagccctattttcattttggatctatagaatccttggagtgaactagcagtagaaattcattaaaatagaaaggggttatttgcttgtcttagagccagtcttttggatggaagtgggggaacctgtcccatgctactga

SEQ ID NO: 156580 - DNA, 188 bp, Homo sapiens
tcttaccacacactcaggcacaaattcggtgtgctgagaggctggagtccatgtcctgataggtgatggggaataaaggatgaaattgacaaagaaacagtgacacgaggtcacagtaaagctgtggtataggcctttgagggcatgaacagaataagatcaaaaagcaacaggaaacttgaagagag

SEQ ID NO: 156581 - DNA, 350 bp, Homo sapiens
gtcctgtgcattggaggctgttgaacagcatccctggcctccacttagttggtattagtagtacccccatctagttatgacaaccaaaaagtctccagacatggccagatatcccctggggggcaaaatcactgtccttaatgttggggatgtgatgactaatacccattccctgttctctaggatctcacagtcctcggtgaggagagaaccattgcacagttagttacgatacctcatggaagcacactgatggtgctatccatcacagcatattttgggagcaatcagccagggaagtcccctggccgagccttcacggatgagtagggttaaccaaatgaagcata

SEQ ID NO: 156582 - DNA, 616 bp, Homo sapiens
tagccctctctccttcaacagcctggtctgtagaaagagtccatacatggcctccctccactccctcatcttccattcattccttgttccaaggccctcccaacaccactgaaacttttttcaatgccctttttttaaattattattatttttttaaaaagcaaattctgcccccatcttttcattctttcagttgaaccactttttccaaaacactgtgcagatataaaaaatacgtagttaaggccagggtgcagtggctcatgcctgtattcccagcacttcgggagtccaaggcaggcagaacacaggtctggagttcaagaccagcctggtcaacatggtgaaaccccatctctactaaatatacaaaaataagccaggcgtggtggtgggcacctgtaatcccagctactcaggaggctgaggcaggagaatcgcctgaacccagaaggtggaggttgcagtgagccgagatcatgccactgcactccagcctaggcgacagagtaagactctgtctccaaaaaacaaacaaacaaaaatggacaaaggagccaggcgtggtggtgcacacatagagccccagctactcagaggctgaagtaggaggatc

SEQ ID NO: 156583 - DNA, 630 bp, Homo sapiens
cttcatgggtcggagttaggttttcttaatgtcttctgctcctgagtgcattggtacaactgggttggaccagattacaggtctgggtggggttagctgatccattgagtgcagggtctacaaaatgtctcaagcactgatcttaggttttacaataatgatgttacccccaggagcaatttggggaggttcggactcttgaagccagaagccgcatgaccctgaaagtgtaatttctcatcttgtagctaatttgttagtcctgcaaaggcaaactggtccccaggcaagaagggggtctttttgggaaagggctgttatcaattttgtttcagagtcaaaccatgaactgaattccttcccaaagtcagttcggcctatgcccaggaatgaacaaggacagcttaagggttagaagcaaaatagagttggttaagttagatttatttcactgtcataatttcctcagttataattttgcaaaggtggtttcgtgtgtgtgggggagcggggggagagagtaaccaatactccaatttttctaagaggagaatgcattactattttttaattattttctctcttttgctccatttctcccattccgactccccacccggtacggcgact

SEQ ID NO: 156584 - DNA, 497 bp, Homo sapiens
acaaatctatgactcggagatcaggagccaacccttctcttttatttctctcacaatacggggtccaagaattagttcaatagccttgatgaattagattttaacccagggcatcctggatcaaattatatccactgatataaaacttcatgtagtcaatatctgacaaaacatgactgtcttataagtctatgttttctttccctttataactactttataaaggatttctatgatatggtttatttttttgaaaattgtacttggaaaattattgtattattgcattaattttattgtattggtataacatagcataataaagtatccaaacaatatttcaggtaggtacaggataaatgtacccaataatattaataatatgaaaaccattagaggccagtataggtgaaatccagatatcttatttgcccttctagtatatagaaatagcctcacagtatttggtggtcaaagagaatacagtaataattgac

SEQ ID NO: 156585 - DNA, 390 bp, Homo sapiens
caacaaaccggattccagatccactgatgttctaatggaagaggggggtactgctgctgctgtcccaggcataagttagagttgagaatcaaagtgcccttgagcccttatttgatctggtagcttcttcagtttaaacttaaaatcagctagaagggaaaggaaagcttggtatgagagaaatatagtggttagtacacaggcctgcggctttttgaggtatccactaaaagacagtgggtgagtttggcctcaagtctgcgtgcaaaaggatcatacagacttcagttaatccagactctcagccccagctaggatagcacatctggttcaactttacacaccttacttgggagagttatgactttttttttttagcattttattttg

SEQ ID NO: 156586 - DNA, 135 bp, Homo sapiens
tgagtggtaaaatcagtgtgaaaaatagacaatgtttgagaagtatagatgggaggagggggagctggtccagaatggttaaggaaggcttcatgggggttgtgtgatttgaccaaggccttcatgggtgagtag

SEQ ID NO: 156587 - DNA, 490 bp, Homo sapiens
ccctcctagcttcctgaaacaaccttctctatctagagcagattctgcagagaggcccctctttaattcatattctgaaacgtgcttgttattgttgacgtacaaaaacttatgaataattcaataaatgaatcttgaaccatcctatttatcattcagtggtctaggtacccaactctagaggaaagcttttctgaaatacacggtaagtatcccccaaccctccctcaaaggaaccaattatgaacactatacagtcttctctcccttctcactccccatgtcaaagttcattgtgttcctcctgcagctgatttaaaagttgatcttttcaaggagctggattcctaaggtagttctattttgagccttcttcctgttctgaagctaaagttggaagggcttaggtggtgatgtcatggaagggagactgttggtttttataggagggtcttctctggcaactctggggatgctcaaatggggaaaa

SEQ ID NO: 156588 - DNA, 408 bp, Homo sapiens
ccagtagtcccgtttgtagtctcatctttatgccgtttctccttttgttccttaagctatttttaaatgttcttttggtatttcttatgtttcttcttacttttccctttcttaacaacttcaacttttcctagcacccttctccatttacactgtcccccaaaagaaagcatttcctttctaccttcatctcattctgctgtttcttttaaaaatattttaggacactgaaaatgtcagatatactcagtatttattggaaaacttagacacagagatttatcatttgatctgtgcacagtgatctgtgtgtttctctgggtttgttcttctgtaaaaatattaatacatttattccttggatacagttatgactaacatgtatataggatcttatgcgtttattca

SEQ ID NO: 156589 - DNA, 564 bp, Homo sapiens
tggggatccaggaaaataggcacggggatgggcacccaggagggatagggactgcaactctgctgcagggagaggagaatggtccccagcgcctgagtctccccttcctacttgggctaagaggaagttagaagtccaacgtgcctggctcggagtacacattcacacaatcttgtgggattaataaacagatgaaaaagttgggaacaagaatttgaatgccacctatataagtctatgggggaggggtacagtttctcccagaatcgtgagaagaataacggcatgttggggaacattcctaattacatctgcaacaatcagtccaggtgccaaagggtgcagagggaaacatcagcaatcattcctttccttaagaagtcaagggagaagaatatgggcagggcagggccctcaagcctttggcctcatgccaagtaaattgttagcccacatcacctgtctggtatgtttgtccatgcggagaggggttgagaggaggtggttggaagtacattggttccactcttttgaccggaaatgggtatcaattctcatcagtct

SEQ ID NO: 156590 - DNA, 309 bp, Homo sapiens
ctctcaaaaagtctggtccagtcaaggggacaatggtcttaggtaggcccttgtctgcccaactcatactgttaaggacaacctaacagtaccatcccactgcaacaaatcttttgcccatggagcaaaccccaccagaagtttgaacagaacacaggtcatgaattctcatactgccagcctggtagaactccctgccagctctgcaagaagggcaccatcaccaatagagccatcttgcacatctgaagggcccacaatacatagcctctgctatccagaagagaagcaagcaaagatggcacttaa

SEQ ID NO: 156591 - DNA, 386 bp, Homo sapiens
ttggggtgtccacgcagcatgcatggctggtcctagctcggatgttgtctgacagtcacccatgaggaacaggagtccctcccattactcagccaagggcacagagtgattatgcccggggtgtagcaaatgctctgcaaatagtagctgctctgaccatgtgatttgactggcattgcccagatgctgagtggtggtgccaggattggacctgtatccatctcatgcctccacccaggccctccacccggcagcctggccgccttctcctggtcctggtccccttgcccccaggaattgaggcgtgcatggtgcatttccatctcccaaatcatggtcctgtctgtgccctcatctgctcctcttccacaggcctctcagggagg

SEQ ID NO: 156592 - DNA, 486 bp, Homo sapiens
tttctattgatgaagaaactgaggctttgagaatataaggtcacagagcaagtatagttaagtagtgaaggcaggattctgaacatctctgctttaactataaatcctatattctttttcggttttttttcttattttacttctcttttacatgataacaggataaatcctatgttcttaaccactaaattgtattttcgtctttgcctagggaataggtagatgggaagtagtaaggtggaaggaaatagaaatggtgtgccacctggaactctgcctggtggtttgtttgaaatcttggtaatttgcctaggtttctttccaaagtaatttcccctctctgttccatttacccactctgttcctgtattaaaggttatgttaattccatgtaccttaggagtaattatagcagttaagtagaatgactgctgacaggggatgaagtagagttgtgacagagtctaggtggacatgagttaattg

SEQ ID NO: 156593 - DNA, 124 bp, Homo sapiens
tttggttgcaagcaacagaaccatcatggttcattggagattttattctttggtacagaatttaacttaaatgccttgtggatgtacatgaaactgagtcctttatttcagagtcatagcagca

SEQ ID NO: 156594 - DNA, 461 bp, Homo sapiens
tgggaggatcacttgaggtcaggagttcgagaccagcctggccaacatgcgaaaccctgtatctactaaaaatacaaaaattagccgggtgtggcggcatgtgcctataatcccagctactcaggaggctgaggcaggagaattgcttgaacctgggaacctgagaggcggaggttgcagtgagggaagatggtgccactgcactccagcctaggcgacagagcgggactttgtctcaaaacaaaaaaacaaaagattgtgtaggcaccacctcagttgattattctgtgtaatctcatgtctgtagcgtacatgtgactagggcagaaataattcagaataatctcagattaggtcaaaatggaagtctcctgtttaagaatgaggagatgtttatgtggctactacagagttaaccacatgtcattgcaaagacagtgagttttcaagttaaagggtta

SEQ ID NO: 156595 - DNA, 417 bp, Homo sapiens
acatgcacggtactcactaaaaatgaaaactgaagtggaaactaacctgtatggctcagcagcgctggagcaattcttataggattagcttgactgttggtcacagcaatgggtttatcaacaccaaccactgtcctgcagacatctgtttaatatttaagtgccggtgcagcaggggtaggtaacagatgacacagaggacaagcctgcatgtgcctttattttttctattagaagaagcaagaagaggatttcagtcacatgcctgagaattacaattctccatttagtctttggaagccctagactagtacacgcttcctccgcatactgcacactagctcacaataaaagcaactaatagttgataactgaagcattcatattatttactccattccagtattgccagcaagt

SEQ ID NO: 156596 - DNA, 655 bp, Homo sapiens
agaagagattgtgacttgccattttgttttctctgtggcctttgtgtagtgctttgcttatctggaattcaattaagaaataaaaattagtagctcctggcacagaagaaagaaataacatttgggaaatatttgcttcttgagagatgatagttgaaccagagaagtaggtgaagtatttgcagacccccacaatttcttggttgcagatccgccaagcatgggttaaaagtacaggggactagggattggcagttgctagtatgtttattcctaaactgtagggtaagacacacaattgattctcctgcctacctgctatgcctttgtatacttgtttcctccctactctgaactgtaggcctgcactgtccagtatagtaaccactagccacatgtgactacttatgttgaagttaaataaagctaaaagatcagctggatgcggtggtgcacacctgtggtcccagctacttgagatcaattgagtccaggagttcgaggctgcagtgagctatgatcgttatcactgcagtccagcctagacaatggagcaagaccctatctcaaaaacaaagatgaaagcctgtctgtactatccaaatatggtaagtgattatttagtttaattaacttcaacagtcctatgtaggtg

SEQ ID NO: 156597 - DNA, 789 bp, Homo sapiens
agaagagattgtgacttgccattttgttttctctgtggcctttgtgtagtgctttgcttatctggaattcaattaagaaataaaaattagtagctcctggcacagaagaaagaaataacatttgggaaatatttgcttcttgagagatgatagttgaaccagagaagtaggtgaagtatttgcagacccccacaatttcttggttgcagatccgccaagcatgggttaaaagtacaggggactagggattggcagttgctagtatgtttattcctaaactgtagggtaagacacacaattgattctcctgcctacctgctatgcctttgtatacttgtttcctccctactctgaactgtaggcctgcactgtccagtatagtaaccactagccacatgtgactacttatgttgaagttaaataaagctaaaagatcaatctcacagtagcctcatttagccttacttttcagatgctcagcactcttggcaggcggctgctgtaggggacagcacagatggagaaggatgtggtcattgtacaaagttttgttggtcagtgctggtcaagacctatcacgtagctgtagttgtgaatggcatgacaaatctggcatttggatttggtttagaagtttaaaaaaattagacagttcaggtaatgaatgttttagttactaaagttgccagtttattcctgatttaatccagaacttcctgttacagaggctaaggatgtgacctaatattttcttcttactacaggattgcttggttgtgaatattctaa

SEQ ID NO: 156598 - DNA, 446 bp, Homo sapiens
gcctcgaactcctgacctcgtgatccacccacctcggcctcccaaagtgctgggattacaggtgtgagcaactgcacctggcccaatatctatcaatctatatattttaagtggaatgtttaattcatttacattcaaggttaatgttaatacatgaggttttctttctgccatattgctgtttgttttctacttgttttataagttccttggggttattttgttgttgttttttgtttttctttctgtgtgtctctttgtctttgtggtttggtggaaatctgttgtgttgctatttgattgctcgtcctactttgtgtgactgttttacaagacctatgagtttgctactttcatgtgttttgatgatgatgatgaatgttgacctttcatttttgtgtttgggacacctttgagtatttctcataggactcgtttggtggtga

SEQ ID NO: 156599 - DNA, 4778 bp, Homo sapiens
caaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtcttaaaaagtatttacaagtacataaatttgctttatttttaaaaatacaaaaaggtaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaggccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattatggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaagatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgaaaaaaaaaaaaaaaaaaaaaaaaaaaaaaaaagggccacccaatcagtacttaccaggatatttgttgaccacactcatgagaaaatggatggttggattaatccatggtaggggattgactagttaagaacagaagattagagaggactggagagtattgttggtgaatgtctcacccatagaaccagctttcataggctgctgtgaaaggtcagtctaagaaggactgacatttgggagccactgcgctagagcccatctgctttaagttcttagtccattagttgttccttggagctccagcctccctacatgaactgcttcccctaagaaaaggaaaatatccggccaggcgtggtggctcatgcctgtaatctcagcactttgggaggccgaggctggcggatcacgaggtcaggagattgagaccatcctggctaacagggtgaaaccccttctctactaaaaatacaaaaaaaattagccgggtatggtggcgggcgcctatagtcccagctactccagaggctgaggcaggagaagtgtgaacccgtgaggcggagcttgcagtgagccgagatcatgccgcgccactgcactccagcctgggcgacagagcgagactgtctcaaaatatatatatatatccaagttacatcttacatctttctttttaagaaaatctttatatgtacctccttctgtcgagtgtccttactttcaatgaacttttttgagatataatttatatacagtaaaatgtacctattttaagtttacaattcagcggatgttgacaaatgtacaacccccagtatctgtcaccccagtcattatattgatcctcccaaaaagttctctcatgtccctttgtagtctcttcccccacattgatctactttttgtcactatagatttgttttgtgttctagaatttcatataaatgtttttgtttgtttttttaagagatgaggtctggctgtattgcctagactggtcttgaactcatgagctcaagtagtcctcccaccccagcctctcgagtagctgggactacaggtgcacacaccatgcctggctaatgttttttaatttttttagagatggggtcttgctgtgttgcccagactggtcttaaactcctggcctcaggcagttctcctgcctcagcctcctgagtaattgggactataggtgattatagggactatacttctttcacttggcatgattttgagattcacctgtgttgcatcaattctgttacatttcattgctgagtgctatctcatccatcctattttttcacctttattgccaagtctcctccaaacagaacctgtattatctccactgcttcacctctcatttactcctcaatcactactatttgtttcagcttttattatttccatgagactgctccttgctaagataactcttatttgtcagatttcatggtcactctttggaactatcatttgacttttttgaaggattcacctcagatttgacagttctaaaattaaaatcattatctttcctaaaaaccatttcatcttcccatatttctaatcttggttgatgacacccccagggtacttgtcattcacacgagaaacctggaagactttgactttccttcccttttactcagtcatttctttgctcccttataaataactcccaaatccatgtcccttctccatccctacttccagtgccgccttttgttcaggttcccatttttcccctaccttgtatattttcagaggcttcctaattaatcttgccctcctccatttcagtccattttttcctcattgtgctactatagtggattttctaagctatatctaatcttaatggttctccacttaaaaaatattttctggctggacatgtggctcacacctgtaatcccagcactttggtaagccaagatgggtggatcacttgaggccaggagttcaagaccagccaggccaatatggtgaaacccctgtctctaataaaaatacaagaaattagctaagcacggtgacatgtgcctgtaatcccaggtacttgggaggctgaggcatgagaattgcttgaacccaggaggcggaggttgcagtgagctggaatcacgccactgcactccagagcgagactctgtctcaaaaaaaaaaaaaaaaaaaaccttttctgacttctattgtctgtgagataaattccaaaattcttttcatggcataattcactacttcttaagtcatttgtttaatctattagagactttgcta

SEQ ID NO: 156600 - DNA, 475 bp, Homo sapiens
gcaacagcacgaaactctgtctcaaaaaataaataaataaaatttaaaggccaaccaaggctgtaattatatatcagtaattaaaccaatcagtacttaccaggatatttgttgaccacactcatgagaaaatggatggttggattaatccatggtaggggattgactagttaagaacagaagattagagaggactggagagtattgttggtgaatgtctcacccatagaaccagctttcataggctgctgtgaaaggtcagtctaagaaggactgacatttgggagccactgcgctagagcccatctgctttaagttcttagtccattagttgttccttggagctccagcctccctacatgaactgcttcccctaagaaaaggaaaatatccggccaggcgtggtggctcatgcctgtaatctcagcactttgggaggccgaggctggcggatcacgaggtcaggagattgaga

SEQ ID NO: 156601 - DNA, 312 bp, Homo sapiens
ttcaccgagagctggtcgaggtcctcaggtaaattacgagtataaggggacagctgaaacagagaatctgtagaaccacgtgcttttctatcatttggtcaccataatgacttgaagcaaacgactaatatgagccaagagaaagctggggtagcagtttgctgttagagcctattgttcgcgagagggagtctggctctgttgcccaggctggacttcagtggcccgatcttggctcactataatctccacctcctgggttcaaatgatccttccacctcagcttcccaagtagctaggatttattttttt

SEQ ID NO: 156602 - DNA, 360 bp, Homo sapiens
tcaggctgctctcgatctcctgacctcaggtgatctacctgcctcggcctcccaaagtgctgggattgcaggcgtgagccaccattcctggccttcagtgggttattttcaaacccttgtagaattttaggagctagcagaagggaccatggtggttactgactaggagccagtggttgcttctctttttaccaccaaggacccatctaatgatttttcctctcttttggatcctgtatctgaaatattttggcatgctaatattttattaagtaacaatatttttcaataaaacaaataagtctgtataactgaacacaatgagagttcctgatacacacacatatactagaatgttcc

SEQ ID NO: 156603 - DNA, 401 bp, Homo sapiens
tcgtggacagctgtcttctcactgtaccctcacatggtggaataggtgagggtctctctggggtgtcttttattaggacgctcatcctatccatgaaggctcttccctaatgacctaagcacctcccaaaggtctcacatcctaatgccatcaccatgggggtttaagatttcaacacaggccgggcgtggtggctcactcttgtaatcctagtactctgggaggccaaggtgggaggctcacctgaggtcaggagtttgagaccagcctggccaacatggtgaaactgcgtctgtactaaaaatacaaaaattagctgagcatggtgacgcaggcctgtagttccagctacttgggaggctgctgaggcagaagaatcgcttgaaccggggaggcggagg

SEQ ID NO: 156604 - DNA, 301 bp, Homo sapiens
taaggtgaacctgtatgtcattcagtcctcacttacctccaggcagcccccggggtctgcttgtggatttagctttcatgcccacaggtagggaaatgtcatccttcttgctgtgcttgatagtggtcaggcaagactgtttactacctgctttgattcagcaaaagcaggaaaaagcaataaaattgaataagcactcattgtcaacattttttagtaatttgctttgccatatcaacctgacaggagaggcgtgtgatctgtatttgggggagggagtgtgaagaaagaaaagctattc

SEQ ID NO: 156605 - DNA, 432 bp, Homo sapiens
aactgatgatgctgtggagggggtgctgagaactgaagtctttgaggaggtgagaaggatctgaggtttaagttgaggtgctggcatttcccaggagcatcgtctggtaactctgaagtggagcctaaccgtttagagcaagattacccctggactcaacttctccccttcgccatcccccactggcctccagaggctccactctgctctccttctagccctcttgctaaaagatagctggccaggtgcagtggctcacacctgtcatgccagcactttgggaggccgaggagggaggatcacttgtggacaggagtttgagaccagactgggcaacatagtgtgagacccccatctccacaaaattcaaaacttagccgggcatgatggcatacgctgtagtcccagctactcaggaggctgaggccagag

SEQ ID NO: 156606 - DNA, 432 bp, Homo sapiens
tggcctttaccagtttctccagccacatctttccctatgcttgttttttattccctgtattttagccacagtggcttcctttccttttcttgtatttgacatcttttgtataggactttgtaatgctctttcttctcccttgaaacacttcttcccctctactcttctggatttcaactcttgtagcacttacctagggaaaccttttgtggcctcactctgattgggtccagtccattgtagttctgtgtagtacttttcacagatgtaagttttttgtagttgtatttgataccacttctgttagaccataagcttattgaggggatatattgtgtctttacataactttttgttttcccagtgcctagcatattgtctaatgtgtgtagtaggtgctgaataaatacttttgaatgaataaatgttaaa

SEQ ID NO: 156607 - DNA, 345 bp, Homo sapiens
cccaattccttggataccagctgcttgtataatctatactggttttgttaatgaaaattgttctctgtaggactggttgctacttgaatctttgctcactttgctgtgtagttttcagtattcattattgcaagtactatgttactctgtaaactctccagaaaattgttgctcaatctttgctatttctcttaacaaccaggaatcattttctgtcagtttctagcttgtattgtttgaactgatacttctataattgagtaaaatctgtctgtcttctttagttaatttacctgcctctactgcctagttagtacatgcttcctatccctgccttagaggggg

SEQ ID NO: 156608 - DNA, 450 bp, Homo sapiens
attcataatgaaaaagttgaatggatttagtcccataaaaacatcaacatttgtgatactgaaaaagtactataaataaaagtaaaaccaaatgaaaactgaaattaaaaataaagagctagggctagactacagtggctcatgcctgtaatcccagcattctgggaggccaaggcaggagaattgtttgaggccaggagttcaagaccagcctgggcaatgtagcgagaccctgtctctaaaaataaaaaaataaaaagttgttgtagactagtaagaaaaagaaacacatcaatagaaatataggcaaaggacatgagaaggcattctggccaggcgccatggctcacgcctgtaatcccagcattttgggaggccgaggtggggggatcacttgaggtcaggagtttgagaccagcctggccaatgtggcggtgaaactaaaagtac

SEQ ID NO: 156609 - DNA, 1277 bp, Homo sapiens
ctatgggccgcttgaagttgcttttgctattctctttgctgatgtgaagcagaaaatgaacaaggtaacagttttgatggtgagattagaggtagccaggctgactgtctcctggctcttagagacccttataagctcagggccaccccctccccttgtttagatattacttgctcttttgagtttcagattacaggagcaattggtctgcatgacctatcttaagaactttaactttgcagtagaaacttaaaccaaatgtatatcctcaagagacaaatcatcttaaaactaggctgttgtcattttgatgtactgtactgctcactgaggaacagtgtggtggagagcaccacctagtggatgggacccatacttgatgggctgtgtaggagatttcgtctacattgatgtaactcttgcccttgtcttgcaaataagtgatttttaatcgtcctagcacatatttttaagtagcgctaggaccccaggagaatgagattgggagtagttgtgagatatgtcggttttctttgtagttttcgcacttctataggtgtatgtactggtgcttgacatctccacattcttataagctgatattataattcaaacaaaacttttttttttaaatgtcagtagggtagtatttagtctttgggaattttgtgtttttgagtgcttatgttcaacctcggtagtaagagacggctttggatagaacctgtttgttgccacaaactttatactatgctgctaatctgttcacctcacgagaggaggagttgctgctgattataaactgtaggtcataaattgttacctgcttgtcatagagactatatgccttttgagtgtactaaaatatttgcaaaaattagatgaaacaattccacatttaaaaaaaaaacaacttttaacacatcatgaccacaaattttaggtacagccattccttgatatttattttagaatgtcaaattcttgataaaatgtatcacctcttcgtttgttgaatgttcctagacatttgttgagctaggaactatgccaggctttgggaatccaaagtgaagaagacatagttctttttggacttagaattttttaaagttttaaaattcttcaacacaaaaagagtgagcgtattcctgggatgtgggatgtattatgttggggtataaatacatttttttgcttaatattttctgacatttagcaaatgcttttgaagaaactgctaaataaaattgatgggtttgttttcatgggtttgg

SEQ ID NO: 156610 - DNA, 440 bp, Homo sapiens
gacaagctcggcccaagttatagaaaaaaaagaaaaatatataagtaaataaatagaaactatcaaattattttcaaggataaggaaggactaatcagtagtttagtcagaggcctagatcaaaacataacatgtatttttaaattaatctctttaaatgcatggttaagttacctgtatatgtgctcagtaaaatcggtcatttgtggggaaaaaaatggctatttggttttctatgcataaaattaagatagaagtctttttcctcctaacagccttcatcatagtggatttaaaaaaaccagtgtcacttaggctgtgtcttatttgtttctaaaacaatggaacaagtcagatgtttgtggaatacattttatatttgcaaataaagtaaaaattttttctgcctttttttttctaataaactttgtgtgaagatt

SEQ ID NO: 156611 - DNA, 503 bp, Homo sapiens
caatgtcactgaattatgcatgtagaaatggttaaatggtaaattttgtgttgtgtgtattttaccacagttgaaaaaaaaagtcacttccttcgctccatctcaggcatactaaagtagaatttctagtggtcgggcccagaatcctgcatttaaaaaaaaagaaaaaagcttttcagtttattgttatgcatggtttaagaaccactgatagcactttcggctgggtgcagtggcctgtgatcccagcactttgggaagccgaggcaggaggattacttgagcccaggagttcaagaccagcctgggcaatgtggctaagccccatctctaaaaaaattttaaaaattagctgggcatggtggcacacacctgtagtcccagttacgctagaggccgaggtgggaggacctcttgatcctgggaggagaggggaggcaaaggttgcagtgaaccaagattgcaccactgcactccaacctgggttacagagactctgtctc

SEQ ID NO: 156612 - DNA, 540 bp, Homo sapiens
gaaaccacagtctgatgcccatatattcctatatacaaaattgtacattatacttaatatacagaagtgtatattaaacctaaatgttctaatactatttttacatctacaacataaaaaagaataatgtaggctcaaatatcagataaatctaggttgagattgtggcctcatcatttacttaaagtgtgttcttgggcatattagtaggcattctaagtttcagttccctcttctcttgattatataataattactacatggaattgctatgggagattaatacaaataaagctcatagtactgtggctgtctaactttttagctgtcattattctaacagttattactatcctattctcaactgtttttaaatagtatcttgctgttttttaactttatgtccattttactgttcactcttatgagccacagagtctggaatccaccttggttctctcagaactattgattttctttgttcttgttggaacaattttctgctttagaaaatctgcatcagtcttcttctttacagat

SEQ ID NO: 156613 - DNA, 234 bp, Homo sapiens
tatgcatttcgtacttaatattaatgctgacctcccttcctcatccaagaaaaaaatgaggtgatccatagcatcctacaaaagtcgctagtgactttttggtttgtttttatctttttaatattgttatgaagtcttaaatgtaaacattttgtgtgtttcattccattgaagttatgatcctcattgatccttacattgagtccttttgacatgaccatagaaaattcctcg

SEQ ID NO: 156614 - DNA, 156 bp, Homo sapiens
ttgctagccagtgcaatattttggataatttctttttctttattttgaatgaaagatgaatcaggacttctttattcatgaagggtgaaaagaagtatgtgttcagtatatttatttatttagagagagagtctcgctctgttgaccaggctggag

SEQ ID NO: 156615 - DNA, 467 bp, Homo sapiens
ccaggagtcattctttttatttatttcctcttttaaatctgtaatttaaagtttattttagctataatgcatgcttctctggcatgcttcggagtccattgctaagatattctgttgtgctcatctgtctgatttatggatctatgcgatttctggcactaggacatcatctgagtttgggctatatagcagtgacaaaatgagtagaataactttagaaacaataaaagcaagagaccactgtgattctaagatgaatgctcccattattatttaatgtttgagtgatatattagaatcattcacatttaaatattatttaaaatttaatattatgccaatatttggatgatgaattccagttataatgcaacattgtgtcaaaaagaatatactgccttgataagggctgtcattagggcctataattgtggtttgccaatctgtaacaggccaaatgtttaatt

SEQ ID NO: 156616 - DNA, 281 bp, Homo sapiens
gttgaataaagaacaatctatgccaattaaggaaattggtttctggggctgagtcacatgacaatataaacgacactacttcctagcggcccacaaatcagcccaccagaataaagctcaagcccctccttcctcacatagcaaggtggttttctgcttcttctgcaggtcatttctgaaagctcaggcttgtccttcctttcatgttcttgtttgaaaatccttaattctgttgaattagattcagatgagcagtatcaagagtcactattccctttccc

SEQ ID NO: 156617 - DNA, 496 bp, Homo sapiens
tttatgtgactttccttcatgagtctttccaaaacattcatcttagttttcaaggaaacattcccctttttattctttgcttatgtaataaattttgtaattatcatgacagaattgtacaaacagatttgggaacaagcacaagtgactcttggtaagcatatagcttacctaatggacacagaagcacttagtctgcttgcctggagtgttcaatgcattaaggagggttccacacattttacatggtggaaaaacactaggttccatcattccccttcttcggctaactggtggctgtttatgcctgatttagtgactctagtttcttgttctggccactagatggcatctattttataggaaatgttgaagaatttatattggaaaaaatatctgaaaagactaaattctttctagatggtattttttgtttttttaaccatgtcaattgcgagggaaaagggcaacatcaatgcaatgtttttcttttttt

SEQ ID NO: 156618 - DNA, 400 bp, Homo sapiens
cctaacgagcgcgacagcctctcacctcacctgctgcacccctgcagccaactctcaacactgccacgagaaagacactgttaaaacagaagtcacattccgccactcctctgctcagaatctcccagtggtccctctaggagaagcctatgagacaatcacccctcttcagctgagctggctgccccacgccttgctcctgctgcttcctcaagactgcagccacacgctccccacaccactgcccatgtgcccttccttgtctacaccggccataacacacaagttccgtctgttttgttcactgctacaccccccagaccacagcatggagcaggtaccttgcacttgcaggatgaacagacaaaagtaaaagggtggccaggcacggtggctcaca

SEQ ID NO: 156619 - DNA, 225 bp, Homo sapiens
ttgaaaggaactgaacaatggtagaatctcagcttaattttgtgtcttcagactcccaacctttgagaaatagtgtctaattccttcctttatttagatgaggcgatataaaccaattcctgatgttactgacacttaagtaagtttcaaagaaaaaaataaaaaatacacataattttaccaggcaaatatagacagttttgtcagatgtggtggctcccagca

SEQ ID NO: 156620 - DNA, 236 bp, Homo sapiens
cagggaagccgtcagtgcaccctccagtctgcagctgaaggcctgagagcccctgggaagtcactggtacaagtcccagagtccaaaggccaaagaacctggagtctgctgtccgagggcaggaggtggggaagcaagcatccagcactagaaggaaaaatagagccagaagactcagccagcaaagctatccctcttcttccgcctgctttgttctagctgccctggcagccgac

SEQ ID NO: 156621 - DNA, 412 bp, Homo sapiens
aagacatcttttgtaatatattcagggcatcattgttctattgctataaggttactaagtttccattgcccatgaaggtttgactaaatgggtcaaacctctctactgtgaatttctatttctatgatggttacaaaagtagtcttttagaatacctgttttttgtaactaactttgaaatccaaactaggagtgaaaatagatttttttttcactgcgtccagaaatacttgatagggaaaagaagaaaagagatgatttctaatttttaaagtgatttttgggaagtttgattagttcgtaaatatcttgggttatctagagagttatacataatatctgtaggtgatacagataaatttatttttatttttcttttttaaatttttttctttttttgagacaggatctc

SEQ ID NO: 156622 - DNA, 291 bp, Homo sapiens
attgagaagagtatgaggagaaagggagaaaggggtgaggtgaggggagactagagaatgtgaggagagacaagagagatgacagagagaggcaggagagatggggagaaaccacaagacagagggcaggagtgtagggagaggaggcagggaaaggcagggccacactgacccaatgtccttcagcaggtggatggagaaactaacggcagtacagtcatcagcaaagtcctgctcggcaatgaaaagggacgatctgacacatgcaacaccgtggcttccacatccatc

SEQ ID NO: 156623 - DNA, 378 bp, Homo sapiens
ttataatatgtaactttatggaaaattaagatgaaattttttctaactgaacagttataggaggacaagtaaacttgagtcttactatgaagtctattatgaatactgagttcaaattgtccaagctttaagataggttctgaatgtaattctctgaagtttaggattaaacagtatcatcaaaattgggtgttctggttgagagctttttttgagataatcaaatcttactcctttaagagatgaaacttaaaagtcagaattatttctgaactaattataaattccataacccagctatccaccttgtaaacaaagaattcaatacacaatttttctttttcttgttttcttttcttttttgtgagacagagtctc

SEQ ID NO: 156624 - DNA, 584 bp, Homo sapiens
agacaaatgtatgacagaccagcagaccagccaaacaaactccacaaagaagtaaaaggagatgctcctttcagcacctcttgtgtgccaggcactgcacttcacattctcacatacatgatcacatttaagttttccaactgcgaggtagctattaccatcccattttataattataaaaactgagggcacagaggctcagtgacttgccctaggccattcagtgaagccaatatctaaaccccagatgtttctaaacactatgcttcattctagacagtacacagtcgttggtcaggaaacatgagttcctttgaaaaaggtatgctggagacataaaattacaacaagttaatattacctagaacatacacagctgctgttccagtccctcagctcaccgcagatccaaaacacccagcttcatttccaatttcccctgagcctccatcactgactcatttttctcatgcctttccctaagcacaaaagaaaaaaaaaccagatcaacgggaacaattcccaactcacggtaacagggtagggaaattcccacataacgtgtatctagaggcacaccagac

SEQ ID NO: 156625 - DNA, 342 bp, Homo sapiens
ggttatagttgtcctaaaggtgggaagtggtatcttattgaggtttggtttgcatttatttaatgattaatgatgttgagcatgttttcacatgcttattagccatttgtatatcttctctggagaaatgtgagctctgatccttggcccatttttcaattgggtcatttattttgttattgttgagtgggaagaattctttatatattctggatactggactcttatcagacatatgctttgcaaatatttctttcattctgtgaggtattttttaaactttattgataatgtcctttgttgaaataaaaaataataattttggtaaagttcaatttctct

SEQ ID NO: 156626 - DNA, 377 bp, Homo sapiens
cattgctcgagtctagactcagtacactacacaccagccctcagccctgtactagacatgtgacaccatttagacgagttttatgctagaaaccggttccggttacatttgaacttttccaactccaaggtcaacagaactcagccaatccacgaggaagtagcctgggacttttacctgaatgtccttgatagtctgtttttgtagctgttttaagaacagaggacataagaatgtgttaatctcaaagccgcatgatggtttttgtgttgtgaaaggttagcttttcaattgtaagacttaattacctttcaaatgaatatttcatagagttactttgtcattgaatatacagctacataagtattctcttccct

SEQ ID NO: 156627 - DNA, 281 bp, Homo sapiens
ccatgcactggccccgctgccagctgtgaggctcagcaccgtgggcctttgaccaagctgtcaaatttgttccccagccctagggtagtaactgtggctcacagttctgccacctccctgacacttcacagttctttttaccctttggcacctcatcaactttatacctggttaacaatccttgctattacatcctctgctcaaataactggcatggtttctgtctgttgactgacacacatatttaactcaggaagacaagaaattctgggctatccaga

SEQ ID NO: 156628 - DNA, 487 bp, Homo sapiens
atcaggatgcatatacaaccaaggattctgtgtgtattatataatggtctatactatttcactctcttagtgatatcttttgatgaacagagttattaattttaacatagtccaaatcatcaatcttttaagggtatgaaggtttccttctatgtccggttaaagaaattcttgcccatcaaaaggtcattaagatatttcctgtgactaatacacaaataaatgcccatgtataaagtattaaactatcatattagaagggaatatgcttaaaacatcacttcttgattgccagaaaattgtcttaattatggttaatagttgttttgtttgcactaacatatatagttcatatgttttaccatatgccacaaacattacacaaaataacagaaaatgtctcagctactatgatgcactgaagcttctcactgtcagcatctaagatgcatacatattcacccattttgacacttggcatcctgat

SEQ ID NO: 156629 - DNA, 273 bp, Homo sapiens
tcggatgcaagtgtcttcttcttcctcatcactatcatattagaagggaatatgcttaaaacatcacttcttgattgccagaaaattgtcttaattatggttaatagttgttttgtttgcactaacatatatagttcatatgttttaccatatgccacaaacattacacaaaataacagaaaatgtctcagctactatgatgcactgaagcttctcactgtcagcatctaagatgcatacatattcacccattttgacacttggcatcctgat

SEQ ID NO: 156630 - DNA, 359 bp, Homo sapiens
acaagcaaggaggcttcttttttgttgttgttttgagacagggtcttgctctgtcacccaggctgcggtgcagtggcacagtcacagctcactgcagcctggaactcctcggctcaagtgatcctcctgcctcagcctcccaagtagctgggactacagacatgagctaccaccatggctggctaacttttaattttagtgtagagatggggtctcactctgttgcccaggctgggcttgaactctgggctcaagcgattcttctgtctgggcctcccaaagtgttaggatcacaggcatgagccgtgcccaaccatataagaaggcttcagacaaaggaaggagtgagtcactaacac

SEQ ID NO: 156631 - DNA, 339 bp, Homo sapiens
ttcttctttcacctaggtgttaatcagaaccgcctgtgtgttatttgaagcttcttccttggctgtttccaagaaaggcaattggtctaccctttatagagccctcactactatcagaaccccaggcctactgcagctgaggcccccacccccggatctagcaattcaatgggagaggaggagaaaagctgaggctgaaccgggggttaaaccttttattctgccgtgcacaacgtctggttgcagggcggggggaaggcgccttcgtgggaatgagacttcttggctccaggactgtgagtgacacatagcaggacacagggagctacaggacttctg

SEQ ID NO: 156632 - DNA, 459 bp, Homo sapiens
agccattttcaaaataaggactatttttcagaaaaaaatgggaaacgtccatcctttgaaacatcctgcctcccttctttgctttaaattccacataagctattttgagcttactgctttgatcagatttagctgtaagtaactatacttagtcatagacatctgatctataaatagaatctactagaggaattgctataacttccttgaaattggcaagtagcagttccatttgatgtgattctaggaaagctttatactgaaaagaaaatgcagtaaatttacctacagagaagacatttgctttcaaaattacaatgtctcaagagtaaatttgcacatccatgttttgaagaaagaattgccatttaacagtatcttaaacaaacatgtattaattactcaataatcaccctcaatttggggaagtaaacagtaacagaaaaattatgtttttcc

SEQ ID NO: 156633 - DNA, 147 bp, Homo sapiens
gccaattacagactccacagcctgggtttctagcagagcggttactgctttccagtggttaacctgactctagaggttcttccacttcctatgacctcctaggcagtcctacatgcacctcagactccacagacacctaaaccaaac

SEQ ID NO: 156634 - DNA, 391 bp, Homo sapiens
tgcctggcttttatactctcccagttagtaagaatggtgtctcaatgggacagaatgtgtccggcaggtgaagacgaccccaggtgcatctaccagcccaattttagggtaagtaaggccagctgtggttgccgtctacctgtagccatccccaaggggagggcatgggcccctacgtggagacagttactgtgccaccctagccacatattattggctatttgaagggattggttgcattgctgtgggggtagccaccccacattaagagtttagcttgtgacatgctattatcatgcctttcagtacataagggtgcatgacttactacctgtatctgcactcttgttactcacccttgtccatcgtgtatggaataccccacagctgg

SEQ ID NO: 156635 - DNA, 475 bp, Homo sapiens
tgaattactttccttttatgattttccttttttcccctggatgcatgccattcttgaatgtcacatagaatatgaagggtgcactttacattttccgtcaatgccttctttgaacgcagccttgagctgttaacttgaagcaaggagccctaggccttccttataaacaagtaatggagcccttagccccccttgtaaatggctatttattaacatataccatcaccaaacaacattttataattccaggcccccacaccattacaccactgtctgctccattgtaaattaagggagggctttggccatctgtttcattaaatgccagaggcagcaaacaatatctgaactttataaatcgagagttagggcttctccctccacaaatctcccccttcttcggctgccaccaccactaccgccaccatatttttttgtttgaacgctcacattgtaaactagcgtattcacacat

SEQ ID NO: 156636 - DNA, 170 bp, Homo sapiens
catctctttcatttctgcttaaatttagtagctaaattaatctgtagcaaacttttctatggatttttgcaggtgggaaaatatacataaattcacaatggatggaccttgccttcatagaggttaaaaggaaaatagacatatatgtgattatatatacaacagtaaaa

SEQ ID NO: 156637 - DNA, 147 bp, Homo sapiens
tacagggatgagatagtgcacaaagtattttatgaagagtttagtctgttaccctaatccccccttccccctatttaggcccaccccccagaagtaagcagttttaactgttttggttttagttcttcaggaggcttctaccaaaat

SEQ ID NO: 156638 - DNA, 305 bp, Homo sapiens
tcaatggcttagagatgtatcctgtgtctaagcaaagaaacctccatttttacagggccgtttccatagtaattcttgcatctgacgtttttacatgttttgctgaaattctatgactgaggcctccgctgttctagaagctcatgataatagctccttcaaccacagcctaaacacttaactaagtacaaaggagaccctgatggaagtcactcactctcatcgaaatgcaggtaaccccatggcaggcccctgctcctgtgccatggcacgcatttcccactgccctccctactgatggcatg

SEQ ID NO: 156639 - DNA, 997 bp, Homo sapiens
  misc_feature (997)..(997): n is a, c, g, or t
attatccctcattgccatttagaatgggtggataattagtttggcattaaccttgaatgtgaaagaccctagaaagtccagctccagggggtgctgttatttttcagcatattcttctacagccactttctgacatcttatgtaagggaaactgaaaatcttaaatgattactcatataaataatcttgggggaagatgagatagaaagaattgtagagaatacatcaccttctctaggaaacttatttttcagtagtattaatcaatcatgaaaaatataaaatatggatgcaagacccaaatacatacatggcatacttctttcattattttattttaaaaacactatttaaatgctataacttagtactttctcttttactgacaaagtcacaaagaataattgttaagtacacactacatgtcaagaaatgaaagaaaatatacattttcggtttctagtagatctgatactaaaatttagaaatatacctgggactcaggtgaattagtacaactttaatttcaagtgagtgccttcacattaagtttccattagcctttcacttaatgagtattttcacatacattgtcacatttgatcattcagtgaggtatggggtgaattatatgaaatcgtgatatttgaccattgtggagtcacaaaaagcagcaatttatgtggttgaatatggcattattaaactacttttgggatgcagaaaagtgagggttaagaatgtgattaaaaaatcataagcttcagaacagagtaaataagtttaagatggaaatttatgatttccatattgcactatgatggggcgcaccattggttcctaaaaaggatggatcaataggaggataactggattatggcaaagggggtaagtggttggtgaggcctttccaggaaagggtgtgaatgggcgggtggcagggattataaaaagtggacaaaaagggtgaaattgggttctatatatggtgtatcgn

SEQ ID NO: 156640 - DNA, 513 bp, Homo sapiens
ccggtggggatagagaatctccagaatgagaatccatcagactccaatcagtccctaaattccacaaaggcagaaataggagctttttatttattcaagtaattttgtttctttcactaagcccaaaacatagtttaatcatgtgctgagtcctctgctctgttaaaagccaaaattaaacctctctctccctttcagacagagagctctctccccactaaaaatcatttgacggaaaattccaaacaaagattctgcataagaatttgccattctctatccattcagctctagagaaaataggtttaggacatccttgacaggaaatttgaagttctcatatcccagacctccaatcacacagagaatgatgagaggtatcaaaatgctacaaaataataaagaggctgcagaaacagttgtctgatgaaacagctgccacctgtacatgaactgtctcatacattatgaagaacataggagagcaagaaaatcccctggattaggacataa

SEQ ID NO: 156641 - DNA, 184 bp, Homo sapiens
tgcgcagtccagccttcccttcactttcaaggccttacgtttttgaaaattatagctcagttatgttgtagaatatcctcaatttggatttgtctgatattttaaatgtttagattaaggatatacatctttggttggaatatcacaaaagtgatgctgtgcttttcttgcatcctagtgggaa

SEQ ID NO: 156642 - DNA, 1080 bp, Homo sapiens
aaaacttaccattgttgcaaatattcgtgcatgtatttgattacatgattaatgcctgtctcagctattagacaacatattcttaagagtgcaggggccctctccctctttatggctcaagagtaaatccccagtgcctagcactatacctagtgcacagcagaaactcactatatatttgctgagtgaccaaatgaagcctgcagcagccagcacagatggcagcactccagtgcaagattgtggctttcttggcagacagggtgagtgccggctccctctgctggactcccatggtactttccacaaacagcctgtctgcctcttggcacttagcactgtattatggtactctcaatggataatgagctctcttgtcttctctgcacttagcacaatgtctggcacacagcagatgctccataaatgattactgcgtgaaggattgcctcattctctgctatccccaggaatgaactagtgcctgacccacaaacaaatatacttactactatatgcactcatcatgtgccaggcactacactaagcactttacacttattatctcatttaatgctcacaacgctttataagggaggcatttttttaaagtaatttggtttctttgagacagggtcttgctttgttgcccaggctggactgcagtggtgccatcacagctaactgcagccttaaactcctgggctcaagcaatatccctgcctttctgcctcagccacctaaatagctaggactagaggtgcatgccaccatgcccatctaattttactttttgcagaaatcgggggtggggggcgggtgtctcactatgttgcccaggctagtctccaactcctgacctcaagtgatcctcccaccccagcctcccaaagtgctggaattacaggtgtgaaccatcgcgcccagccctgtgctcaatttttaactaagtgcacaattgttctgtgaaaaacaagcaatgggctatttcttgtagcagactaaggagagacttagtttttctgtcaagcagatggtgagggtaacattgttgggccaacatcagtgtaattactttga

SEQ ID NO: 156643 - DNA, 537 bp, Homo sapiens
gcattttttttcatgctcaaagcatgcttgtgagtattgggagaaatgagtgctattcaggcccttctcggattgatacaaaattgagtttccttcctcaatgatgagtaatggactagaatgtttttcagatggcactaagtcaggtaaggaaacattagaaggtaggatttgaatttaaggagacctttaacaatttagaaacgagaagtcattaaaaacagaaagatgtttaaaatagacaaaaatgggctccatctggcagagacaagtactataacaaaatagctgtgggccctgagtgagcaagaaagtactacaacaaattgtaatatgaggcgggtgtatgtagagaattatgaaacgaaagcctagagagtaatctttccacaaaacttggcattgctgaggttttaattagagtgggaactcagatttcattctcctattttaaggctcatttggagaacctggaaaagatccagctaggagaaggaaaaaaaaaaaaaaagattaactgggtggaaaatgaagtta

SEQ ID NO: 156644 - DNA, 503 bp, Homo sapiens
aagttaatggctcactcaagactctcaacaagttggtgctaacaaagttgattttaaatttaggttcggctaaaccctgagtcccagacttcaaatacaagaatacagcaccagctgaaaaatatcttaactattcttctttaaaactaaaagcagatttcctctacctccccttgcactctcacaccagctcccatgaagacgatcctcatcaccatcttgcttgctaaacttcaatttgaaaaatagttactaattgaccaaaatactatgttgggtactgagaacacagagataaaaggacaccatccatgctccacaagaattgatagtaggctacagaaggtaaaactagcagaaagtaagctataaatgacaccaagtgcaacaacatatttaagctcaagtgcgaacaccagtcaagccacagacacagagcaaaaggaaaaaatctacggctgcaaggctttttacagactggtaagcaattcctgtccagattc

SEQ ID NO: 156645 - DNA, 290 bp, Homo sapiens
tgcccaggttctcttcctgctctcagattctgtgatttctttacagcaaaattcatccttatttattcaaaatgtattaaaacatatattacaggcaaagttttaatcaatgcatcatataaaatttttagcaagacaacatgtatttaaaaagaaaaaactccattttattctcaaaaataaattgtaaagaataaacatttcctctaaaaaattttgaagcaaaattggatcagttcacatccatctcatttggggataatctacataagcaagaaggtcgtgaacat

SEQ ID NO: 156646 - DNA, 483 bp, Homo sapiens
atcatacttttaatcttcaaaatggcagttctgagagttgacactgcaccttcccctcaaggataaggactgtatatcaatgagatatatacctaaattacttaagtatattttggctagtctaaaatgtctagggtaaatatctcaaataacagtagattagtgattctaggccaaatatgtttttaaaacttgagcccaaagtttttaaaacttgagccaacatttagataatggaagaattcacataaaagtcagaagctctaccaacacttgggtacaccttaccacatgattaagtacaactacgactgcccccttgagacaaggcctgagctctgtccagccccgactcacacaggaaaagtgagcccttttcactgggtggcctttcataaacaaggccttcaaggactttaggcctctgagtatgtgactcctagatgcctattgtaagtaacacacaagaaaccaatacaaaaa

SEQ ID NO: 156647 - DNA, 133 bp, Homo sapiens
agctaagtcaaaggagtaagacatttttcaggtcacttttggtttaaattgatagcataactatacctgggaaacagtctgactatgataattgaaagtaaaaaaaaaaattaaaacactgagtcatgcttgg

SEQ ID NO: 156648 - DNA, 320 bp, Homo sapiens
ccaccacacccagctaatttttaaaaaatttgtagagatgggttttcactatgttacccaggctggtcttgaacttctgggctcaagcagtcctcacacattggcctgccaaagtgctaggattacagacatgagccaccacccctggctgattttttcaaaaagttccatggcttttcatttcatatttacatcataatgttttttgagttaaattttggataaagtgaggtttaggtcaggttgttgttgttgttgttttgtttgtgttttttgtttgttttttgagatggagtcttgctctgttgcctaggctggag

SEQ ID NO: 156649 - DNA, 596 bp, Homo sapiens
cacatttgagtccaggcagctgcacactttccttcagcctcacaaggcccagcaactgtgctctcaacaaaggaaaagctcttctgctggtttatatttatgagaagcagagtagaaccctggggggtgaggggggcaatgaaatggagcctttggagctggaactggcccagcttcaggtgaagcctccaagtgggtattctgaagtgaggactgtaacaagagaggccaagaaggctatgttccagttaaggaaaaatcccctctggcacccccaaagcaaagcagtctcccccatcctgctctccccacaattatagaaggcagacagaagagatcaagatgcacatgaatagaaaacagcacttctcatttggattgaggaaattttcagtcttcaaccagtccttcaacatgagcatgaatagataactgagaatcaccaaactttgaaagaactgacaaggctggcacagtgactcacacctgtaatcccataggcagcactttgggaggccgagcaatgcagatcgcttgagttcaggacttcaagaccagtttgggcaacaaagcaagaccctgtctctggcaaaaaa

SEQ ID NO: 156650 - DNA, 540 bp, Homo sapiens
agtgggaggcctcgttgttaaccttatgagctctggagtcaggctcaaattctgacttctgtacttagtagctgtgtgatcctgggcaggctacttaacctctctgtgccttaggcgcctcatctgaaaaatgcgagtaatagtaataaactttactgaggttcgtggtgattaaattaatatttgcaaagtgctcagaactagatcttggcatttgatgaatactgattacccattaattctttttatgatatcctgaccccgtttcttccatacaaagcaggttaacatgcatccgtgcatgttggtatgtgcccagaactgtacacacgcacccattaacaatggctgcctggaagtaggggtaagaaggaagtgtgagtatccatgtccctttgtgatagatttatttgtgaattactgtaacttcctacatcaggcactgacacttgtggacaggtgggtaggtaataggtagtagctatacacacggtcattcagtgaacaagtgctctcatctggaagcgcacacgcctccgg

SEQ ID NO: 156651 - DNA, 724 bp, Homo sapiens
tgaggggagagggcagggggtggggtccacaggtcatatatacacatatgtgtatatacccctcatgtatacacatatgtgtatagacccctcatgtatatacatatgtgcatacaccttatgtataaacatacgtgcatttttctgagaagtgggtccatagctctgttaagattctcagagatctatggcccagaaaggctcaaagtacagcttgaagtcctcttcaactgcacttccgaaagtatgctaggtcagttcatgcttccaatttagaaaccacctgtgtttctagttgtaaaagcgccttctcatggtatacccatctcacataaagggaaaagggggctgcttgaaaaataatcctgtgttcctgaaaaacatctctagccatgcacaaaaagatgagggttattaaatgtaaaataaaacaaaattaagatatagactattgctcaagttttcaagtttttgaacataaaacaaacgaaacatttactaagcacttagcatagtgattgcttacaagagaaattaacttttgttgaggacctactatgtgctaagcactttacatgtgttctcatttaatttcattctccattgaattatatctcactagctctgttttatagattttttaaaaaaccactgagcctcaaataaattatcccccaaaagtcatctagcaagaggatttgaacccaggtctctagacctccaa

SEQ ID NO: 156652 - DNA, 182 bp, Homo sapiens
gagggtgggcggcacccgactgagccaactacatatgaaggtgccagggctcggcccagggcgggaacctggcagggtggcacctcctgggaaggtcctgggtgcttccagccccatctcactgacagagactcagaggctcagaggtgagtggaaacatgatagtccaacagcaaacttgc

SEQ ID NO: 156653 - DNA, 797 bp, Homo sapiens
atatctgcattctcattaaagtcccaggaatcaaacagacttaagtgaaagatgacatactaagtttcttagtgtttcaatctcactttgcttagattaatatttctaataggtcttagaattgttctaatttgtgtgatgatttacttaaatcaacttagcgaaattacagttgagagattcaatttgaaagatgcattctgcagttgattagactgtttatagatctctagaaagatttatatattaacataaacagtcttaattacagaaaggattaattttgttttcattttaagaaggcattgtatcagaatccatacttaaagaaaaaccttgagttagctaaaggaatattagtttattagcaaggtaactaagaattatggaggattaggggttctgaaggtaagaaagatttgtgaatccttatgcatgagttataattattctcatagtcatacagccttctctactagacaggtcttattcttaagagaagtcttttatacatgatacatagtcttaattacagctagcctctacttgtaaaaaagaaaatccttagccgttagctatttactgacttccccgtatttgttatgttcatgcagtgtctacttattctttgtatatgaaaacagcaaaatcttccatgtcagataagcattttacaaaaatgaattttcttgtgtgagataactaggaaataataataatgttaaaagaaggacaaaaaccaagaaatgagttgataaaaatcaactcgagcttttaattttagaacaaaaaaaata

SEQ ID NO: 156654 - DNA, 411 bp, Homo sapiens
agtggccagaaacttagtggcttaaaacaacacactttcattctctcacatttctggaggccaaaagtctgacacaggtctcactaggctaaaactgaggtgtaagcaggcttggttccttcaggaggctccagggagggtctgctttcctgacttttccagcttctaggggtgcccacattccttgactcatggccccatccatcttcaaagtacctcactccaatcactgctacccttcacccatctcctctaatctgaccctcttgccaccacattccaagaacctttgtgatgacattgggcccccttagataatccagaatgatcacctcatctcaggaccgttaacctaatcgcctctgcaaagtcccttttgcgacgttaggttgcatattcacaggctccagg

SEQ ID NO: 156655 - DNA, 327 bp, Homo sapiens
caacatcgaacactccagccctgtctccttttcccacccgccgcgggtcaggcacacacctggcccccgggcctgcagaccctcgcacaaactcctcactcctggtgcggcccctccctgcgccgccctgttcattcctggccctggctaacagtcctggcgatggctgtcactccctctgccagtcgtccgggacccacgctccgcctgcctcaggatggaaattgttagaggtcagggagccctggccggcctgctcacctcgcaaaccccgggcttagagtccgacctgaaccagcagccatccattccgagtgcccccgtacc

SEQ ID NO: 156656 - DNA, 213 bp, Homo sapiens
ccatccttggaggtctggggggtcagattcacagttcaccagtaagattgagcagtttcagagcctggaaccagcacaaccaaaaataccaccaaaacatcttttggactgacactcaattccaggggctcagggagacagcagttgtgataaatgtagtagtagatccattaggcagacctgacctcagcaaggcatgaattaaagacacta

SEQ ID NO: 156657 - DNA, 382 bp, Homo sapiens
cgcccaccttggcctcccaaagagctagaattaccggcatgagccactgtacccagccagctacagtaacattttttgccaattaaatttattcaacatatttagcatctaaaacttgtttgtgtatatagtgttacaagattcaaattaaaataagcaatttttcaagcttaccaagaatttcactgttcagaaaaataatatccttaaattgtggtgtgtctactcaaatctacaaaattgaggaaatatgcaatatgcaaaatgctaaccctctgttcctatcccataacaaacattacattctgtatattaacataatttttttaatcccactaaaaacaagatacaatcactccgtcacctaatgtgctatacacgg

SEQ ID NO: 156658 - DNA, 339 bp, Homo sapiens
tgctgggattacagacgtgagccaccagcgcctggcctgtctgtataacctcagaattactttgtacctcacaaatctcaagtactaagtactgaatctttgttctccccctcaccaagtccttttgaagtcacacagagaaatttcttgaattttttagagaggcgtatagaatattaataactaatgtttattgactggttattctgtgccaggtactttgagtactttatgtaccttatttcacttactgtctaggacaatctagtgagataagtaatatgatctccatttattaaaatattcccattttatacaggaggaaacactcatagattc

SEQ ID NO: 156659 - DNA, 342 bp, Homo sapiens
acaagtagggaggcaaccaggcccttccctgggtcagggaagggagacagaaacatttcaggatattaggattgcaatagtaacgggggtgcacgcaaaggaaagcatgtgcaagcagcttgagatggagaccggctggagagcatcggagaccaaggcgaggccccgtctgtgaggagctacgggggaaggggagagctgaggatggggacacccagagacggcctccgcccagcgcgaggcggcacagagaccaggccgggctccgcgtctgtcacggtagcagtgtggcccttgaccctggggcagtgatcgtcctccacgcctgctcgctgcgtagcg

SEQ ID NO: 156660 - DNA, 395 bp, Homo sapiens
aaacccgtactctcagcagccccttttctccagtcctgtggctattctcatctgctcgcctccaggacactatcctacccccatccctcatcattttcacctcttacctgcagtctggaggagaccctgtctcaaataggcaagaccacagtgagatattatcagcattgtaaacactctaccttctagatttctgcctggaaccttatttttataaaatccagtgacttcagaaagcagtaattgggagggaggtggattttgcttctgaccaagacaaaagctgacagagagcaatggaataatctgtgctgcacaaagttgtccctctcttgtgagagctctacaccagacatgctgaaggaggcatccaggacccctcaagagtctatgac

SEQ ID NO: 156661 - DNA, 534 bp, Homo sapiens
atggcagggcaggggaggaagagaagaacgtggacaagcagtacagcccagcacagactgcatttagatttgcttattccagcagtcagtgctatgtcaactatctgatatgtccacacatctctctatatatttccctctttttcatgtctctgtctctgtctaatgccaatgtcacccagtatccatagagttagggactagatacacagttctactgactgacagttttctaggcagcaacaagtatataaactcttgagaatgtttgtgccatttgactcagtaattccacttctacttatttttttttattttttttatttttttgagatggagtctcactctgttgcccaggctagagtgcagtggtgcaatctcggctcattgcaacctccgcctcccaggttcaagcaattctctgcctcagcctcttgagtagctggtattacaggtgcccttaaccttccctgctaatttttgtatttttagtagagatgggttttcaccatcttggccaggctggtgttgaac

SEQ ID NO: 156662 - DNA, 350 bp, Homo sapiens
tgtaaacctgtggcattcttagcacataaagcctctgtagtttaaaatcaaattgagacaagttgtaaactcatgaaacagttaagctcatgaaagcaagctagttactgtcaacgtgaaaggtttacaactaatccttctggcattcaaaggagtgtcagtgacccttggtggtagtcagggaaggcttcagaggaagatatgactaaggctggactaaggaagtcccaaatggactattcagcaagaagagtaataggaataaggacaagtggagggcagagtgggaggtaaattctcaggccaggtagcaaatgaggaaggttaaaaaaaggggtggggggaaacaa

SEQ ID NO: 156663 - DNA, 385 bp, Homo sapiens
aattattgttccttctggtgaaggggttggtgccatcgtgggtcctaccaggttataaattaatcacagtcaatctagtagccaggaataggttccagccttgaagtcatcttttgttagagtgagacttctggagatgtcaggtccatatcaagatctgacccctgaagcgttgaagcaaatatatgaccagataagtgagtgtggaacattccgaggctgtaaagtttatctcagaactacatcttgaaactgggtagggcagggagaagagcaaatggaaaaagaaaaaaatgttttatttcttatttatttatttttttgagacagagtctcgctctgttgcccaggctggagtgcagtggcaccatcttggcttgctgca

SEQ ID NO: 156664 - DNA, 474 bp, Homo sapiens
caagataaggcttgataacagggaatgaggccagccagaatgtgcacagggatcctgcatagcagtgagcataaggaattcagggatgcaggcattcggggtgggttggaatagtcaggggagaattcctagaggaagtgggtctcaagaggtgggtagggttgggatgaaagaaaaagcaaagagtgttcttggagatgggaataattcagaagtcttggagagtacgcctctctctggagctctgggaaccccaatgatggaggaattctatcatctacccattcattctttcactcattcatttaataaacatatattaaacacttacttcatatttagagtggtgatggccgggtgcggtggctcacacctataatctgcactttggaaggtcgaggtgggcggatcgcttgagcccaggagtttgagaccagcctgggcaacatggtgaaacctcgtctctacaaaaaa

SEQ ID NO: 156665 - DNA, 561 bp, Homo sapiens
gtattctccaacaaaggtctactctgtaggggaaaatatattattagacccctatcctggtttggggagggcatttctcccacttcagctcactctagccttcctgtgtcggtttcagtgggggaaaatgtataccactggagaaaagcccatgaaggtcacagctcagagaaaataggcaaagtaaaaaataaaggtttaatcctaaaattatagactgtatttcattccccataccttactaccataccaacagagctctggtataataacaatgcatttcagctggaagagttgcaagaatggactctttttctgaggaatagtactgagataagctcaaagtcaatggatgagacaaacataaggatactagaggaacttgaagtttctgacatctatagcaaacattaaacacagcttacctcctggccagattaacaaatccacatcatatgtttacctttgttcttattactcaatgcaacatggtgaactttcaacaaaaaaaattagaaggcacacctaaaggcaagaaaaaacagtctgtagagataaagc

SEQ ID NO: 156666 - DNA, 464 bp, Homo sapiens
ctaattggtgttctggttaacaccctccggtttgtatcgtgtaatcagactgcagcttacagttcatctttgagaaatagtctaagagaaattcatgtaaattaaatggttttcttcctaaagcattcagggagagttgttcattttaacgtccacgctgttaacacaggagtctgtgtgcagtcttggatccaacttcaacacctgtgttcatacccgtcacctttgtgtagaggaactcacactagagataatgtgacttgctgtgagctctcctggcctttggtttactgtcctcaggcaactgtggtgtgtgtcaggatctttcacactatcttacactcttaagaaactacagcaaattgcaacaactcccaccctcaacaatgtattggacttgtaattcagaggattgaaagccccctcccttttttccccccatttattcttcagaacaccgtcgt

SEQ ID NO: 156667 - DNA, 1316 bp, Homo sapiens
aaatgtcaaatgtcattgaaactagagtgggtaactaattttttttattaaaaacaatttttattgagccagggtctcactctgtcacccagggtgtagtgcaggggcacgaccctaggtcattgcagcctcagactcctggactcagatgatcctcccatctcagccttttgagtagctgggaccacaggcatccgccatcctgcccagttaatattttttaatttttgtaatgagggggttttgctatgttgcccagggtggtcttgaactcctggcttcaagtgattctccctcctaggcctcccaaagtgctggaattacaggcacgggccaccacgtccagccagagtaactagttttatgtagcaagcaaggtaaaagggagaggtcattttgattctgagtgttttgccttgcatgactgggatgatggttgcacagttaaactggaaatagggaaataaagcatggcaaggaggtacagcaagtttttggtcttggttttggacattcaggttttaggggccattggagtagctgggtggagaggtcacatagtcttctgcacattgagggacttctttgggagagaagtaggctctggagatagggcagtcatttgcctttaagacgattgggacagactagagagcagataaggttgggagggggaaggagaaatagagggcaggaatggatggaatgccaccagggccagggatgtgggcgagcacccaggatgtgtgccaagagagcacatcaggaatggggggatccaaggccatgaggaaatgcatgaggtgtggggatgaggcagaggccgctgataacttttgagtcatcactacagagtcctgtggctaaaatccagtagggaaggggctgagagactcgggggtaacacagcagaagcagctcctgagcagctggatgtttccattacagggacagggtagagtacgagactgagaatgagagtacaagggagagtgtgtctctccgggaggtggaagaggaccaggggctggtttggtagatgggaatctgagcatatgtaggacactgggaagaaaacactggtcagacagtgagaagaccagggaacacttactgagcacttactatgagccaagttctgtccaggcctaaccacacttaatcctcacattgaccctgtgagataggcgctatcatcaccccattttacagatggaaaaagtgaggccccgattggtcgtggaacttgactaaggtcacacaggttgaagtggagtcaggatgtgaactcaaatctgccagcctccagggccagt

SEQ ID NO: 156668 - DNA, 424 bp, Homo sapiens
gggcagaaacccctcatgcaaagtgggaggaacgtcactgcacagcctctggaggcctgtccgtcagcatgcagcaagagtgtacaggcatgtttgccctttgccctggcaatcccacttctagaactctatcccgaaatacaccgacaaaaacaggaaatgttctatccatacagccactcctggcagcactttctgtgacagcaaatgccagggaataaaccatcccagtggctggccagcccacggcagcgcacagtgcagctgcagaggaggccggggtggcccctccagcacaaaatgatgccttttgtgttatcaggggatacaaatgtgtgcctagatttgtgtggatttgccatatgctttcaagatgaaaggaaggataggctgggcacggtggctcacacctgtaattccagca

SEQ ID NO: 156669 - DNA, 367 bp, Homo sapiens
ttcgaacatgtgaccagcattcctgctgatcgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctg

SEQ ID NO: 156670 - DNA, 531 bp, Homo sapiens
ttctttgctcaggagatagttcctctattagatggtctgcaatgaggtgatggcccaagggcctatcgcccactccatctccccgtcctttgccaccatagcgtaatcaatttagaaaatgaaggaaagagaaagaaccaaacatttcagaagaagtaaatttttcttttggaaaatcaccaaaaagaggaatttttgtgtatttcactgcttaggaataatttcttttccctcaagtcctcaaggttgcctgttagctcttaactgtagccagggacccagttatgcttaatttccagatgccatacactgttcactcatgaactgagacaacattatgggaattaaatcatatctgcagcatacttaaaaaaaaacaaacaaaagaaacctcttcaaaccagtctatttcaaaaagtgatggggttttaatattgtttgcaagaattgcctgcagtttttctctttatttttgggggctgactgaagcagccttcatggagacagaagtcttcattcaggtggtaattt

SEQ ID NO: 156671 - DNA, 124 bp, Homo sapiens
ttttcctcatttgaggggcgataatatcaatcaaccacctctgtgcaatcgcttatgtcaccactgaaaagtcaccccagacacctctgtgttcaaatagtgccacagcatccttaatcaaata

SEQ ID NO: 156672 - DNA, 206 bp, Homo sapiens
acacacacacacaaatggacacccgagcgggcacacccggctccacagacccggggatggacatccaacccggacacaaacacccagagcagctagtcgcgcacgcacatgggcttgggggggacccacacctgggcacacaacccacgcacacacacacctgcacacagcccctccgatgggcgcgcgacagcgcccagacacac

SEQ ID NO: 156673 - DNA, 145 bp, Homo sapiens
aaaaatgagccaaagaagaaacagctaagatcgatgttgtcacatttagatctacaaaatcatcaggtaaaacccacatgacaaaattctcctggccaaacaaaatgtataaaatacgctaatatgcaaacccaaaagctacaga

SEQ ID NO: 156674 - DNA, 592 bp, Homo sapiens
cgtccccaggtcaggctgtcctcctcctgctccagtttggctttcatgtcccacttttccctcaagagatggaaaagcctgtcctttcctcaagcccgcatttccatttatcagaacatggcagggaggggcaggcagaggcaccatggaggacagcaagtcccatcacactcaggaggctcctggcctgtgcagcctccagctatcagcactgtcccttccccatttagccgctgcttctcgggaggccgccccagtgccctgagcctggaggcactgttcatggggccagccccgctgcggggttctcctgccctgcctcttcttcagagccaaaaagaaaaagcacagagggcaaggcccacatggaaatcttacaaaacagctgagggccaagagtcctggaaattccaagcaatcttgtctcaggggaagaggctgagtccctgtcattttaagaaagcctcctgtctgcacatcaaagtctcgtctctatcttgggaccctatcgaccacactgggctgctgtgaatgtaaaaggagggtccagatggaaagaggctttattgacaggacgcggcagttcatgcct

SEQ ID NO: 156675 - DNA, 545 bp, Homo sapiens
aactatcatccatcatggattcttgaaaaagcctttttttttcttggagacagaatctcactccgtcgccgggctggagtgcaggggtacaatccaggctcactgcaacctccacctcccaggttcaagtgattctcctgcctcagcctcccgagtagccgggattacaggcatgcgccaccatgcccagctatttttttgtattttttagtagagacagggcttcaccaggttggccagcctggtcttgaactcccaacctcaggtgatccatctgccttggccttccaacgtgctgggattacaggcatgagccactgcacctggccagatgacattttaaattagtggtgaatggatgggatactgattaaatgatgttggaacatttgactaataattttaaaacataaaccatagagtttgttgttgttgttgtttgaaatgtagtctcgctctgtcacccaggctggagcgcagtggtgcgatctcagctcactgcaacctccgcctcctgcgttcaagtgattttcctgcctcagcct

SEQ ID NO: 156676 - DNA, 386 bp, Homo sapiens
tgaacccactccttgttcaaggaagctcccctgggcttttaatcacttaaataaaacctcttccctgccccagggacttgagagtacaaggtcatagctggcttttcctggcttgtcaggggcgtgatcccggaagatgagattattgcctaagagctggtgggctggaagagctccaggttttgtcctgggggagggacacgccctccagggaccaggaagcaggtgtaatagtatcagtcgcacaagagctggaatcgggtgagggcttggattcagctacccttccctccaagaagccccaggatcgtttcccctctgctgtgtctgtcctccttggagaggggaggcctgtggataggctggcaaggtcaaggcaggctcag

SEQ ID NO: 156677 - DNA, 553 bp, Homo sapiens
ggacttctgaggaaggaggatggtgagacacccaggtgagtggtgccacacacaaacacaaaatgccaagccagggagtgggactggaagggggcggtgaggtggtgggaggcacccacagaggcccttctgcactgtggggtctggtgtgttggaggaagatctgcacttggatgaggagatttggggatcgccagcatccgcgtcattgaagtgatgagcatggacgtgtgacccaggggcttgaacggagttaagaagagcagggccaggagcagacagacctagagagcaagaacattcaggagcaaagcctgaggcaggagggtggtcatcaacacagatgctgcagccaggtggcccagggtcgggcggcatccccaccactcctcccggggatgacttgcacctgaaacagaggtaataaaacacagcagccttgtgaggatgacatgacttaatccgtttaaagggctgagaaagtgctcacatactttagctctttgagggctagaggcccagaaggcatgtgagggagacacggagtgatgct

SEQ ID NO: 156678 - DNA, 409 bp, Homo sapiens
ggacttctgaggaaggaggatggtgagacacccaggtgagtggtgccacacacaaacacaaaatgccaagccagggagtgggactggaagggggcggtgaggtggtgggaggcacccacagaggcccttctgcactgtggggtctggtgtgttggaggaagatctgcacttggatgaggagatttggggatcgccagcatccgcgtcattgaagtgatgagcatggacgtgtgacccaggggcttgaacggagttaagaagagcagggccaggagcagacagacctagagagcaagaacattcaggagcaaagcctgaggcaggagggtggtcatcaacacagatgctgcagccaggagactgaggcaagccaggagacctgagcaagccaggagacctgacagccaga

SEQ ID NO: 156679 - DNA, 518 bp, Homo sapiens
gggtgtggtgagtgttgttcctcgtggtcgtgaagacactcggagcttccctgttctcgggggcaatggctttggacacgctgttcaggatgcccctttcccacgcgcaggcaattataccgtcagagcccatggcccctagacatcatggaggcctcctcaaatcacagagaaccacaaatggcctcgcaggttgttgtagacgccgtgcgcttgtccggggtgggtaaaggctccgaggctcaggtccagggcccgagggggctgtccttccaggtggatgggggtccccagggtctttcagggaagcttgagcccaccccaagagcagcttcctcagagttgtacaggcccacagatttgaggttttaccttggaggagggttacctggcagggtttgctaagtggatgtcagggctcccaggccctcctgcatggcactgcagcatggaggggtctggccaagggttggctccccagcctgcttctgggccttccacacaggtcaggcggccgc

SEQ ID NO: 156680 - DNA, 470 bp, Homo sapiens
ccaggatttgcttatatgttttcttcccaagaaagctataaacagcgagaattttagctgtaagttttcctgtatgccccactcctcccctgccaaaaccagagttaaagaaaagattaactgcccatttttctgtgatcagcggaccttatctatcctcccaattccttatgaacatagttcgttaagttctataagatcctctttttcttgctgtacagctccaaggccacaaaacgagtaagcataagtcgcaatttcagattttctcaaaatctaaggcatgtcacaaaataatttactgcctttgtttcttgctcctgtaacattcttcccgcctcacgtatctcccgccttaaagagtttaaaaggcaatcacccaagctagcagtggcaacccatttgggaccccttccacactgtagaagctttgtactttcactctgctcaataaaacctacagctcaaaa

SEQ ID NO: 156681 - DNA, 627 bp, Homo sapiens
cttcattcttgaagtcggcgagccaagaacccaccaattccggacacaatattgcatgcattaatagaaaggccaaaatgaactgcatttcagggggaaaaatgctgaccctaaaacaaaactaataaccaccatttaaaataaagaattatatgcataagaatgagcagagctgctctgagggaaagctgggagcatccccactccaaaatgaaaatctgaacttttactagttattcaacacttttctgagcactttccttattcacagaataagaggaatcttgggtttcccaaggattcacttcaggcttttcttaattagcaagttgtcctggattataaaaggaattcagtttataaaaactaaatcattcttctaagtttgagcatagatcctcactccttaatgggagactgtgcaaaatgactcccatccaatgagtacagtatggaaaggaagaagaaagaatgacttcgccatagagaaacctgacagcttatgagaaaaacatcaaacaaacccaattgagggacaaaattcctaaccagcactcctcaaaacattcaaggccatcaaaaatatggaaagtctgagaaattggccagccaagagaagcataagga

SEQ ID NO: 156682 - DNA, 644 bp, Homo sapiens
agaagctttgcacaatagatgtgacatgaacaatatcaaaattatcctccagccatctgtcctcagaatcgtgagatgtaattgttgtaggctctagctagcaagcatgattagttcactacgaggaacgtgtccttgtatcctatatccaacaaaagagaatctagttttgtcaatgggataatgactgctcatgggcaggttaaggaacaaaaccaactgtcttccattcactaggcagctttcttcctgtggggtaatcgaatattctgctctctcacctctgcctcccagtgtccatctgcaaccaccctgaaccacatttgagtctgttatccacagttctgagtgaaaagggaatgagttttaggaacagccttccaaaaattgcattttatgctgctggaatatcactgaccataaaggtaaatcgaaatttaccctgctaaagttagtactacaagtgtggttgaagtttgccaccataatgatcacaggtttatattcaacaagtcatacggtgatgtttccattattggcaaatgagatatcctttaagaggacttaattcattaggattttaaatacttctgttttgaatcaaaatcttgctcgttttgaaagtttctagacaacaagaaaga

SEQ ID NO: 156683 - DNA, 408 bp, Homo sapiens
agagaagcctagcaggcatgctaacgctcaaatcaagagctctccagcagagctcatacctcctggagcctgtggatcaatgggaaagccaactagagaagaatccagtcagaaatgagagcactgccaagtaggagtcaggcagtctccgaatacagtgggtctgcagaaaacagagaggcagctgtggttggtgcaactgagaaaggcattctggcaaaggtggccctggagctgggctgggaaccatgtgtgcttggctatctggagaggaggatgggggctttgcggtagggcagaaggctaagcctagtggctggtgtgggttcccaggggtgggagtccagcccaggccaggcaagtaggattggcagggaggggagcctgttgagtggaggctgatggcca

SEQ ID NO: 156684 - DNA, 340 bp, Homo sapiens
ctccacccgacggggagggtgagggaagggcacctgttctcaggactagggcagggctgggtgtgacaggaaatagtcgagggattaaaacaaaacaaaaaaaacacccgacgccagtcacagagccacgagcctctacttccagctactcgggaggctgaggcaggagaattcttgaacccaagaggcagaggttgcagtgagccgagatcacgccgttgcactctagcctgggcgatatagcaagactccatctcacaaaaaaaaagaaaaaaaagaatcatggatgccaagtatgtgctgggcgttcagcacgtgtgacctcaggttatcctcccag

SEQ ID NO: 156685 - DNA, 657 bp, Homo sapiens
ttaaatataaaaaatggccataacctaggcatcttatacgtatctatttaatcaatctttgcagtaacacaatgacacagttttattatccttattttatagatgaaggctcaaggagagtaagaagcttttcttaaatagctatattttatctcaaatatcatatacttcatgttattgtccttattccaccattagagtttggggccattaacattttacgttaaaattacttacgtaggcttggggtttttgttttttattttatagattctaaaattgaactttctaaaataaattttcactttaattataaactatactcctggttcttaaggattgagttctgggaagaatttcagagattgccaccacagctatcacgacctcattcatgaggtgcaagaacatgaaacacatatagcactttcctaggtatttatgactgaaaaaagagaatctttagttgatcttgtaaaattaaatatcaaagcctgcaagccactagtttctggcttttgcatactttgttgcctaccctcacaacaaagaagttgcacctgattgacattttcagtattcaactgatgaccagaaaagtggctatatgctcctacatgtttgataacagaagaaaaatcctagcttcctttcctt

SEQ ID NO: 156686 - DNA, 642 bp, Homo sapiens
gacatttactgagggccgattgtgtgtcagatgctgcgctgtgactctttgtgggattgaaagacacaaggcaagcagtggttcgattcccattgtacctggcaggaaatgaggctctgagaggttcagtcacttacctgagttcactcagctcattaaaggagagctagggttccaacgctggttgatctgactctgaaatgcacgcttttccctatgcaccggaaaaatagaaccatattttaaacagtttttgaaaatagatcaaagggaaaaaaatgcacccctaacttaactatcatgagacaacattgtttagtatctggtgtatttctgtctagtgtttttcccccgtttggtgactgtatatatttattaaacatgtattttacataactataatcataaaagaatatggttttgattgagactttggatgaggtaggagggtctcctgagctggggccaccggggagggattgattcttggcaaaatggaaacctggttttggctctgagccatctttttggtaatgaggtgcctgaaactgcactggagaaggcaaactggctgaatggagaggcaggcgagaccccagtgttctctcctgggtagcttttgctcagttaagtggcagaatt

SEQ ID NO: 156687 - DNA, 353 bp, Homo sapiens
cttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcggaagtcagtgcccaggccccacacagtcttcaaaggtctggcctccccagcgtggggctcctcgtttgaggggaggtgacttccctcccagcaggctcttggacacagtaagcttccccagccctgcctgagcagcctttcctccttgccctgttccccacctcccg

SEQ ID NO: 156688 - DNA, 138 bp, Homo sapiens
aaaaaacactcaggacacctagtaaaatggctcttgcagtgtctgtcctgtgactagatttataaatgccctcctcagtgaaagcagaggccgaagctatccaatcgtttgaccaaagccttagttagcatattatct

SEQ ID NO: 156689 - DNA, 333 bp, Homo sapiens
ctagctctgtggtagccttggaaacccacagcctcacatctacaatagctgtgaaaaacagcagcctggcagccactggagaggacagaataggtctggagttcccaaaaagcctgacctgtctgggggctcacaggaaggctgcattatcagctcttgtctttacatagcctgacttggttcatgatatagacagccttatagccagccaaggcatttactgaaaatagtgaataaaaattagcaaaggcttatcactgtaacttctgaagacagtattaccaattgggaattaaaaagaggctaactaaaaagcttaaaaggaaaaaatgg

SEQ ID NO: 156690 - DNA, 363 bp, Homo sapiens
ggattgtcattagcttccaatgagaaacaggtgcacaatcaaggtctaaagataaagagggttaagtgcaagacagcagccatgacgtgtcggtccacgtacagcctgtctgcctgagggctcagtgatccaaaaagacactgcaggtcagcacttcagagtgttcgcaacatccgggattacttaaccctgtggcttgacaagcagcagagatttgcaaacaatgatagcttctgtgccacttcagccgaacactggctctgaaaacagcctcagtatctgacaagctctcattcctcggcatgaagatatacttaggctctctcaatggacagccacgccacaagcccaggaatgagagct

SEQ ID NO: 156691 - DNA, 679 bp, Homo sapiens
acagagaagggacccctctcttattttcggagtccaaaataagccattttgggagccacatccaccacttttgtgactcccacacaggttggttcccaggaatcaggtgtcttagtgttaatacgggccaataggacaaaacaggacccttggtccttcacaaaacattaggaatatttgtgtactgaggtaatgtacaatgtctttttgccctgaatagggctcccttagaaactcttttaataatcatttttaaatatcactctggaaccacttttagtaatttgctgaaggaacatcacagtaatatcttaattcttaaatatcttaattcatcccatgtttttcttttagtttttcaaattaactctaagtaattcatactgtacatttccgaaattgaagtacacacagctttaattctctgcagggaggatgcagcaggagagaatatcctgggcacatctttctggagaatcatttttactataagatttgtaagaaacaaatttatttccaaagtaagaaattaaaactctaaaacaaggctagaaagtcatctgcctttaataacccttagtcatctatgcctgatatgtgagactttctccaagataaaaactctcaagaataacctattttccatcattataaatagtaaaaattagaaatcatagaa

SEQ ID NO: 156692 - DNA, 229 bp, Homo sapiens
tactcccccacctccagggtcctcaccattcccctaggtaagcgccacactctggagcaggcaagcagcaggcctggagatggactaagtccctcaaagaccctgggggtcaggaagctgaggctggttgtgtggtaagaacgccccatggcctctgtctgcacttcccagctcaaatctttccaaaacatcaagcattcctttttcccctggagctattaagaaacac

SEQ ID NO: 156693 - DNA, 536 bp, Homo sapiens
tctaaaataacacctgtctactaatatatctggatgacatttaaaatcactaattagcagacttttcatccagtgagaaatttgtctataattaagaaaccaaatacacatgattcaacccagtttacaagaaagatcatttgagaagaaggataagagagaggttagttaactgagggatgtgtactctaggtgatatcttgaccatgacatgccaatcacaatttcagatccataaaagggaaccaatagatcttctatcacagcagaaaatgggtctctgatattgggagacagcattcacttattgaattatgcttcttaactttggagaaagaactggaaaaaaagaggctcaaaatatgtccctgctcaacaattctgggctcggtaactgctacttacagtgctctagtatacagtcgagccttacgacgcgaatcatatcaacagcctggacgacatctcctattcttcacctagcagcaggggtttataagacgtcacaggttcacagtcaaatctgtgcgagtaaa

SEQ ID NO: 156694 - DNA, 876 bp, Homo sapiens
catcagtgtacatttcctcttccccaacaagccctgcgacccccaaaagggaaacctgacctagttcccaccagcttacactgcacccttgtacctcacctaagaaagactacacagggctgagtgtggtggctcacacctgtaatctcagcactttgggaggccgagtggggggatcatttgaggtcaggagttcgagaccagcctggccaatgtggtgaaaccctgtctctaccaaaaatataaaaaaaaaaaaaaaaaaaaattggggggcggctgggcccggaaaagatttttaaaacctttggtgggggggggggccccaggtagggcacgagtagaactgcgggccaatagcgttgcccaaaagaagaaaacccgggggcactggcacaaggtggcggggtgtcctcacaaaaaaaaaaacggccggggggcgcacccggcgggtccgtggaccaactccaaaggcggcttccgagcggccatacaccggacgccaactcaacgggaagtccaagcagcgctcgaaatcaaattaacgcccgcgccgtgagacaccacaaaacacacgaccaacacgacgcacgaaacacaacacaaggcagcaaaagaaaacacaagcgccacaaaacacacacacgcaggagacgaacaaacgacaaacagaccccacgcccgcaaacaccgacgcaagaccgacacaaccccgacaccacacacccaaacacacgccggacaacgaacgcaggcacaccagcgacaagcgacaaacaaaacgccacagcaaacgaccatcgaacgcacggagtgcggtccacagggagcgccaaaaacacagaccaacaaacaacgcaacaaaaagacacaaaagcc

SEQ ID NO: 156695 - DNA, 323 bp, Homo sapiens
ctctgagctttgtcatgtaacacaggcaggtaaattaaatctaagaaaaaccacggagtctgtttacgttctctttgttttgatggcagctgagacctctgctgagcaaatataacgcaaaggaaaatactctgcaaaggagaagcttgttctgaagcagggaagctcagaactcatcctagcaggagcctttgcagtttgagtctgtgctctttcagatcctgcaagtggtctgctattgctgcagactcgactgaacatttgtctttctagaagtcttaaaatacatactgcagcaaatccatccacctacctgcagtctg

SEQ ID NO: 156696 - DNA, 433 bp, Homo sapiens
aagctgtgaattaatgcaagccatcattagtctgtgaaatggtacaaggaaggagaaacagcatggcggcagctccaggagatgtcatcactaggggattcccatcagcaggcagagctccattaataaagacgcatttagagacctgggctctgtgaccaatcggccgttcagagcagcgttcctgcttgtgagctaatcagggctaatctttcatattaaaagtattaaggaacatatgacattaaagcgtcacccagtgccgcggaggattatggctcttattagtggagcaaaatgtaaaacgttttggtttagtaaatctataaggcttgatttattcataagcgcatgcaatgcttgcaaggggcagctgccaaataattattgtttatggtgagaatgtatggaaatcatttaatccagtgacgac

SEQ ID NO: 156697 - DNA, 380 bp, Homo sapiens
caatcccttaggaacctctgaggttttccatttatgagactctcctactactagagtgggccaaagggagagagaatcctatttggagcaatggggaggtaacaggtgacggaggagtgaagcactcagcaaaaagaacagagttcatgaaaccgtaatgggttcctcaccttctagcgttctaccaccatgtgaggctggtgccccaaacccaaacccacaatcattttgttgggagttcctgactcaggcctacagctacatggtcatatcttctgggcaagaaagacagccatgatgggtgaaagtaaagaagtgacagaaggacttaggaatcaagaatttagatggggtaagaggcatgtttccttacagactgc

SEQ ID NO: 156698 - DNA, 96 bp, Homo sapiens
cctgtcaaagctcccaattaaaaataaccagataattctggccacttgattaaaaatggtgggataagcttgtgggggaaagaggaatggaatgaa

SEQ ID NO: 156699 - DNA, 406 bp, Homo sapiens
gcaggtaactgtgcacgaactaaccttggaaaggtcaagagacctggctgtggctcattttcctttcttttcttgggtacttgggctcctaatgaaaatgcttctcattcagaggttccgggaagcctccatccatgagcaactcacatgatttacagaagaattgctatgctgtgtatcttcacgtgggtaacacacttgttcctcacagcccatagggttttgtcattaaactattgagacccatgtgatggtggagtatcaagattgacaggttaatttcccatttatatagaacattatatgaaaattgatttttttaaggcatgggggtggaggatcctgggatgtgtggcgtggtgagagagaagattaagcatttagtgttttcagctacatttaaact

SEQ ID NO: 156700 - DNA, 359 bp, Homo sapiens
gctgagcaggcagggtgcatgagtcaccttaaaagaatgcccccctccacacacacacaccctggatgtgggagaatgggcttccagcgctggagagggctcccccgagtcccccagccgttgaccctgaggtctctcctgctccaccagcccctctcgcttatcttttatccctctcctccctgaacacacacacagacacacacacacacacacacacacacacacacctctcacctctgcctgtaaacccaggggaggagcatccactgtgtgccacagccagctgtgacaatgctgccaagagtgctgaggggccaggggtggcctggtgggagagagggctctccgggtgcagg

SEQ ID NO: 156701 - DNA, 807 bp, Homo sapiens
tggaaacaaagtctcactctgtggcccaggctggagcacaggggcacagtctcggctcactgaaacctctgcctgctaggttcaagtaattctcatgtcccagctacttgagaggctagtacagggagtcgctatgttttaagccagcccattcagttttggtaaagctccatcataacattttccatcatactgacctaatacctagctatattaagctggctcacgccctgccttctgggactacaggcacccaccaccacacctggctaattttttgtatttttagtagagacggggtttcactgtgttagccaggatggcctcgatctcctgacctcgtgatcctcccacctcagcccccaaagtgctgggattacaggcgtgagccactgcgcctggcccatcagggttctttaagtatgatacaaacccactgcatgcacagcgtctgcctgagtccctccacagtgccccctgtatttggacaccaagtagaagtgactgaacatgaaacttaatgctgttaactatcccataaataattaagtcctttgtctcagaccgaggagttttgtatcttcttccagcatctgtaaaaatgtgcaggccaacttgttaacttgtaagttgggtgaaatctcagatctttcacagttcttaaaagcattgtgataaatctccacttgtaaaaatcatttagcatattaaattacagcagtgaacaataagaatgtagtacaatgctttctcaaaaagctaaaaacaaatagatcagctattattgacaagaaagaaactgtcctt

SEQ ID NO: 156702 - DNA, 380 bp, Homo sapiens
caaacagagtcacactttgtacacacctgtgcacacacgtgcacacacagaggccagtagggaggataagaggggcctgaatgtgaccggcgggcctttgttaggggagtcggaggaagacacacatcagagaccatcacctcctggtgtataaggggaacagggattagaagaaacccaggatatctctgtatggagaaaggatggaaaatccacagccatcaggaggggcaggacacggcgctcggtaacgcttgggagagacctgggccctacgtagctgactagcatctcacctgtagcccctccaagggcctctggttgcaactggaagctgaggccgaaaccccttcccactgtccagttacaatcaggcagtc

SEQ ID NO: 156703 - DNA, 721 bp, Homo sapiens
cttgtgcagttaatttgatttaagtttcagcaactgaggcacaatatataccagatatagaagttatcctccaaaattagctcctctaagtttctcctacttttcacatgattcccagatattcttttctttaagtccaagtgatttcccaattatttccatggctatggctacaaaggctttaggccataggaatagaggaatttattcttactaaattcatcttattagatttgattaatcttcccaacttgtcaactgtgggatcttgtttctgtcattctctatgtatttctttattcattgatagcaaaggcactatatatcttaaataccaagaagaatttatatagctttctttttgaaaaattgtttaaagtatctagttcaagatccccaatctaggtgaacttcatggaacatttaattgacatggagataattaggggatgttctgaagagttaccaaagagaactcctaaagagaaactagatggttgagattatttatggaggaagaacagatgaaagtaaaattctgctattaagaatactatctgggtaaagaaatgctttctgctttctttggtggaaatagataagagtgagcagacttatattcattcattgaaattcagataaattcataaccaaagttttattatatatatactgataaggtgaagagttcaacactaatctagtttgaactccatagata

SEQ ID NO: 156704 - DNA, 395 bp, Homo sapiens
tagtaaaacctactctttaaacagttaagacatgatactcatatccttgattttaatttgcatcatgtagaatttgctgagcatctactataggttccattctccaaaatcacagggttcaagagtgttgcagaatgttaaattctgagaacatttttaaaggaaaagtagtgtggtacacctatattgaaacactaaaaggatatgaagtagcaaccctaattgaacaaattactatttcctactacgtaaaattaacaattacaaatactctcacatctgttcactttacgctttgtcaccaaatcagttaaattatgaagatttttcattttcatagcgttcagatttttggaaaagcagttaagtgaacagatgtgagagtctccaagcct

SEQ ID NO: 156705 - DNA, 637 bp, Homo sapiens
tgaggatcccccaaggtccttagcccaaggctgccctgtagcagactaaaatctagttacttgggcatactaacaatttagatggctcttgagcggtttgcttgagcctgctcctgctatgtggagtgtactttcatttcaataaatctgtgcttttggtgcttcaagaaacaaaaaatgaaggctgggtgcatggtggctcacacctgtaatcccagcattttgggaggctgaggcaggcagatcacttgagatcaggagtttgagaccagcctggacaacatggtgaaaccccatctctactaaaaatgcaaaaattagccaggtgtggtggtgggcacctgtaatcctagatatttagagggctgaggcaggagaattgcacgaacccgggaggtggagctggcagtgagctgagattgtgccattgcactccagcctgggtgacagcgagactctgtctcaaaacaaacaaaccagagagattagatttgaacctcagcgtgtccacctccctggaatgtggccagaggaggttaaccaggacagtgacaatactgggcaccaagtgacaaggacccagttacagaagtaggtggagagtgaccagcctgtaaagagaagacggcttgttcct

SEQ ID NO: 156706 - DNA, 443 bp, Homo sapiens
gccactggcaggggtgctgcgtctgcgacgcgaaggcaaaggagcaaaggcagcctcatcgcgggcgctgggacccacatgctgtgggaaaccatttggaagctcaagtaaagaaaggtgaaaagtgaaacatacaatgtagcatagacattacacttcaaacaggtaacaatgaaaacactgaacaggagacagggacaaactaaacacgtaggaagaggtgattaccaagcacagagacccaagtttagaaacgccccagtcctctggcccttgtcttgacaccaccacgcgctgggagaggaaagtgcctaagacaagcacactgcctctgaggaccgtctgtgatgcctcactcatgcacagctctcccaggacgctcgccgggaccagagcacacagacatccgtgcaggtccccacacccagagcagaagtcgcggc

SEQ ID NO: 156707 - DNA, 374 bp, Homo sapiens
tatgttgaacttttaaagccacactcactgccctctccctctcctctgtccttagctcctggcaaccacacttgtgtctctctgttttgataattttgttatttcaagaatgttttataaatggtactagatagtatacaactttttgagattgatttcattttctcaacataattttctgaagagtcatcaaggttgttgcatgtatcaatatactaacatgcatgtattaacagcttattccttttcattgttgagtagtattccatgttttggacatagcaaggcttgtttaaacattcactaatttaaaaatatcttatttgtttcccatttgaggctgttatgaataaagctacaattaagatttgtgt

SEQ ID NO: 156708 - DNA, 612 bp, Homo sapiens
tatttggctagctaattctttgttttagggactttcctgtgcatcacacattgtttagcagcaaacctggtctctttccactagataccttaacacctctgcctacattatgacaaccaaatgtgtctccagacattgccaaacgttctcttaagaacagattcactgcctgttcagaaccagtgatctacacaatagtttttaatatctaccttattttccattatgtgaatacacagtcatttatttaattaactacctgtctatgtctctttagatttttctccagcttttttcattacaactaatatgtatcatcacattcttttatacatcttcgagcacattttataattatttcttttggacagagtctcagaaatggcctttcgtggttaagttcttatgcagagatttgcttacctgtattaatgcccttgattttcacaagtctacaggacaccatgagaatgcactttgccctacagcctcactaatatgtggtacatcatcaaccttttaaatgtgacaactaaatacctgtaaaatgacagtatcttattgtttagaaacatctctttagtaaagttacgtatcttttggcaggtgatg

SEQ ID NO: 156709 - DNA, 547 bp, Homo sapiens
tatttggctagctaattctttgttttagggactttcctgtgcatcacacattgtttagcagcaaacctggtctctttccactagataccttaacacctctgcctacattatgacaaccaaatgtgtctccagacattgccaaacgttctcttaagaacagattcactcagaacctacgggaacaaaccaaactctctcagaacctacgggaacaaaccaaactctctcagaacctacgggaacaaaccaaactctctcagaacctacgggaacaaaccaaactctctcagaacctacgggaacaaaccaaactctctcagaacctacgggaacaaaccaaactctctcagaacctacgggaacaaaccaaactctctcagaacctacgggaacaaaccaaactctctcagaacctacgggaacaaactaaactctctcagaacctacgggaacaaacgaaactccctcagaacctacacacacacacaaatccacacacataaacatagtgcacacacatgcacacatacacaaacagacacaccct

SEQ ID NO: 156710 - DNA, 241 bp, Homo sapiens
aaaaaaaagatgtagacagcaatgagtcagtggcacaaaaagaattgaaaggccttttcttctttaggcttgatgccccatcctaccctgccactcccttagaattactgtggacagccagagcactgcaaaaaagggaaatttgtcatttgccttggggaacaatggctttcaccaatcaagaggcaaaatcaaccacagtctcagagcctggagtaagatggaaaaatcttcctgttgt

SEQ ID NO: 156711 - DNA, 590 bp, Homo sapiens
gggtgtcagaggatcccgggttccttgtctcttccagtattcttatgctaagaaaatatttcttctatttaagatacagtagctgttcccttgtattttctcataggggttcttgttttattttgtttgatatttaactcttaaattcacctgcgttttattttcttatgtattatgagataaggctttaatttgatcttttttttccagaatgaaacaaattgctcaacagcagttattaaacaatcttttcggtttcaaactctaactgcagcccacagctgaaatattttatatcacaacccagcatgcacacactacatttcatcaattctgctgtgaacattttttcatgttttggtatcttaaattaggatgtgtcttataagcaatgatactgaagcactctgggaggctgaggtgggtggattgccgctcaaagtgctggtattacaagcctggccaacaatccctgtgcacagaaaatgcaaattagctgtgtccagttaaatgcaattgacctttgcactagagatagagcagtttttgcaaattcatttcagcattcgtcttccgttttttttttttgg

SEQ ID NO: 156712 - DNA, 87 bp, Homo sapiens
ttcctggctcgggaaagatgcttttgattctgggccagctttgattgcgccctccccttggttcagtgtcccgtggcgccttcaggt

SEQ ID NO: 156713 - DNA, 429 bp, Homo sapiens
ctcccttccctatgtgtctcctgggctgaaacttgcggcgcactgggacagggatggtgctttccttaggcccatttagggaggggactggttcccagcctggcacaggtcctcagctctgccttgattgccttagagtgagatggatcagtcagtgctctgaaggtaaatgtaagagactgtccctgctgtgtgcgaggctggtctagggatggaggacttaacaggtcctcccaatctgtcaggcctggacagcactgtcctgtctcaggacttcctcagatcctgcagagggcacagcctcctagcccaggaggggcagccccttggtggagcctgagctctccatggtcctggagcatcacctgccagccctgtgctccattttttcccaggtcccacatttccagtgtcagccagcagggaggc

SEQ ID NO: 156714 - DNA, 547 bp, Homo sapiens
acacagtgaatgaagcaactttattcctcacatatcggcagcaagggacagtagaagcctgggcttcatggagttcatccaaggctcaggaaagctacctagtgtggaatctcatctgtgtgtggcccatgttgcactgtagctgagggttctggaaaagcagcctgtcctgggctttatccttcatgaatttgagttactgggcttaaagtattgtaggacatcttgttctagaaagaataggaacaggtcccaggctgttctggtcagttcctccttatctcaggaagttaaattttgaaggggacaaataaacaaaccttagcacaaactaataggataattatggtcctcatatagattatttctaggttacttttactaacctggtctaatagagttaattaaaattaatttcattgggtcatttaaacaaaattcaaaatacagtgatgatggaaataggaatttattttggtctgttacctaattttagcatatttgattataaactatgactagaagatgtgtatgatacaaagaagaa

SEQ ID NO: 156715 - DNA, 636 bp, Homo sapiens
aggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatataca

SEQ ID NO: 156716 - DNA, 434 bp, Homo sapiens
cactggggatcactttctgcagcactttgtgggccatggtgacaactctggctttactccagtgagccgtgggaaggtcctgagagaggtgtgacatgagctgacttaacacagctacctgtgtcacccagggggaaagtgaggcacagaaagagtggctgacctatcagaaccacacaactagagagcgagaccacccccaaaaggccccaggtgtgtctggcaccaaggtccatgtgctttccatttctgcaccttgtccctgggagacaccccggtcctgccagaatgtgtcagaggctgagccaacccgtgaggtcaaccctgtagacagctcaaggaaccaggacttggatctggcttttgccctctgctgtccacaaaactgggtgatgctctttccgcaactggtacggcgggtttataggatgcta

SEQ ID NO: 156717 - DNA, 338 bp, Homo sapiens
accccgaattgggtctgcactcgaggcatggataatgcgaatcactactattctaaacccactaacaaactacatagcctatccattcctcatgctttccatatgaggtataatcataaccagctctatctgcttccgtcccccgacagatggacttgtttccttgagtttcctaagtactttatgtaacactcttactccactggaaacacatcgtctaataaactttaagtgtctttatccactctgtcttccccgagcaggctagcttttcctcgagggcagcggctccatcctgctcctctctgggaaagcttccagaacgaggcaagcccaaa

SEQ ID NO: 156718 - DNA, 207 bp, Homo sapiens
  misc_feature (142)..(142): n is a, c, g, or t
  misc_feature (145)..(145): n is a, c, g, or t
  misc_feature (149)..(149): n is a, c, g, or t
  misc_feature (163)..(163): n is a, c, g, or t
  misc_feature (165)..(165): n is a, c, g, or t
  misc_feature (172)..(172): n is a, c, g, or t
  misc_feature (174)..(174): n is a, c, g, or t
  misc_feature (188)..(188): n is a, c, g, or t
tctgtctggttgttcaaaattcctcccttcctacaaaatacttaagttacaaccaaaactgtagttaatataaaaacttgagccaaaaagtgatgggagtcaattctgttgtttttttttttttggataaagaaaaaaaaanttnatcntttttttggggggntnttctgcntngggggaagttgggntttccacatccaccaaagg

SEQ ID NO: 156719 - DNA, 430 bp, Homo sapiens
ttagtagagacggggtttcaccatcctggccaggctggtcttgaactcctgacctcatgatccacctgcctcggccccctaaagggctgggattacaggcatgagccactgcgcccagcataaataaaaaaaatttaaactattatataatttaggattttcaggaatgaaggttgattctttataaaccaaatttgattttgtgaggttttgcagaatttaattttacttggctaaatatgactcattatatggtcacagttttttcagtgattaatttggtaagaaatattttgttttccttcttggcattatcatgagttatggcttcctgtacacattcctgccattttagctgtgtactttttctttgaagctgccatatgttaacaacccaagagagatggtatttactggagagatcatcact

SEQ ID NO: 156720 - DNA, 575 bp, Homo sapiens
gtccctgcacagttggatggcttgatgaagaaacgcaagaaatctaagcttcacagttccccacatagttccccagttcctgaaagcctttcagcttgctcatgagatgaaatccaatgcctagtattgaatgagatagcccaggaatagaatctagaaagatacaaacatcctgtagaaaactgatagcaaatgctcaggcttcaagagaaaagggtccagagccgcactaacatcaaagaattttactgtgaaaacatggcttcttggccgctccacagccagtctatctgaggtgctggtgcgactttaaaacatattttggggctggacatggtggctcgcgcctgtaatcctagcactctgggaggccaaggcaggtggattgcttgagcccaggaattcaagaagagcatgggcaacatggtgagacccagtctctacaaacaaagctcacacctgtaatcccagcactttgggaggctgaggcgggcggatcacaaggtcaggagatggagaccatcctggctaacacggtgaaaccccgtctctactaaaaatacaaaaaattagcc

SEQ ID NO: 156721 - DNA, 406 bp, Homo sapiens
  misc_feature (5)..(5): n is a, c, g, or t
aatgnttgcgttgtgaccaaagtcatcagatggacctgcctgactgtgcgtttgctgggagatgcctgactgtgtgctcgtcagaggctgcctgactgtgcgtttgctgggagatgcctgactgtgtgctcgtcagaggctgcctgactgtgcgtttgctgggagatgcctgactgtgtgctcgtcagaggctgcctgactgtgcgttcgtcgggggctgcctgactgtgcgtttgctgggagatgcctgactgtgtgttcgtcgggggctgcctgactgtgcgtttgctgggagatgcctgactgtgtgttcgtcgagggctgcctgactgtgtgttcgtcgggggctgcctgactgcgtttgctgggagatgcctgactgtgtgttcgtcgagggctgcctgac

SEQ ID NO: 156722 - DNA, 452 bp, Homo sapiens
taaaaaggacagtcctccctgggtctttggacctgcgtccctgaaggctcctgtgtcacctaaaactttgattaaatacgtctgtcatgcttttctcttgtgaacttgtctctcgttataggagtgtcagctgtgaccctttcaatgggtgaggaaacagaccatacctttgtgcgcctacacaaacatgatctcattcacatgataattgtcataatcattattcatgaggatgatgatggtattatggactgaactgtgtctccccgaattcctgtgttggtaaagtcctaaccctcaggacctcagaatgtgactgcatttggatgcagggccttaagagaggtcatcaagttaaaacaagaccgttagggtggatccaatccaatctgcctggtgtccttatgggaagaaatcaggacccggatgcacacagatgacccgtgatgatg

SEQ ID NO: 156723 - DNA, 625 bp, Homo sapiens
aaactcaagagtgggggagaatcctacctttaagccaataatttagaaaatgcattgtatatatagaacaaatttaaaagttgaagggtttatttcagtatgtatagtaaaagtagggcctgaataaagaccatgtaggtgcaccaacagcttcactttttaaagaagcaaagcattgtcatggaaaacaagtagtggagacagtggaagaaccctaattcagaaaatagggtcttattcaacgtagtattggaagttctggccggggcaatcaggcaagaggaagaaataaagggtattcaaataggaagaatggaagtcaaattgtctgtgtttgcagatgacatgattgtatatttatttagaatacccgatcgtctcagccccaaatctccttaagctgataagcagcttcagcaaagtctcaggatacaaaatcaatgtgcaaaaatcacaggcattcctatacaccaataatagacaatcagatagccaaatcatgagagaactcccattcacaattgctacaaagagaataaaacacctaggtatacaacttataagggatgtgaaggacctcttcaaggagaactacaaaccactgctcaaggaagtaagagaggac

SEQ ID NO: 156724 - DNA, 520 bp, Homo sapiens
caatcactggcttcactgttgggtggtatggctgtgtcattttattgagaaatcacttgatacatttccttgttttgttttctgaagctggtcatgcttaccagaggtgtcttactctcctccctaaaggataagaaaaggtggtcagtttctgatcccagtggaaaaagaagttgagggatctcaaaaagtaaactgtttattttcatcactgtgcctattcagtccaacagctcttttctaacttgcttaagagagtacatctccagttttctgccagggttcaggagtcaattgccagcagtatagaggatctggaggtttaactaattgttaagcgactttgaatcgatcttttgacctgtttcatctatgtttctacaggtatttggactgccaattcctaaatctttgcggggagtcagggtgttctgtggtgtaatctgtgatatccacactgctgacagctggcagaatattgtttttttccttccttctttcctttttttttttttttttt

SEQ ID NO: 156725 - DNA, 632 bp, Homo sapiens
ctcatgtctcgaatcgttatggtgactaggataggaagtcccacagatagaggagtcctaatgcaggaagaattctgatactgagaattggtcagctaaacaagaaaaaacatgaagcattttctcagagtagttatctctggtttctccaggaacagtggataagaaacaaatatacatggccatataagcatctatagaaaaataaacattactttcatattgtgtagagattcttcaacagagcttccaggatacttagagggttcaaaaatgggcctgaggagctagggagaatgacgaaaccctatcagttacatgtaaatctatgtgtagatagatgcatgtgtcttcttggtgaagggggtctcaagaattcatcagattatcaaagcaggacaagacgtagaagctatgaaattctaacagttgaaaacctttcttggccatgcagctcctttgattaacatatgttaccagtgaaaagtcactccatgtttgaatacagccatcggctggaactgttactgaaacaccaggggttcggtctaggtccggctgctcgctgcacagaaagccaatcactgagatcacaagcatcgccaaggaaggctttaatcgggtgctgcagt

SEQ ID NO: 156726 - DNA, 439 bp, Homo sapiens
gtaaaactcctaataatgacacagtttgagacttgagagaaaggagcaaagcagtctttcttatcatgtctgccactgcctcaaccaggaaccactgttgtcagttctgtggcaagagtcagggaaactctcgtaaaaatccatttacacataattatgtgagttgaaaaaatagttcggtgaatctattgttatgtagtattcttttttaaaactatatatcttgaatctgttttcatgttagcaaatattgaaatacttgctttcttagttctgtttgcaaacatttcatgcttaataagaatttatattatgctgttcagcatgcttattattaaatattttattctgagatataatgctatgattatttctgatttttaatcttttgatttaactaataaactaaagtggtgttctaattatgaaccattgctgt

SEQ ID NO: 156727 - DNA, 707 bp, Homo sapiens
tttctaccaaattagcaaatactcatgggtactcaatttacccaagtaggttctcagtttctagaatttggtcttccagtgcttactacattgataactctttgaggccttttaagaggatgttttaaactattcagtgttttgagttgtccttattgggcacgttggtcctaatttcttagtgtgccattactagaagtggaagttccccattctgactttgatacaagaagattggttgccctattatgtctgttgctgtttgtttgaggaagatacttttgtgacacctttttctgcccatttccctttttgatactcctttttcctatataagaactatatttatttgatttggaaaggggtaaatataatcatcttatcattcctcctggcagaggtagccgttgaggagtaaggcttttttgatgagtagaacactggtgatttgacagaaaagaataatacttctggccaatattttccattaatttttctgttaccatcttaaaagcatcagagtttaaggagataattttctatttcgacccttccattgaggtcactttttttacgaagtctaatctctgcaattatgacatcacattttattgtagagcaaagcattgtactttcagagggcaaatatcatttaagtgatagaactgatttttcccccaaaataaacacagctcaagaaaaagcag

SEQ ID NO: 156728 - DNA, 199 bp, Homo sapiens
gaagccctcctattccatgtcagtatatcaagatacaacctggcatgaagatggggtgcaggaggggctgtcctttgcctaataggtgctggctaattgggtacattcttcctcctcctccacctggacctagacttactgagagaataaaccacaaggagaggactgggtgcagtggctcatgcctgtaatcccagca

SEQ ID NO: 156729 - DNA, 384 bp, Homo sapiens
cacgccagccttttctaatttatttggagaagaaagtgtcctgcagtatttgccagtctggattttgctgactgcaacccctcttccaaaaatggagtaacttaacatgcctccttttcagtggtatttcctataagttggtagttcaatcttgaggcttcatcaagcatattttataggtgttctgtgtgcttccatcaggaacaacatattatctgctgtttttctgtttgtgatattaatagctattgatgaccattgcctagatccattaattcattgagggactgcaaaatggtgatattccaattctgtcagtctttcttgacatttcagttagactactttcataaaaagaagctctccttcacctctgtttggtaa

SEQ ID NO: 156730 - DNA, 429 bp, Homo sapiens
atttacctggtgtgatgtggattcaggaggccaggatccctggcccaaccagcccgcccaccgtgggggcatttatttgcctgctgacattgccaggcctggccgctgatctgatcgctggtggctgctttccaggtagtcggtctcagtcaatttttccttctcaaactcacctgatcagctgaattacctgggccccccaaccccattgttaaaaatctcatttgcaggccccatccagaccctactgagcgaatcccaaagtgtgtggctgtgggactctggtttgatgaaatgagcacttcatgtggctgaaagggatgggcaggttggacacactgaatccgcagtgcagagggaaggaatgctcacatcccagctcccaaaattacctttgagcccctccacagctggggttggtgtggacaa

SEQ ID NO: 156731 - DNA, 262 bp, Homo sapiens
ctgtggcttccatctggccaccctctcttattcagggaagccagctgccatgttatgagctagaaagacccacatggtatagaaatgatgtctccaaccaacatatagcaaagaatctgaggcctgctaacagccatgtgagtgatctgagaaacagatccttcccagtaatgcctttagatgactgttgccctagccaacaccttgattaacaacagccttatgagagaccttgagccagaggcacccagctaagcttaca

SEQ ID NO: 156732 - DNA, 241 bp, Homo sapiens
ggtgcgtgtgcggtggggtggcttcaatggggaggaggtgacatctgagcaaggaccagagggaggagaggtcctgagttgtcagcacggggctggctgaggaccactgcagagggcagtgggggcatgaacagtaggagggcaggggaacagggcctgagtgcactggcgcttactcacgggaagccactagagggtggttcccccatttttcttttcttttttttttttgagatggatt

SEQ ID NO: 156733 - DNA, 513 bp, Homo sapiens
tctgcctagagtgcaaggaaagtcctcagcagcctcagggccatgtcataatcagagactcatcatgtttaaatgactcaagcctttctcagtgtgagatgaccacatgcatctcattttcccctcacaaaagcccagggaagccagttgtactgctccagtcccaggctctgagaggtttagctcttctctccaaagtcctgagatggagggcaggagggaaggcatcccaggcagggttacaggtaagcaaaggcagagaaggaagatgttcacatggtatattttgaagacagcaattggcccagttggctgaagagagactcctcatgttggcaggcaaaaggaattaagaataatatgactgaagtttacggagctcatagtgtgcaagatgcaagctgaccaatcctgtgcttacttcctgtacaatccttccatgcacaccccatcctcatttcccagtctattctgctcagagcaaccaggtagctccacatacaatgggaaaca

SEQ ID NO: 156734 - DNA, 341 bp, Homo sapiens
cagctgacacgccaggcgatggcacgatttcctccaggaacgtttctctgtaatgtgactgattacaatatagctggctgcaggagaagccgcggcgctccagccggctgagggtgagccaacacaacccagagataatgaataatggtttgtggcaaaactgataatgcgcccactattatattgactggggctgcggcttcagttaatcgtgctaaattgctaggctggagctgtgttccgccgggcttggccgctgccttcctcttttgaaaatttccatttgtctgaagttgggttcttgtcttttcctcctgcccttctattcaaatgagctggct

SEQ ID NO: 156735 - DNA, 384 bp, Homo sapiens
ataagtgaagggtgagacagaaaacaaaatgctggctgtttgtcaaatcctgaaagtaggggggctgaaatcatttttgaaggaggatgtcattcaggagaccttgtacatcttagagtgtcctcttaccagatgaagtggaggatgaggttgaattagggagttaggtgacagtgggcacatacttctctgcctcagttttttttttaaatctgtaaaaatggggatgataacactcaggattttttggtgaggactgtagttacctggaaagcccttaggatagtgcccggtgcatagtgagtgctgcatcagtgtgagctattataattatgggaataggcaaaggtgccaccctggccatccagagtggagaggtatttt

SEQ ID NO: 156736 - DNA, 211 bp, Homo sapiens
tcctaagtagtaggaatagtcaatgcattgtttatgaaaaatgacaagccaggaaaaaggagaggaaagaacaatgagtttccagctccactattaacttcttgctagacaagacagactgcagttacctcatctataaagaaaaaaatttaacaattcttacctacctcataagaatattgagagaattatatgagttaatatatatgta

SEQ ID NO: 156737 - DNA, 454 bp, Homo sapiens
ccagtgatgaaactggcacagaggttagatgaccttatcaggggtgatggctgagataacaggcaaggccactccagagcttgtactgttgtgtactaagttatactgcccttatttgagtactttgtagatgattggagagcatcggtaagtaccacatacctcatgtttatgcctgcttttaggtctttcaccaagaaagcaaaattattttctggaaagagccaaggacttgttttctaatcctgtctctgccactacctggtgaactgacctggggcaagtaatttcatctgtgggccttctgttttttaatttctaaaatgaagaggttgggctggatgaccgcttgatttggctaatttattttccaagttctttaactgtatactaaagctgcatattaaatattcacagtatacactcatgttaggctcagggaagtcctatagta

SEQ ID NO: 156738 - DNA, 970 bp, Homo sapiens
gattttagttgtacttaggaagaataagaaaaagtatctcttcccataagtggaagtcccctatatgggaaatttttaaatcagtcctctgcttaaaagccacagcctctgcaccaaccctacacttgctcaatcctgaaaatgagtgtttccttacattttgtaccctgggcccttcgcatgtgttatccagcccatatctcaacataacatctttccagcctcatctccctctccattatcccacaccccatgtattttcatgcctgtgacctggttagatggccctccctgtccctcgcctcctctatctgctgaaacaccaatcctgcaagacttcaataaaatgccatgtccttataaaaccttcactgatttccacctctctccctcccgtgttaattgctcctctccctatgtatccatgccctttgtttgtgcctatatggaaatttgaattgttgactaggtgtagtggttcatgcctgtaatcccagcactttggaagggtagggcaagaggattggattgagctcaggagtttgagatcagccttggcaatatggtgagaccccatctctacaaaaaattttaaaaatgaaagtgaaaataaattagccaggtgtggtagcagatgtctgtagtccctacttgggttcagagggatataaccctaaataagcttagtcatcattaaggagctaggccctgtggaccctccccatgggggtgactacttcatctctcggtttccctctatttctgtggttacctgattgctgtttgatagtctgtgggcttgtgcatttaaagtttgctttttcaaggtgtctgtgagctctgtgggggcaggagctctgcaaccctaggtatcagagaacctagaacctattaggtgctggcacatgttatgatcaatgactgaaatctgaattttgtcagtctggtactcactttttctgactgagcc

SEQ ID NO: 156739 - DNA, 693 bp, Homo sapiens
taatgggaccaagagtcaccttaggaattatgcagcacagagatgcctgatataaagaggccaatatagaatgcataatagggccaagcccctaagactctcccagaaatcagtttctagattctacagatgatgctttccatctgctttacagttgccaaagcaaatcacgtttattctaaaaacagataagggcttgctcacaccaatcaaaagcaggtttttatctactattagtaggctgcctcttcagcagagactatcgtgttccccagccaggctaactggcattaaaccacttataagtacccactaacaagctaggtaccctggggaaactggacacaaacaaagcatgggccctgttccttagcatcttgcaatgtggatggcgagaaaagatgcacatatttggagatgacttgagatggcagtgcagtcacactggcaggaaagccaggcttgtgacgcaggtctgtgagtgccggaagcactgggcagagtcagccagcgccctgcaaatccaaccaacagaacaaaactagccagcagaggcttaagaggctgagaagctgagctgtttgtcttaggttggtagcccagggtgaatacagctatctctggccaggcatgtagcacagcacagagttgatgagatctagtccaagagctactctgcttgggttcaattcc

SEQ ID NO: 156740 - DNA, 290 bp, Homo sapiens
caccccttcttctttccctgttgcatccagccggttactttcccttgccctgcccaaatgcccacttcgaggccctcttcttcttttcctaggctggctgaaaactaagttttcaaaatacaaaatgaaaagtaagatttgattgctgtagaggaaatgtccaacagctcttgtatttaaacttaagtagccccattgggactcccaatttcatatcttgagttctagaggtgctcctgccgtatagttctgaaactttctgcacaaattcagtggatcctgtgtttttt

SEQ ID NO: 156741 - DNA, 211 bp, Homo sapiens
cttttcatatgactctcatcctcatgatcacaagaaggttgctccctctctgtcctcacatctgtattccaggaaaagcaaggagaaagatgaggaaatggtctgaggactcctcaacccatgtttccttgcccagagctctgtcacatagacatctttagctctgagattggcaagatacatacattgccacactcccaataaagttggg

SEQ ID NO: 156742 - DNA, 181 bp, Homo sapiens
tgctgggattacaggcatgagccaccacgcctggtcaatcttcctcttcttatgaggttataaggtaaccaatcctatcggattaggaccctaccctatgacctcttttaaccttaatgattatcacctaaaagccgaatctacaaatgcagtcacattggggattacaacttcaacatag

SEQ ID NO: 156743 - DNA, 369 bp, Homo sapiens
gttaaggcactgtatgtactaagagaataaaaaatgtattgctctattccttcgaggagcctataattgaatggggaatatagatatatcaaactatacattgtaattttatgataggattattaagcattatgggagcaaaggagagagtagttaattctgatggatcattgaattggcctttgaggaataagagttttctaggaattgaagaggggagaaagtcatctcctttctttccctccccattcttctttaaggtactgaaaaatcagattcaggacagtgtttattaagacagatatatttgtgggcaaataaagagtaaattggaatgagagattaattaggctactacagttgtttaaa

SEQ ID NO: 156744 - DNA, 234 bp, Homo sapiens
  misc_feature (187)..(187): n is a, c, g, or t
cctaggggatccttattaaaaatgcacattggccaggtgtagtggctcacgtctataatcccagttctttgggcagctgaggctgaaggattgcttgagctcaggattttgagaccagcctgggcgatacagcaagattccattgcaaaaaagaaaaaaagaaaaagatttttaatacaggatcccnctagggggtatcctactaagagtcgacgctgcacgtgcatgcgatgc

SEQ ID NO: 156745 - DNA, 144 bp, Homo sapiens
cctgggcgacagagcgagactccgtctcaaaaaaaaaaaagttttatcggaacacagccatgctcattcctgtatgtactgtcagtggctgctttcacgtgactgaagcggaactgacagtgtaacatgcaaaacaggtaagaa

SEQ ID NO: 156746 - DNA, 243 bp, Homo sapiens
ttttgggattacaggcatgagccaccatgctcagccattgaagtcattcttgtacatcctcattgtcatcatccctatctattaatctacaaacactgttaatatcacttttacattatccatgaactctgttgctgtctcagtatttccactgccattgtctttgttcaggctgttctaatcccttgctgaaaatagtgtcctaagatcttccttcaacacccctcccctgtttttttacag

SEQ ID NO: 156747 - DNA, 443 bp, Homo sapiens
tgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgttt

SEQ ID NO: 156748 - DNA, 184 bp, Homo sapiens
aaatgttagctgctgttgtctgtatacctacagatatttgcatgcaggattctatcatctatatttttcttaaaggattgctgggaatctgaaaagcatttttgaggaagatgtccagtgaaatggatggtgaaaggatgttgaatatagttcataaatcattggcactcaataatttccagaa

SEQ ID NO: 156749 - DNA, 423 bp, Homo sapiens
tcactcagagtgacactactttgtggggagattctcacgcccttccacaatgccagggcaacgggatcccgtagcccagcccccttctctagctggtgctttttcatcattcagatctgggtcttggtttgaattttcagtcctcctgagctggcagttgtgttttagagaaccacagcatctcattttcatcagcacatccgagtgatgtgaaggtctcagaaaagctgccaggcccccagcctaaccttcaaaagcaacaactctgaggcaggcagggttgagggaaggtctttattccagacagagacagcagggtccttctccattagggcttgatctccccaggagggaccccgctcctaaccaccagctgcttgcacactcccaccaccgcacctgccccttcctctcctgccctct

SEQ ID NO: 156750 - DNA, 560 bp, Homo sapiens
tagtgatttagcagttaatagctatgtctggtagaaggtaggctatagcaagagcttgtggcaactttgcttctaactgatgtagttgcagcttattgctccactgcaggcagcgttgaatttcagcatggaaagcacgttcttgaggcctctttgcttttcctcagtcaaggctgtatccagggttgatatctagcctatatgccatatgtgtatggctagtgtttgttctgattggttggtgctcacactgcccagattgttaaatattttgaaaatcgtatctggttctattcatctgcattctctgatcttatgtctggctctatttatccctattctctgatcttatgtcagacctgaagttcctctaatttttctgtggtgtatttatagggaaaaattgcctttttttcttctaatgctcttaagcaacttcatataaaaaagttcctggaaacattaaatttttcttttactattacaggccattatacagtattttaagtctacttagtgatctaaaaggtttcaaacatttatgaataaactaaagaaat

SEQ ID NO: 156751 - DNA, 250 bp, Homo sapiens
ggacatgtcataatttaaattatgtcttagtctataatgatgtatttgaacatgagtatatcttaaaggaaaacgccaagagtttttgtctgatagagggctttaaaatactggctttaaaaaataaataaaaaattaaacatgggcttttaataaaatgaatcaacttaaaaattatctggctgggtgtggtggtgtaggtcaataatcccaaaacttgggaggctgaggcagcagaatcactcggcca

SEQ ID NO: 156752 - DNA, 430 bp, Homo sapiens
ctatataaagacaaccaaaatgttaacaaccaaatatcaattcgtggtggatattttgaaagaaaagcattgatatttaaaatgttattttgatattggaatataaattaaaaagatgagaaatatttgtaaaccatttcagattaatttattatttattcttattttcaagaatcccataccaatagcaatatataattacatgttctttttgtttgatttgccacactttgtcaaatagtaacttaaaatagcagacagttatttaaaaacacgtttaacagatggaaagatcacctaggcgtgcaagaagtcatcaatatgtgattcatcagtttgccttcagattattttcttacactgagagatttaaataatttccaaaccactgaaaaataggcagaggcagcaattttggaaaagcatgaat

SEQ ID NO: 156753 - DNA, 865 bp, Homo sapiens
tgtggcccccttcatgtgaggtcccacaccagacaccacagaccgatgggaaagatgctagaatggtgggcactttgtagggcatgtctggggcatgggagacactgtccatctccatctggatggtagttacacgggtagagggctattgccgtggactttcattatgtgtctccccaaatcccagtgttgaaaccctcacccacaatgtgactgtacttggagacagggccttgatgaaactaattaaggttaaacgaggtcaacaggtgaagtcctgacccaataggattgatgtcctcatctctcaccaccatgtaagatagtggccgttggtgagccaggaagagagctcccactggagcccgatgctgccaccccttgatctgccacaccttgatctgccaccccttggtccaggggacttctagcctccagaatggtgagacataaaagtctgatgtgtaagctgcccaggctgtggcctctgttgttgcagccccaacagactaatgcatgtgagactgtgtcgcactgtatacttcagatgagtatattttaccatatggaggttattccttcttttaaggaagcagggggcagctacagaaggaaataatttcatttctgataggaccttctagtgtctattttttatagagtcaagtcaaatgattcctcattcaccacctgccactgggccaggaattccaccaccttggaccagtctgctgctcttgcatggtgcctgcgtccctcccaggcaatgacacacccgctgcgctcatccatgtgggctgctgagccgcgccacgccaccgcaggcacaccagatggttttgagagggcttctatttttcctccc

SEQ ID NO: 156754 - DNA, 247 bp, Homo sapiens
atgagccgagattgtgccactgcactccagcctgggcaacagagggagactctgtcttaaaaaaaaaaaaaatgaggattttgagatgggggatcatactggatcatctgggtggtaccaatgtaatcacaggggtccttataagtgaaagaggaaggcaggagaaaagagttgtaaaaggagatgtgactgtggaagcaggggttggagtgataagaccactggttggaagggggaccttgagcca

SEQ ID NO: 156755 - DNA, 273 bp, Homo sapiens
gtataaacatttattggaaaggaaaaaacatttttgttggaaagtttggtaattattgtggcttaggatatgttctattttgaaagattgctatatccagtatatttctgcccttttatgattgaagatgtacgtctgaaaatacctatgttagttctagccggttgttctttttgcgctgggaagtctttgaattttgcactgtagctgctattttcagatcctgtctctgaaactttgtctctcagttttagcttgaagtagccatttcct

SEQ ID NO: 156756 - DNA, 617 bp, Homo sapiens
gcaattaatcatgtaaataaaaccaaaagtatgccatagcataaaaggagtctttaagaaaggctaagaaaatatgacagagcacaagatgtctgatttatattgttgaggtgttccctagagtctccgttacttctttgttttgttttgtttcctactgaatttcatgcccagtgaactttttgtaagtttctatcgcctctacttctgtttacttcctacagatcctttttattttctgttgcttttaaaaattacaaattaatcggaagaatagaatcaccaacatcagaaagaattggagattggaagacacttgagtctggaggaaagagaaagactttaagactcactgcttaggagcaatctttaaactagtttatttatttattcataaagttgtatacatttatggggtacaagtgcaatgttattacttagctattttgagtagtggtaaagtccagcttttcactatatccatcactcaaataatgtatgttacacttaccaggcaatttctcatcatccaccctcttcctcccttctcactcttccaagtcttcaatatctttcattctacactcattccacatgtctttcaaagtcacgatgat

SEQ ID NO: 156757 - DNA, 462 bp, Homo sapiens
aaatgaccaaccagaagacacatgactccagagcccaaacagaggtacacaaatggatattcattaaaaccatgggtgacagtgcagatccggggtggtaagaaggacagatgaagctgggagagttgattatccctatgggcaaagagaaaattggaccccaacttcacaccatgaaaaaaaaagaatcacctcctggtggctaaatggggaagacaaaacttcaaaattatttagaagaaattaaggagaaagatctttatggcttcaacatggtgaatttcttaaaacacaaaagttttccaactttaaagacaaatactgataagcttcactacattaacattaagaacttctttttatcaaaaaggccccataaagagagtgaaaaaataagccacacactggaagataaatttgcaattttggaactgacaaagaatttctccaaaaagctgaaaa

SEQ ID NO: 156758 - DNA, 2687 bp, Homo sapiens
ccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagt

SEQ ID NO: 156759 - DNA, 1625 bp, Homo sapiens
tccggaagacagatgaatacctggagaaggccctggagtacctgcgccagatattccggctcagcgaagcgcagcttaggcagttcacactcgccttgggcatcacccaggatgagaatggaaaacagcagctccccgactgcgtcgtgggtgagaacggactcatccttacgcccctggggcggtaccagttcgcaggacagatggcggctctgtgttcccgggatgacttcctcggcagcttctgtcgctaccacctcacagaacctgggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaagactgggccgtagaattccatgtttcaggagcctaagaccctcccagagcccaggtgcttcaccgcagaccgcaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttttattttgatgtaaactgagaataatggcattttagggcctgtgaccaaaaatgaagcttgtaacgaccatggatctgaataaacatgtccttgcttctga

SEQ ID NO: 156760 - DNA, 1820 bp, Homo sapiens
tccggaagacagatgaatacctggagaaggccctggagtacctgcgccagatattccggctcagcgaagcgcagcttaggcagttcacactcgccttgggcatcacccaggatgagaatggaaaacagcagctccccgactgcgtcgtgggtgagaacggactcatccttacgcccctggggcggtaccagttcgcaggacagatggcggctctgtgttcccgggatgacttcctcggcagcttctgtcgctaccacctcacagaacctgggctggccagcaggcacctgctgagtcctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaagactgggccgtagaattccatgtttcaggagcctaagaccctcccagagcccaggtgcttcaccgcagaccgcaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttttattttgatgtaaactgagaataatggcattttagggcctgtgaccaaaaatgaagcttgtaacgaccatggatctgaataaacatgtccttgcttctgaaaaaaaaaaaaaaaaaaaaaaaaaaaaaaaaaaaaaaggggggggggtaaaaattccccgcggagggggcgcaagtttaggcgtatacccggctttttgttgtccaagggggccccaagtaggggaggcgtataaaaagcctaggacaaggg

SEQ ID NO: 156761 - DNA, 1453 bp, Homo sapiens
tccggaagacagatgaatacctggagaaggccctggagtacctgcgccagatattccggctcagcgaagcgcagcttaggcagttcacactcgccttgggcatcacccaggatgagaatggaaaacagcagctccccgactgcgtcgtgggtgagaacggactcatccttacgcccctggggcggtaccagttcgcaggacagatggcggctctgtgttcccgggatgacttcctcggcagcttctgtcgctaccacctcacagaacctgggctggccagcaggcacctgctgagtcctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttttattttgatgtaaactgagaataatggcattttagggcctgtgaccaaaaatgaagcttgtaacgaccatggatctgaataaacatgtccttgcttctga

SEQ ID NO: 156762 - DNA, 444 bp, Homo sapiens
ttcgatctagaggatcccggcatgtagtgaggaccgtgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttttattttgatgtaaactgagaataatggcattttagggcctgtgaccaaaaatgaagcttgtaacgaccatggatctgaataaacatgtccttgcttctga

SEQ ID NO: 156763 - DNA, 1668 bp, Homo sapiens
tccggaagacagatgaatacctggagaaggccctggagtacctgcgccagatattccggctcagcgaagcgcagcttaggcagttcacactcgccttgggcatcacccaggatgagaatggaaaacagcagctccccgactgcgtcgtgggtgagaacggactcatccttacgcccctggggcggtaccagttcgcaggacagatggcggctctgtgttcccgggatgacttcctcggcagcttctgtcgctaccacctcacagaacctgggctggccagcaggcacctgctgagtcctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaagactgggccgtagaattccatgtttcaggagcctaagaccctcccagagcccaggtgcttcaccgcagaccgcaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttttattttgatgtaaactgagaataatggcattttagggcctgtgaccaaaaatgaagcttgtaacgaccatggatctgaataaacatgtccttgcttctga

SEQ ID NO: 156764 - DNA, 2151 bp, Homo sapiens
tccggaagacagatgaatacctggagaaggccctggagtacctgcgccagatattccggctcagcgaagcgcagcttaggcagttcacactcgccttgggcatcacccaggatgagaatggaaaacagcagctccccgactgcgtcgtgggtgagaacggactcatccttacgcccctggggcggtaccagttcgcaggacagatggcggctctgtgttcccgggatgacttcctcggcagcttctgtcgctaccacctcacagaacctgggctggccagcaggcacctgctgagtcctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaagactgggccgtagaattccatgtttcaggagcctaagaccctcccagagcccaggtgcttcaccgcagaccgcaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttttattttgatgtaaactgagaataatggcattttagggcctgtgaccaaaaatgaagcttgtaacgaccatggatctgaataaacatgtccttgcttctgaaaaaaaaaaaaaaaaaaaaaaaaaaaaaaaaaaaaaaaaaccttctcggagcggcttttttcgcgcggggcgcgcgcgagaaacaagagcggttcatagagaagggcggccaattgggccatacgtgtgtttcctttagccccatttttcttttcacaacggcggggagaaatctccgcgcggggctcccccctataaaggagaggagcgaggatatatatatttctgcgagaataaccgcacggggtaaccccgctccttttaatatcctcctcccccacaaaaaacactgttcttcaataatcaatgatgtcaaacacaacgacgacgaacgaaagtcagaaagatacaaacattacatggcggggttcctccaacaatattcatttttatactacaacaacaaatctctgttcttactatatcaatcaattatttactcacagtatgtttacactattttctattatcttcaattttttt

SEQ ID NO: 156765 - DNA, 996 bp, Homo sapiens
agaagagaagggagtcagaccctctgagcaaaggggaagttgctgcgctctgctcggtgtcgtggcctcgcagatgattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacataaagaggaactgatgcacggggaggaggctgatgctgtgtacgagtccatggcccacctttccacagacctgcttatgaaatgctcgctcaaccccggctgtgacgaggatctctatgagtccatggctgcctttg

SEQ ID NO: 156766 - DNA, 1167 bp, Homo sapiens
ctcagcacccgctgtgtcgtggtgctgctgtccgcggagctggtgcagcacttccacaagcccgccttgctgcccctgctgcagagagctttccatcctccgcaccgcgtggtcaggctgctctgcggcgtgcgggacagcgaggagttcctagacttctttccagattgggcccattggcaggagctcacctgtgacgatgagccagagacctacgtggcagctgtgaaaaaagccatttccgaagattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacataaagaggaactgatgcacggggaggaggctgatgctgtgtacgagtccatggcccacctttccacagacctgcttatgaaatgctcgctcaaccccggctgtgacgaggatctctatgagtccatggctgcctttg

SEQ ID NO: 156767 - DNA, 192 bp, Homo sapiens
tggcatctgacccctgagtcctcctttctgctcaggatgagagtgtgacagtagagacagcacatgagaaaaaaaaaacgtgtaggcctcgcaaatctcagcttaaataatgggactaatatttccccgctaacctgctaaacactgaaagcggaagttcctaagcatttggcaacccacgccctttggaga

SEQ ID NO: 156768 - DNA, 480 bp, Homo sapiens
cttccaagttcaagcgattctcctgcctcagcctcccaagtagctgggattacagatgcctgccaccacgcctggctaatttttgtatttttagtacagacggggtttcaccatgttggccaggctggtctcgaactcctgatctcaggtgatccacccaccttggtctcccaaagtgttgggattacaggtgtgagcccctgcgcccagccaaacccaaccctttctgttcatttgggcccttccccttggtgagggagggtctcccctttagttgttggccaggaggactgcagtggagcaggggaaggaagggctggcaggaggacaggaggaggggagtgctccctcccaccttgtctgctatctcccatcctcccacctgggagggcaccggctgctgcccacagctgaggctctttgcatggggatgccccgacctcgtcactattcttcctgggttgggtggggatcccctgc

SEQ ID NO: 156769 - DNA, 283 bp, Homo sapiens
aacttcatcatcatcttacctttgttacaaacaaggagagattctctagttttccaaggtctgtccctatttccttttgcaaagactgagttccttcgggcatccctttctctcatcctctactggatcatttctacctacattcaaatgtgcatcctcccttgacctacttcagctgcacactccctccaacacacccctctactctccttcctactcgaattgctgtgtctgtggcttcccctttccaacctccccttctttactttaaacctgtgcttgg

SEQ ID NO: 156770 - DNA, 483 bp, Homo sapiens
acctttaaggtcatcctaaaaaagaaaagcccagccagaatggactgttctggaaagcacggcgctgaagaatgaaatgcaagtgcacagccacagcccagagacctgggaaggctaattacaatagcttccaggtggtgagcgactgctctgcaccaggtacacctcattgatcctcacaacaatcccatgaggtgggtattactgctcccctgttataagtgaggacactgaggcttagcaagattaagcaacttgcccaaggtcttacagttagtaagtaataaagctggatttggttgagcccaatctctctggctcaaggctatgctttaaccacccacgccatcttgccttagatggtttgatcagccaccctgctaattctacaaccccctaaccccagcctagcttctttcccacactcaggaataccgagtaggatgattacagactcctcatagaatcttacgagctacacaa

SEQ ID NO: 156771 - DNA, 283 bp, Homo sapiens
atacttttgcacagaaattaggtctgctctaggataatagtgcagtgattcagttccttctcaagtgttcagacttaataatattacctaggacagtatatgtatcttttcaatggatagaccaatgggtgtatttaagagaattttataggtcaatgaacgtacataagagaatacaacagacttacttattttttatataaatttaaggcctgggaacttcaagtacttaaaattcaaagctctgtccctagtgttttggaatttctctttactacctaaa

SEQ ID NO: 156772 - DNA, 525 bp, Homo sapiens
ttactgcaaggagggtaggcagggcaggtcctctaggtcttcctttcagtataacagttacacaacagaaagcgtctttgctttttttattcttggagaaaaagctttgcagctttagctgactcagttacttcttttcatttagatgtgatccctttaaaataatccgctggcaaccaggttgatggatgaacttcaaagaaggacatagtgatgaaaagatcgatagcttttaagactgctctaaagaaccagatagctgtatttaagatataattggaatttccctttaagagaaagaacaggttaaacttgagaagaaaaaagacaagccatatataacagtactgctgacatttagtctttgcaactgtaaatatacaagaacctcaaagatcactatctgtcctgtatttgaaggcgcttgttgtgatgtgcagaatactgttggcccttaaatgagaaaacatgagatgacatgggaaaacacaggatgacatgttaagacatccaaaaaccagaatg

SEQ ID NO: 156773 - DNA, 450 bp, Homo sapiens
cactagataaacccgtgtcagtttagtttaaagctgtatctgttacttcagcgtttatattcaaatgtgaatcccagacatctggattcagtgcttgtgttgacatttttagctatttgatttgtggtaattttcctagtatgtgtgatgcacttgtgtccaagtacagatctttcttcatgggacagtatgttattttatggcttaagacatgggaagcacttagaacagtgtatagcacatgggaagcattcaaaaatgttagtcatggctattgctgtcatcataacagttttttttttttttttggagacagagtattgctttgtcacccaggctgaagtgcagtggcatgatattgggtcattgcaacctctgcctcctgatttcaagcaattctccagcctcagcctcccaagtatcagggattacaggcacccaccaccacac

SEQ ID NO: 156774 - DNA, 663 bp, Homo sapiens
taaggaaatactaataattaccatatcagatactaatgtctctacaaatcctgtgaaaaacaaatctggcatctattcttacccctcctttcaattttctctctaagtttacaaattatctcttctgctttaattcaattgtcttttcattgtagtcactgtttctgaacttctacaccgcatttgaaactgtcaacaccctgcccttgtagaaaatcttcctatcctggaaatgatgcactttctggttcttctcagaatgctattagcctatttcaagacccaaaattccaaacctcaaagctctttcttcattatactactaccctcccaacacacatctactgatgtgttttactagcatctatatccctggtcagtgcaaaatctacctttcatctaaccgttcattgtatatgggaataattacatgcataaggttaagcaacttgcccaaagtcccttctgattttaataccttattatgaagatttaatgaattaaacaaacgtaggcgcttagaatacctgtcatacagtaagtaaatgttagctattattttattcctacaaccactatcttatatcagaccctcatcagcttattcctaaaattctccataagcactctaatcagtctctccactcccaggacactcagctg

SEQ ID NO: 156775 - DNA, 476 bp, Homo sapiens
gctcggtaccctgtctcagtttcgggacgcatggcgtgccttccactctgcccctggatttctttttacagccctggctcttgtgggccacaacagttcttgaggtaggctgctagggttccccattggagcctctccattccagtgttccagggggcagatgagctcctatccccactggcctgtcttgctggtgttcagggccctggcttccactttgcgaggtcacctttcaggattcatgtgtatccactttgctgtgtcagaaactccctactgctgacctccctctcctctttgctgtcattaatggattctcattgtgggagataaacgtgtgctcagcctagaataccacatgattttttttttcttgattcattgcttttgcctgttagccttgttgttctaaagtagttcatttttctactctacttttcctttcccctcaatgacccccaccccaaaactgtgcc

SEQ ID NO: 156776 - DNA, 578 bp, Homo sapiens
agtttgctcctcatatttcatcagttgctcaaaggtactccccattttagcttgtgttctgtttggatcctgactttctcatggtggtttttctggacttttattagctttctttttcatcctgggtattacatggcgtgccttccactctgcccctggatttctttttacagccctggctcttgtgggccacaacagttcttgaggtaggctgctagggttccccattggagcctctccattccagtgttccagggggcagatgagctcctatccccactggcctgtcttgctggtgttcagggccctggcttccactttgcgaggtcacctttcaggattcatgtgtatccactttgctgtgtcagaaactccctactgctgacctccctctcctctttgctgtcattaatggattctcattgtgggagataaacgtgtgctcagcctagaataccacatgattttttttttcttgattcattgcttttgcctgttagccttgttgttctaaagtagttcatttttctactctacttttcctttcccctcaatgacccccaccccaaaactgtgcc

SEQ ID NO: 156777 - DNA, 154 bp, Homo sapiens
ccccatttccagttactttcttagcatcaggaggctgtaatctagggagggtgacattacagttagagtaaagtggaataagttctgtgccagaactatgctcagagcattgtgagattatacgaggcgggcacataacctgtgcctgtaagga

SEQ ID NO: 156778 - DNA, 237 bp, Homo sapiens
gagttaggatactgaaggtgctagaaagagaatatagttatgtgccacaaatagaaggctgaatcggccagaatcaggaaagaaagtgatagagaactgaacaggaagagactggaaagtctagagaatacaaaattgagaatgaaatgtggctgttgtcaaagaataacatgtatgcttaggggttcaaaggtggagcagggatgagtgatgacaaatgtgaacagacttgtggat

SEQ ID NO: 156779 - DNA, 152 bp, Homo sapiens
ttatttagttttatttttgctattctagagtggggctataggcaggggttattcgtagctcagaaagtgggggaccatacagggatgaggtgcctgtgggcccctggccttgctgaacactaggcaggtgtggacagtgaactccatgctgg

SEQ ID NO: 156780 - DNA, 404 bp, Homo sapiens
ctaaaaactactacttccagcctaattacaaaaaaacaacagacttggattgggagaacactactggcatggtctgtcaagacagtcaaagtcatgaaaaacaaagaaaagcagaaaaaactgtcacagaacagaagagactggaagataagacaaatgtatacaatgtggtacccctaactggatgcatcttggaacagaaatatgagctatatggaaaaactggtgaaatcccaatggagagtctcatgtcagtttcctagttttgacaaacatactttatgtaagatgttaacaatggtggaaagtgggagagatgtatacaggaaatctctgtattatctttgtaaatctgtaaattttgtaaatctaaaattattctaaagttaaaaagttattttaaa

SEQ ID NO: 156781 - DNA, 469 bp, Homo sapiens
cagttcatgtaccctgctcaacaaatacagcatttgaataagcaattgagtacaatgctggaggactttatggaatatagaatggataattaggcagtcaatgttttctgaaatagtataaaataagaaaaaaggagcaaaatgcccatttgaaaggatgggctaggaaatgaaaattccaggctctagttagtctatcatgtaagaatgaagatctgcctcagaaatgtgagactatagggaagtttcttctgtctgacttgactcatttcaagtacaaggtccctgtgaacagctttgcgcctttgaacttgtaaactttaagctattaaactttgatgttttagtttataactattagaggagcattccgaacctggaattaaaatgaaattttattctcatagttgctatggcttttagttttgctttcggttgtaacattttccattgtcatatacaaaaactt

SEQ ID NO: 156782 - DNA, 668 bp, Homo sapiens
gaggctgaagtcatacattcattatttgttaatcccaccctaagtgataggtgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaaaaaaacacatttgtttgggcgcgcgcagttgaggcccctgagaagaaaggtttttaaaaaacccttgtgttggggagccggggggcccaaaatgtactaacgtagccactgggcaaaaagaagggggccacagaggaagctcggggccaaagacactgcggtgtgggttcctccacaaataaaacacgccgggcggacacagcgggttcttagaccactccagggagggtcgagggccgagggatcacaaaaggagacaagcggacgaataaatagcggtcagg

SEQ ID NO: 156783 - DNA, 550 bp, Homo sapiens
cagcagccatcatcattgaggcaagatgatcattagcattttttgcattgaagtatttttaaattaagatatatatattttagacataatgctattacacacttaatagactacagtatagtgtaaacataacttttatatgcactgggaaaccaaaacatccatgtaactcactttattgccctattgacttcattgtggtggtctggaactgaaccagcaatgtctctggggtgtgcctgcactttcataatttaaaaatatttgtatattattagttagaatgcacaatttgactcggattactggtcctatgtatttctcttctatgctgcctattctgatccattaactgttttcctattagattttcaaatttgtgttactgttttccaagagtcctctgtatgttagaggttagtatgaggtgaatattgcaaatattctccccacttgcaaataatttcatacaaaagaaaagttccaaacagatgctggccaagaacatgtgctttggaatgaggtgaggtcaggttcgaatcctagcttc

SEQ ID NO: 156784 - DNA, 197 bp, Homo sapiens
ctggagttcctggtttagttcactgtctttacttgtatattcatgagataataaactcagcaggttaatttacttgcccgaagtatttacaatgattcagtagcagaacaaagaggtaatccacttgtaacacccaggtcgaggtctccgtgtatctggtcactctgctgagggtggagtggttaacagagctgcct

SEQ ID NO: 156785 - DNA, 357 bp, Homo sapiens
aaggcaccattgttgctgcactgcattgttggttgcaaggtagttactaaggttgggccaggttgcataggacaggacaggacacagatccccacctttccatgggaggaatgtccaaaaatgtgaagtcatgttttaaaaccgccacattgtaattcacttattataattataatgaaattatctttcttcttccctgtacactaaataccccccacccaccccccgacacacacgcacaagaaaacttctgaaattacattaccctgtaaaaatcctgactgaaatgtaaaggttttgttggttggttggttggttggtttgagatggagtctcgctctgtcgcccaggctggag

SEQ ID NO: 156786 - DNA, 123 bp, Homo sapiens
tgagacagagatggaagccaggacaagggagcccaccgggcccagataggtacagagagcagaggctcctgttctgtcctcgccacccacgagggtgacactgcttgtaaatggtggctgtgc

SEQ ID NO: 156787 - DNA, 238 bp, Homo sapiens
ttgggctgccagttgcagatggagtgtgggcctggagtgagaacctacggtgctttttctgggcccatccatggccacccatggaccaatcatcacatacttactcccttctgagcccataaaaacctctggactcagccagactcacacagatgtcaggactaccagcggtgggaaggagctacccacttcagttctcctcgacttgttgggaaaacctaactgtgataaagagcta

SEQ ID NO: 156788 - DNA, 655 bp, Homo sapiens
ccctcaccagcttgtgttcccaagttagtctccagccctcctgaccttgagctcctgactcatatacccgacaactgacttgaactgtgaactggagtctcaataggaaattaacacttacgtgcccaaaggagaactcttgattttcccctctaagccactcgttttttgttttttgtttttgaggcagagtctctctctgttgcccaggctggagtgcagtggcatgatcttggctcactgcaacgtctgcctcccggattcaagcgattcttctgcctcagcctcccgagtagctgggactacaggagcgtgccaccatgcccagctaatttttatatttttagtagagacagggtttcaccatattggccgggctggactcaaactcctgacctcgtaatctgcccgcctcggcctctcaaaatgttgggattacaggtgtgagccaccgggcctggcctaagccattctttcccagtgaatgtcaccctgcagagtggctgaggccaaaacctaggagtcagcctttactcccagctttccttcaagttcaagacttccgcaagcccccaggggagcaccttcaactatcacaaaaacgtgtccaactctgcattttcaccctcacgtccctggcctgagcaccagcaaa

SEQ ID NO: 156789 - DNA, 178 bp, Homo sapiens
tcggtggagtaactgctgagaagaggatctggaagtacaccctggagctgtttcagtacttccgttgacatcaccctgggtgggtgggattggtgtagtaactgctgagaagagggtctggaagtacaccctggagctgtttcagtacttctgttgacatcaccctgggtggaacctt

SEQ ID NO: 156790 - DNA, 483 bp, Homo sapiens
tgaatgtagtaaaaacttgaattgtacacttaaaatgggtgagctgtatgaaatatgaattatatcacaataaaggtagtatcagtgtatatgctcagcatcatgcttggccttgataaattggtaaatgttagctaccaatgtaatagtaactctctgacttcatgtgcagagcacgtttatagtagcaaagatggaaagaaaggaaaatgctgagagagtagatgaacatacaagttaactcagataccaggtgagggagaaggtgactgaatctgtggcagcagtatggtaggagctgagtgctgcttttggagaaggtgaatgaagttatgtggtgcaagagcctgataccctaaaagtgtctagtaaacctgaatgtagttacccttaaaatgtggttgaacttgggtctggggatccagatgtcactaaacagtatcttcttcacaaaagagtaatcaccgtcagtgtgataaaagc

SEQ ID NO: 156791 - DNA, 189 bp, Homo sapiens
ttccagagggtccctgaggaggcaccccattcccatcttcctgatctgcccccactgcccacctcacagctctctttcctcaagcactcctctctcccttgctgactcctgggcgacattcagtcctgacagttacatcctagagaagccttccctgaccttccccctaattagaatagcctccaccat

SEQ ID NO: 156792 - DNA, 516 bp, Homo sapiens
cgaggagtgggagtgttggagggtgaagagaatggggcagtgaaagatactaaaaggatggaagccagttaagtagttgttggttatttgggaatttcagaatatatcctgtacttctgaatatttgatacttattctaaaagtaggatttacccttgagtcttgtatttcttctcattgctaagctttataatgtctattttagtggaaaattcctctagctataatctcttaatgctgccaatctcattctcatgatagttttagaataatagtgtaattttccccaacacaacaccccctggtgtttctacataagatgcgaaaattcccagagggggaaaacttccagtaaggggtggcatttatctttgatgatactgtttcttttcccttttctgagcattatagttcatgtctttgtagctaagagtggagggaggattctttttggatcgtattagagatttatgttaacattcctaagtaaaatgttaaaaactttttggagttaat

SEQ ID NO: 156793 - DNA, 336 bp, Homo sapiens
tttaaagggctttcatgtggaggaagaatttactccttgtgattccaaatggcatatctagaattaacatgcaggaggtagaagaagtcattttgtaatagagctgttcagaaatgtaacacagggtctcatgcagtggtgagttcagggtcactcagagtgatgctaaaagaatgattggccatatgaataaattagtcgagcagggagctgtactccattctgtgtttctaataaagccatttttgtttaatccccatagtcttatggtttttccctcttggtgtcaatggtttatttcaccttctatgaggaatctagaagtattgaagtttg

SEQ ID NO: 156794 - DNA, 564 bp, Homo sapiens
cccacacctttctttggagtctaagatcagccaagacctaacttcccagtttagttctgattcttgaccatttctctctgcatttcaacttctctaatttccttaaacaccaatctataaagagccatggacctttttccctttcactctatatcctggttagtttaattcttgttttctcacctagtgttgaaggaaggtacgtagtataataaagattgcattctagtgaaagatacaagtcctttttcagtcacgtgtggcctaggacaggtttgataattcccttaagcctcagtttgtccaaggataataggaatgtaatgatcattcccctgtctgcctcacatggttatgatgaaagtcatgtgagaccacatttagttccacaaatattattactacatatttaaacactctgaggtgttacaatgttaatgtgttagaaatatttatatattgggaggaataatagtatagatcaaaagtcagaaactggtgactcatgggaaccacccagccagtagatgtgttttatttggcctacatggtatttttatgtat

SEQ ID NO: 156795 - DNA, 241 bp, Homo sapiens
tggaaatatgtacacttgttgagcacataggccctgaaaggagaatcacacctggccctgtggcctattaggtacctaactatgggcagattggttagctcctctaggcatcatttttttaatgtgttaaatggagataatattaagacttacctcataaaatccttagaaggattaaatgaagtaattcatatacagcccttacgaacaaatgacatttgtgtaggtcagaaccaactta

SEQ ID NO: 156796 - DNA, 731 bp, Homo sapiens
gttcggtccatgcacagttcggtcccatgcacatgcacacaggggcttcagatagagatccgccctatctcaagggacagtcctggggctcccctggaaagggtctctccctgtcccctcttcgtggacaaggcagaaaagggtcgcggagggtcctctgcccccgcctgcctcccaggtgcacgggcacaagcatcgtaattctcaggcctgccgtgtgcaccgggagggagccgggcgcctcggacgccacctggggccctcacagctctcctggatcctcctgttctcacaggctagagaacacgggtttcaggccaggcacagcggctcgcttctgtcatcccagcactttgggatgccgaggcgggtggatcacctgaggtcaggagttcgagaccagcctggcctacgtggcaaaaccccatctctactaaaaatacaaaaattagccaggtgtggtggcgggcgcctgtaatcccagctacttgggaggctgaggcaggagaaccgcttgaacccgggaggcggaggttgtaatgagccgaggtcatgccacagcaacaagatcacttcagtctgggcaacaagagtgaaactccatctcagcatcagccaacctgggctcgagtcctggccccaccgcttcccaaggccgtgacctcagacaagctgccaaccctctcgagccctcagtttctggaactacagaacggggacatccataggac

SEQ ID NO: 156797 - DNA, 359 bp, Homo sapiens
ggttgtctccactattctaattgtttagatagtaagtctaagtagtaagacaaagttttgaggtccccaaggggaagaactgcaacatacaagactaggcttcttccacaccataagctaagactgaacattatatatagtattgaattaacctaaatatccaaacattcatccaagtgaacccaaacatttagctaagatactctctacccaaaggtcttggcaatcaccatcaatggtctgcaatgcaaacaccaacatgtttaaagttgtgtctaattgatatacaaagaaaaaattttaaatgaaccagcctgggaattcagaatgaacttcagcttctagcatgaggtaccacc

SEQ ID NO: 156798 - DNA, 183 bp, Homo sapiens
caaagtaatatttaaaagtgtaaactcaatgatttcattgatttacataaagacctttcaatgattttcctatgattcttccattaaaatctatgttcttcttctttacttacaggagtctagctgcatgaatattcttccatttactcttcaaaccaagcttcctcctgcctcaggaaatat

SEQ ID NO: 156799 - DNA, 850 bp, Homo sapiens
  misc_feature (229)..(229): n is a, c, g, or t
gtaacccatggagtctattcagccataaaaaaagaatgagatcctgccatttgcaacaacatggatgaaactggagaacactgtgttaggtgaaataagccaggaacagaaagacgaacttcacacgatctcactcatttgtggaagctaaaaattaaaacaattgaactcatggaaatagagagtaaaggatagttgccagatgctgggtagggtagtgaggtggtgngggagaaatagggatggttaatgggtacaaaaaaaccagaatgaatagtcgggtgcagtggctcacacctgtaatcccacactttgggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcctaggagttcaaggctgtagtgaggtatgatagtagctatgtagtaatgccactgtactccagcttgggcagcagagcaagactctgtctcttaaacaaacaaaaaaaccttcctttgttcttccttccctacctgtgaaataaaaccccaaatcatagattttcattcataatctggttgcagcctatctttctagccttctcttccactgtctgtttcttctctaccattttaagcttcctggtattcctagaatacgtaacctattttagggcttgtacttactttacaggatcccatttagataccaacttgtggatgaggccattttaactaccctagaaaaaagtagtttctaagttttttttta

SEQ ID NO: 156800 - DNA, 109 bp, Homo sapiens
aagtcattatgtggccttaataggtggacagaaatcgggtttcatgcaattatgaagttgagtttttaaagtaaatgtgcagccgggcacggtggctcacacctgtaat

SEQ ID NO: 156801 - DNA, 332 bp, Homo sapiens
ccttgtagggcatgaagacgaccagtctcagaaatttctctggccaaaaaaaattaagtgtttgaggctgggcaagggggctcacacttgtaatcctagcactttgggaggccaaggcaggaggctcatttgagcccaggagtgagttcgagaccagctggagtaacatggcaaaaccctgcctctacaaaatacaagaaattagccaggcatggtggcatgctgccagctacttgggaggctgtggtaggaggattgcttgagcctgggaggttgaggctgcagtgagctatgattgtaccactatattccagcctgggtgacacagcaag

SEQ ID NO: 156802 - DNA, 788 bp, Homo sapiens
aagaaaaaaagctttatcgcaattataaaagagctgttggaaaaagtacttgatgcaaattatttgacacactgtaggagagtgtggaatgttcacatttgctgttcatcaaaatgagttcaccacatttggaaataaacacaggattttccccctactttttaaaagaaggcagttatacacatttacaagtagaaggaaggaaaagctgtgggcttacatagggccgagctttgaaacagtccattatccaatgctgtgtttggtgagtgtgcacaggacttctaacacagggcttgtacctagaaagccctggctttgcggtttgtacagtgagtgaggctgcgattgtcatactagccagacagatttctgcagcccagctttgcactcttttggcttttactttctttctagagccaggatttctagaatagttcggactcttgtatgactggccagtggaagtcactatgccagatcatcttgtgaaaagaagtacatctaatgtacttttcttctcattaggatggaaaagcaggcatagtctagtctgcaggaggacagttgtgataaatcttggtttaattacagctgccagtttttgaaagtgtcctctttaatgaaatgaaaagtcagtgggtcgtaatcaccacctggatgaaacaaatttttgggtaccttacttagtccagtggtatatgtaactagcgtctgcatttcagacttggtgtcccttttattcaaatgcagtataacaggaagtgaataatatcctacctatccta

SEQ ID NO: 156803 - DNA, 385 bp, Homo sapiens
actttccacagcttttggtaatagatagggactgtttgttttatggctgaagttttgtgaaacaattattgcatttcatacattctgctcatggttattgccttagtttttctttagtttgtcttagacatctgctaatttgaggatgttaatttttttctgtatttaaaatatgctgatacttggtctagttttctttgtgagctccttattctcaaacatgcaactgtgaactgatttttttaaaaagggacatttacgtttcactccttcagtataggaatttacgtttttagccttctgtgaaatcagggaatagattcttatctttgccatttataaggttgcattaggaaggtagatttttgaacataaaatgaaagta

SEQ ID NO: 156804 - DNA, 623 bp, Homo sapiens
tcgccctggtggaggtgttactattgaatagaataatctcgcagaacactaacatcagagaaggtcacctgtgtgactgtgctgaaataggaccaaaagtaagtaaactttaaaaaaaacaactcataatcgtttctaagtagtgacaaatccaagatcatcatacaaaccacaaaaatcaccaaatatcccctgctcccggccagtaagagtgagggccgaattcccacagtccccaggtgcgtgtttccctcgcggcgaagagtaacaactctagttctgcggaaccacatgtgtgtgcctggtgctctctggctgcacttgtaacagccaacctcacaaaagctgaggccttttgaaactcaaaactgccaagctgaacaccacagtttttctttttatctaccatcacaggagtctagcccaccactttaaaacctctagcactggccaggcgtagtggctcacgcctgtaatcccagcactttgggaggcagaggcaggcggatcacctgaggtcaggagttggagaccagcctgaccaaagtggagaaacccccgtctctactaaaaatacaaaatttgtaatcccagcacttggggaggccaaggcgggcggatca

SEQ ID NO: 156805 - DNA, 279 bp, Homo sapiens
aagccagtatgaactgttagttgacattattcatatgaagatgttaagcaagaatttagaaatttaggcttggagtttaggccaaagcctggactaatggatcatctctatagggctgttatgtaaagagtgagaatggttgagctccccgaacaagagtatgtagagtaaaaagagaagcaagcatacagtcttcaggggactcctgatatttagaaatggtcaggcaaaaaagaagttaggagaggagatagagcaggatctgcagagaagtggagg

SEQ ID NO: 156806 - DNA, 329 bp, Homo sapiens
ggaattcaaagttaaagtgagccaggatctcaccacagcactccagtctgggcaacagagcgagactctgtctaacattaactaaataaaaagtactttataaggattctagtgaggaggccgaccagtcaaagccaaatacaggcttctcacaaatgccatgcagtgattccaaccctctggcctcatatatgacatttggaacaaaacgaggaaacgaagaaatgcggatgtaacatcgaggcttatttcctcctgtctcacgaaggactgggagccatttacagaagaaaccctggcggctccgcacggctcttccctgggacaat

SEQ ID NO: 156807 - DNA, 502 bp, Homo sapiens
tggttttgaaaaggtctgaactttggggaaaattgtttgaaatttattttggctttccttgcccgtggcagtaccttgaaagtaactgaaacataagcttgttttggataacctttcccttgcaaatggaaattgtacatacacacagcagaattcacgttggctttttttttctttttcaaatcatatttctggaaaatcttggaagggagtttgtgctttgtggccagtccagggtgggtgtaagtcatgaatgattggtcatattaagactgtgctagacccttttgatcaaaagcctcgctagggatgctttctacttatgatcctctgtccatgagaatataccagagagtaggtattaggaaatccttgacagattgacttgattaaggaatctttacttttcccccaaagctgtgaacataaaggtttactcagggttggtaatagagtaggatggtagttggaggttctcgccctgccttgaggtagagctgca

SEQ ID NO: 156808 - DNA, 463 bp, Homo sapiens
tgaaacccagtctctactaaaaaatacaaaaattagccaggcgtggtggtgggcacccgtagtaccaactacttgggaggctgaggcaggagaatcacttgaacccaggaggtggaggttgcagtgagccaagatcgcgccactgcactccgcctaggcgacagagcaagactctgtcttaaaaaacaaacaaaaaaaaaggttttctgattgtttcttttccttttcagttgggaaagacttgagcagggtgatgtttgggtttccagccttaggccgcagcattagggaatttcagagttagcaggggctgcagaatcatcctatctgtgcctctagggcatgctcctggagagccaggagtcggtgggaaggatcggccgattcattgctttttattgaatctacaacagcccaggccccttggcctcccactgctgtcggcagcagacaaacacaacca

SEQ ID NO: 156809 - DNA, 571 bp, Homo sapiens
taaagaaagcaaagcagcaggctatgcagagatctgaaatgaaagtatttcaggaagtgggaacggtgagtgcaaaggccctgagatgaacagcaaaggaggccagtgtggttagagaagaatgactagggtttgaaaaggaagtagaaacagggtactggagataatgaaagaagggaacaaaatctcttcaggcccttggcttttatgctaatatgggcagcctctggtggactctggtagaataccatgttcatgttctgatgtttaaaatgatcatactcgatgctgagctgaaaacagaccgcaggctgtatacaagtatctacagaagtgataatgccaggatctcccatgcttgatgctccccagtattccttctgagttccctatgtatgtggctgtgtaataacagctgtcattggacttgaaggaaaccaagaactgggattatgtgatatgccatatatatgaaaccttaatgcacaacttcttgtatctggctccattattaccaaacattcaacccctatttctaaacactgattagaacatttgaaatttatcacac

SEQ ID NO: 156810 - DNA, 128 bp, Homo sapiens
tgtacagcagcccgtgtgccgaccttgtgcgtacgaatgtgttcgtgaccctgtaaatcctaggccggcatcctgtgctaccccaaagcctgtggccttccctggctgtgccatctgtagatgtgtgt

SEQ ID NO: 156811 - DNA, 200 bp, Homo sapiens
atggatcaaacagaaccagcaaaagctagaacagtttggaagtttatccaactgtgtcaaaaataaaggatcaagaataacaaccgggaggaaaaaggcagctgaaatgacctgaagattactgctgctatcacccactggctttgactgaacagcaactaaattctgtaactaatcccaggcagaacacagctagatag

SEQ ID NO: 156812 - DNA, 357 bp, Homo sapiens
catattgcctgctaataagagcataggttgtttacactcagtctgtctggtattagacccagctcatctgtttactagcttggtaaccttgggcaggtcatttaacttcttcccacctcactttctttatctgtaaaatggggataatgatggtctttaacccatagggttgtcatgaggattaaatgagctaatgcacacatagttgttagcatcctgctaagaaacagagtgagcacttaacaaatgttagaaacatgagctggtggtgttattttcaacgttggagactcaggtcctctgagactctggagtttccactttagtcctgtctagcagtaggcttgctagtgcaac

SEQ ID NO: 156813 - DNA, 264 bp, Homo sapiens
cacaagtcgatgcttcctcctttaaagaaacttttaaaagccaaggagtcaaagagccccaagcaggactcgaaaagctgatgaagtctggaagtaaatgaacccgcctcctgacagaacagcttccccgaaacacgggaaaaaggggattcctcccccgacttcgtatctgtctgcttccgagggtgaacgctaagcagcagatcccatctctccactaatacctgcggcgcacccggggaggaggagcgggaaacggcgagg

SEQ ID NO: 156814 - DNA, 287 bp, Homo sapiens
ggggcctaggaggtcattgtcgggggtgtgagtttgtacactgggcaagctgggatccatggagcagcctggacaggagcgatgttgcctgatgtatgtccatgaagatccgtctggctgccgtttggagaatgaagagggcagggtgaaagccaggaggccagttggagactgcctcagacctccaggcaccagggacggggcgagctggcagcagcgaaggtgctgagaggtgactgactatggctggagtttaaagcatgcgtgggatttgctgatggactaga

SEQ ID NO: 156815 - DNA, 420 bp, Homo sapiens
agaaagaggagaagagagaagacagagaggaggccccacactcttttaaacaaccagatctcacctgaactcagagtgagaacttactcattagtgcgaggatggcaccaacccatggtggtggcatgcgcctatagtcccacctgctagagaggctgaggtgggaggattgcttgagcccgggatcccaggaggtttcagtgagctgagatcatgccagtgcactccaacctgggtgatagagcaagactctgtctcaaaaacaaaaacaaaagaacaggaaagagagagaaaaagaaatacagaaatataggtggccaggctagtgtgatagcagtagaacgaggataaggggttggattctgattatattttgaaggaagagtccaggggtttgctggtaggttggaggtgagatgt

SEQ ID NO: 156816 - DNA, 416 bp, Homo sapiens
atcgtcgtcatcatcatcactatggatgggtcctccacattaaaattccattcctcaaaaacatggatgccttccaaagtcaaaaagacaaaaatcaaactcttgagcatggcattcaagccactggacaatatggtgccaacgtattaatactttcctagccccacctcgtgactgatctgccatgtagaagtaaactctacacttaccaagccctcacaattccaaaaacttgccaactactttcaccttctggcctttgctcctgctttctcattggcctgaaccacccactgtctttctcaacccagcagaattggccttcaaaaccagacaacattgtcaatatctctgtcaacactttaaattgtaccctattaaaaacaggcaaatggaaggcttccaaattggcctgc

SEQ ID NO: 156817 - DNA, 311 bp, Homo sapiens
ttcactctgagcccataaagcaagcagaaagccagccccagaaggtagcagccctgttgtgggcagctgtccccagggctgcagaggacccacgttcccggccatgtgcagttcccggcactgtgggagctcctgtaacattattacccccaccagtgttgttgctaatgtggaaaccgccggccggcaggcaggactgtcctttcagctgaggggaaagagccactgtggagccaggataccaccagggggccagggtggaagagagggtctgagtgagagcgccgccccgagtgtttcccatggggctg

SEQ ID NO: 156818 - DNA, 414 bp, Homo sapiens
cggtgagctaacctgatatatcagttttgcatagcatccccacactttcagtttcctgctctctgtccttagcatttatcacctatctaacaccgtcatgtgtacaggcaggcccccttttctatgggttctctatccatggactcaaccatgtggattgaaaatatttgggctgggcttggtggctcatgcctgtaatcccagcactttgggaggccaaagcaggcagatcacaaggtcaagagctcgagaccatcctggccaacatggtgaaaccctgtctctattaaaaacacaaaaattgttgaccgtggcatgtgagtatgacattagatccggccacattctagacaggggtgtgcttagtgaagtctgaatttaatgtttcaacctaagcatctaggagcagctctg

SEQ ID NO: 156819 - DNA, 184 bp, Homo sapiens
gtagccactatacacctaggagagtgctgggcaggcatgtcttactttgcaaacactcgaggggactaacttccacctcctctgctacttccagctgcttctaatcacacttttagtcctctcctccattttacacacacacacacacacactcactctcacatacacacactcatgcataccc

SEQ ID NO: 156820 - DNA, 712 bp, Homo sapiens
tgtatccttggaactgtcaagtatataattgtcttagtagcctcttcactcatttgtgccttaaatttctgtctttggttcagtagtatgaagattatcttttatagagccctgattatttgtcagatattatcataaatgctgtgtaaaactatctcatttaatcctcaaaacaatctttgatatttgtgctattgttcccattttactgtgagaggcccaggatatgaatgcaaggcttttacgcttaaacactaagaaactgcttccaaaatgcttaaaaatctttccaactaagaagagataagaaaccaagagggagcagttgacttcatccatgccagcccaagaagcatcttacatccaagataaagatattttctcccactcttatgaaggaaatggtaaccaagggagtcaatggtgggcttaactccagaacgtagatggcagaggcctcaagtgggcaaggcatctcactgcagcagaggccagggtgagaaacgattaggcatacgaagagggacacagcaacggagactcaaaaaagaagggccacacaggaatcagaagtgccacatcttcatgtcttcttccagtaaaaaacagacaagagccatagatgaaggcactggaatctttgtatcactgaggattgctggaaggaggagagatgactgagaatacaaaaatcagcaacagcttgaaagaa

SEQ ID NO: 156821 - DNA, 351 bp, Homo sapiens
tacacagaaaaacatcatttaccttctaagggaattctgtttgtccaagggtacccatgtgatgtcacagccagacactgtaccaaggtacaggggtttttgcactgcattcataccctgaaagctttctaaactgcacagcactaaaacctaaacctaccaaattttcactaccaatgcagtgttttctccccttactctaatgtggacttttatgttcaaattcagttagtctctctatcatgcctactaaatgatactactaagaattcaaaagatgaaagtaattttaaagataatttagtattaacagagatctctcattttagagatgaggaaaaagaaatcacc

SEQ ID NO: 156822 - DNA, 415 bp, Homo sapiens
ttaactgcttaccaaaataaaattcaacactttttgaaagaagacaacataatacagaccccttaccatgtaatatgacaatttctagcttacaatgaaaaattactagacataagaaaacacaagaaaatatgacctgtagcaaagaaaaaaagaagttaatagaaataggcctaaaggtgacccagatctagaaattagcagacaaggactttaaagcaaacatttgaagtatgtttaagaaattagatgaaaacgtggtaataataagtgaacagagaggttcaaactattaaaaaaaaaaagaaccaaatggagattcaagaacttaaaagtctaatatctgctatgaaatacttatggtgctaagagagtactgaagatgtcagaaaaaaagggttaacttgaatacaga

SEQ ID NO: 156823 - DNA, 571 bp, Homo sapiens
aagagagaatgctgaaggtcaaatcaaacagaatgatgttgggatcacttgtgtcccagtatggtctatggttaagagggcaggctcttagccaggatgcctgggtgtgaatcaaggctctgctgtgcacttattggctacttgacctcaatctagttacccaactttttaagcttcatctgtattattgcctatttatagattaaaccaggattaaaatttacagatttatagattaaatcagaattaaaattaaatcagtcagaattaaaggaaataattcaagtaaaccacagaagaagcacttatcgttgattacaattaccaccgttacagtgaaagagatccaagtttccccgagttactggcagcatatctgtatgggtccaaaattcaaccgaggggcataaagcagaaaagagaccaagccaagtttcagagaaggagtggaagtttatttaaaagcctttagaacaggaaagaaaggaaaattagcttgaaagagacccaagcaggcactgaaggtccaagagagaaatgagagcaaaagaagacagcaaaaggggccttt

SEQ ID NO: 156824 - DNA, 235 bp, Homo sapiens
cttccccgtggcttctattgcacccaggctgctcatcgcagccttagaagctgtgtggtggctgctgctcacagcagggcagagctcgaccggcatgaggcattcctgcagtgcagtctaggacagtggcccaggaatgatttccttttctctttttttagagacagagtcttgctctgtcacccaggctggagtactgcggcatgatcatagctcactgcagcctctaactctg

SEQ ID NO: 156825 - DNA, 513 bp, Homo sapiens
taaaggccctgtttccaaatagagtcaggctgagaggtagttggggccaaggcttcagcatatgaattggggcgtggaacacagttcagcccatgagccgagtagcctgaacactcctgggaccaagggcatggacaggaactccgcggtgatgatggccttgggtgaggtttgagtcagcgctcgagcagctgctctgttccgtttcctttgagacctcaggaagaatcagctgcgtactctgttgggttcgtgccgcctccaggaaatgatcctggtcgcacccaccatggcacagctgcctgatggtggggaggactcagaccatgagaccctggagagattgcctttggctggccgcaccttcacggattcattcaacgctgagctgaaggccaggtgcctttagcatcgcagtttgggcctttatcatctctcccctgagctctgtaccctcttctcatagttcctcctgcctcttctcttgccccattgcaatcctcccacctcagc

SEQ ID NO: 156826 - DNA, 232 bp, Homo sapiens
ccatggagttcttgtgctgggagttgaacttatttaaaagtactctagacagattaatttgtaatataaccacttgcagtttctggtgtttaggactggatttctgtgtactcagtttcctgaagagacacaagaggcaatgctagctaccatgagacttctggtagctaccatgagacaagctggccaaatgagcccttccaaaattccacttcctgcaaagataacaatg

SEQ ID NO: 156827 - DNA, 265 bp, Homo sapiens
ccaacatgtcgtaatatgtaacttatatgtgaagaaaatgaggccattctgcttcaagtaagtcatctgccagattgatgtagatattgaacaccttatgcccaggccccttttcacttaacctttctaattttaggcttccatagagcattgccttcttgatagtctatggctgctttcaggttccaaatacctgagagttgcctcagtcaatcaataccttctgtcatgctctattacagctgatcaatatggacaaggatgc

SEQ ID NO: 156828 - DNA, 742 bp, Homo sapiens
ggcagacctggtcacccactacatttcttggcccccacctccgcgcccccctcccagtccaagcaactcagcggttcccttgcttcacagcattcacctctgccctgctgtatcctgagacccctgggtagggctcccagcctcgggctctgggagagccagaaggttccattcttcatgcaggcctcaccagtctgccctgaggctaggccacacctaagtgaccctttgaggggcaacatcacaacaaatgagctataaaactcgactacaatcctttgaccaaataaccttactcctggcaatctgcccccaagagtgagtccagagaatctaaaaagatgcttctggcatttcccatgcacccgaggtcccaggtggcagagatgtccatacagctaggacccaggcataaccatgagcttgctgggaaaaaaaaaattcaaaacagggaactgcacattcacacacgctagaaaaaaatgatcaaagtcaataaacaagaacctctaggaggccaggtgtggtggctcacacctgtaatcccagcactttgggaggccgaggtgggtggattgccggagctcaggagttcgagaccagcctgggcaacacagtaaaaccccatctctactaaattacaaaaaattagccaggcgtggcggtgtgtgcctgtaatcccagctactcaggaggctgagacaggagaatcactcgaacccgggaggcagaggttgcagtg

SEQ ID NO: 156829 - DNA, 209 bp, Homo sapiens
gcagggtgaaaaaagcagtatctgttatttcttaaagaaacagacaccaacacatggtgaatatcttagtttttttcttcttagtagtcagtttcttgaaccagtgattttctgatacaattggtcctaagcctgtgacatcagttcagttcaagcaatggggtcttctgtgtgaaagccacacactaggtgggaaacaggcaacctgg

SEQ ID NO: 156830 - DNA, 375 bp, Homo sapiens
ctctattaatgggcatgctgataagagcgccagttgcctttcccacggcactgaaacagagggaggtgagcgcgtgaacaggtttcgtccactaaacagatctgaccatgagtcagttctgagagggccgggtgatgaaatccagagccccttgtaggggcacctgaccggggcggtggagacagcccagcaggaggaaggaagccaaacccctccccaacatcccagctttgctgagcttgtatgtgggggtgggggccggtgtccaggaagaagtctgtcccgaccttgaaaaggtgccccagcctgccaggcggctggcatttcaagggcaagggcctgcctgcctgctgtctctggggcaccggcagctgg

SEQ ID NO: 156831 - DNA, 384 bp, Homo sapiens
ttcctgagtatatggtttatgatgagcaaacagctcttacttttgccttagactcaattagaaccaaaatgtggttcattagcactgactcttcagtctgatcttacattaatgttaaaattataacactcatatctcagtttaggcatataatttatattcatatttactatttaaaaacaggctgggcacagtggctcatgcctgtaatcctagcactttgggaggccgaggcaggtggactgcctgaggtcaggagtttcacaccagcctggccaacgtggcaaaaccctgtctctactaaaaatacaaaaaattagccaggcgtggtggtgggcacctgtaatcccagctacttgggaggctgaggcaggagaattgctt

SEQ ID NO: 156832 - DNA, 761 bp, Homo sapiens
agtttttcttgttatcccatcctattagtcctaaaactaactataaagagacattccaggaataaactccccaacagaaagtaatttgcttagtatagattcagtcatgctcttattcaagctaatttgtacatttcaccttgttaaatttcacttctgaaagctgctgtgattttccctctcagatgctcatttcatatctcaaaatgaacctccctcaagttaaaataaataccaccattagttaattatgaggtgccaagataaaggacaaataataagaacagaaaagcaccccccaaagccaatattataggttatatgcctaaaaatcttaagtcaaacatgccatttcttaaaagttaacccaattaaatgcaaagaaaaagcagctatggtggctgtgagtgtctgtgctgtcagattccaaacttaacttgaaagccaatagttaaggagaggtttcagaggaggaaaagatgatttaaaaaaaaaagttattaatctaatccttacgttctagtccctacccaagccactcacacaagacatcatgcccagtgcaggatggatacgctcccacttcagctacaggaaattagctctgcaaattcgatggccctttggtgaactagtctaatccttgtctcaggtttgccttgaaggggaagacacttctatttctcctgctttcaatatcaccctttctttgatacatctcactttcaccagtgcagccctggctttagcatagaacatct

SEQ ID NO: 156833 - DNA, 373 bp, Homo sapiens
tgagtgtggtatgacgtgagagttggagatcaagatgagtgaaatgcccaaacagggaatgacaaaggacagagtattgaagcccacgcgggttgagaagggcatgtatatgggagaacaccctgatgtgactggtcagagcttgagtgaactcatccatgggatgagagtggagccaacccaacacagggtgttggagtccaagcaaagtaaagaggacatctgcatgaagaaagggctgcaacagtgaagagtgggtgattaaataattaggtaaatatattagggaatagatttgagacagggtctcactcagtagctctggctggagtgcagtggtgcaatctcggctcgctgtagccttgacctcctg

SEQ ID NO: 156834 - DNA, 152 bp, Homo sapiens
aactttttgtttagtggacatactgtggcccagaagctttggcagaggcttagtagaaaatagaaaagcagctaaaaataggattgtagtttatttaaaaattgtatttagaaaagtcttaaagttcattatttattactgttttacagtgg

SEQ ID NO: 156835 - DNA, 373 bp, Homo sapiens
catttatgtagccgtggttggctgacatggacgacagatactattatgaattctttactgcaagaagggaagattacacagaggttgtcaagaacctagccacagggaagtgggtgtgacaaaaatctctgatttatacttctatcactgcaagacagaattggacaggtatgagggggatgctgttggtgtggggatcggcaaccaactgtgtgtgtgtctgggtgctggtgtgtgtgcatgtatgtatatgtgtgtgttgtgctcaagggatctcatgtgggggcagccaaatattacctggggatggggccataaaacacattcaaatatatgacaaagattctctgcttggccaaacgccagttaggct

SEQ ID NO: 156836 - DNA, 342 bp, Homo sapiens
aatggatggacggatgacagatggataaatggatgaatgattggatagatggatgaatgggtagacagaaagactctgatactggaaagtgaatccttcacatccatggcaagtgaaccgggtaacaaagtcagaggcaagaccatagcagcgtcatttgtcactgttgccatttatacacatttttggggcagaatcggtcatgcttgaccacaggtcatctctagagggtgaggattgggggtcaggaactgtggggtgggctcagggctagggctgccgatgtggcctttgtgcctgtgagcagactgcatttccatcagcctcatccccatcttccct

SEQ ID NO: 156837 - DNA, 379 bp, Homo sapiens
gatccctattcattgttgaccaccaattggaattcagtttaaaagagagaatttattataagaattcagagataccttgtggaatgtggcagtgggaatggagctggctcacaggaatggatgggctagaaaaccatcaggatcctgtccacgtccttattggggcttctgccagtgtttctgctcaatttcttccctttctccattgtctgccttctatggactctccttggaagtcccccgcttttagtaacagcataggaagctttaaaagtcattggttagtccttcacaagctgattcagtattggatagtcagacaacagttatagacatcagatagccagtgtagatcatatagatgacttatgtatgtcat

SEQ ID NO: 156838 - DNA, 387 bp, Homo sapiens
tgatgcaactgttcctcccattactagcagagaataagaaggttaaaatcagctcctgactaaatgactgtccctagataaagtatagatgaaaactatttccatttgttgcaatgatcagtatagcaaactctgtttgtgcctctctcttatcatttcagtgcacttcagttccatcttcaactgctaacaccaaaggtttttgtgtgtggatttgtgtgtgtgtgtgaggatttatctttccgccgcttttctacctgcctaacaagctggaagtggcagaaaatgaacactttccaggagcaactgtcaaccaaagactggcttatgtaaacatttcttgactcaggctctctcaggtgggaatactctgattcttgtgtttta

SEQ ID NO: 156839 - DNA, 321 bp, Homo sapiens
agagatggattttcttcatgttgttcaactttggcctcaagtgatcactcactttggcctcccaaagtgctgggattacaggcgtgagccaccgcacatggcctagactctgtcttaaaaaaaaaaaattgtatacagtattcgaaattacctaacagtgatactttgaccctcaataaatgttagttttcttccttttttcttagttcagttctgttggtaaattggctttatggccttaaaactgagtcaattaacttgactcaattttagttttagttgatcattgataagatttcagcgcccattttaagtctctgg

SEQ ID NO: 156840 - DNA, 428 bp, Homo sapiens
tttgggttgggcagcagggacactggctggtgggcacttgattgacctgaatgggcaagagggctggctgtggtgctgaacggacagcttccctcccttgctccttggtggcatcagtggcccaagcccagccctagatagacagagagcatgtgcctggagagggcctggtttcatctcaaggtgaccacacaatcattgggaaggaaaaaggagggtctgagggcttcatccaggtttacagcccaagaaagtcctgcccacagagggtttgcatctgtgctggtcccgtcatgagtaaatcttgcctgcttgagctggcgaggagtgggaaggaggaggaggggagagagaagtagcgggacagagggaggtaagagtcagaaagacacacagtgacaaggaatcacagaaagatgcactcaggg

SEQ ID NO: 156841 - DNA, 284 bp, Homo sapiens
tgtggaaccgttatgtatgcataatgaaaagagtcaagataatgcaaagttaagttccagctaaacccaaatgacgtgacaagttattttgatttcactgaatcctaattttcttttcttcaaaatttttgaacattcagacaaatgtgccacttaccttgcacatttgtcttaaggtctaaagggataatctatcatttttgacatatagaggccctcattaaatgtttgttctttcttatctctcaaaaatatctaccataatactttgaaactaagctcaa

SEQ ID NO: 156842 - DNA, 390 bp, Homo sapiens
atagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgc

SEQ ID NO: 156843 - DNA, 168 bp, Homo sapiens
tgtcctgcgtccctgcagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccc

SEQ ID NO: 156844 - DNA, 196 bp, Homo sapiens
accatgtactcgtcggctacatgtgtagcaagcacctaccttccagagttgtggaggggatttaaagtgcagacgcaggtaaacacaggacagtgccaggagtgtaatcaacatctaatgaatcctagagttatgattataatgctgatgttctatctatcaatgcaaggagttcatggcatcttggccccagttt

SEQ ID NO: 156845 - DNA, 272 bp, Homo sapiens
ctgcctggtcattgtcatagcacctgtatttctggttgtcccacaaaagttggcaaactttatttagatttttttaaaactttaactaagtttcttgcttcatggatagaaaatctgtggctgttttaaaaatacatatttaattgtgtgtgtgtgtgtgtatttatgttgagaatatctacagctttaattaattttttgtgaatcagaaacttttaggacattgctatagaaaccttgtctcattgcactaaatgagtctcattcctgat

SEQ ID NO: 156846 - DNA, 409 bp, Homo sapiens
tccttcaaaggaaaccttaaggaaaagtgtaactgctccagcgagtgaggcctgctcacccaaccaccagagccctaaagcatgttcccagaggggttccttgacagcacagtttgaaaactgctacacagcataatctgtaaggtcttctctggttctaacattgtatgattgccttctgtaaggcaaacagccttttctgtgatgaaaggacagctgggagaaacttgaaccagaccttgacagatgggtaggcttttgatctgcagagaggattccagagtcaaatagcgtgagcaaaggtgcacagacaataagcaaggcgtgtgggagggtccaggaggccaaagtagccgagggaagtcgggggaatgaaggcagtgcagcaggtgacataaggacatgctgg

SEQ ID NO: 156847 - DNA, 549 bp, Homo sapiens
gtgcatctttgttgttttcacacaacttctcatctgaaacaaagtcttaagttacagcagctctggtcttggcttaatggagtatatggcaaaaagaggatttggtggcagtgcctaggaggatttttttttttcccatcaacaatacttctcatttagcctgttgattgatacggattatcaggggactccttccagcttccctagttggagtttttttttttttttttccttttttgaaacaggggtcttcaaaaagggaaaaaaaaaaaaaaaacgctgttgggggcggctggggccccggaaaaactttctaaaaaccatgcggggggcgggcggggcccaaaggggacagggcaccggggcaaaagggggaccaaagaaaccggggcccagaaacgggggggggattctccaccattaaaaaagccccgggggacaacggggcgggctggaaaaatcccaaggggggaagcggggagccaacaggggcacattaacggggggccaaagagagccggaataaataaacccggaacggggggagac

SEQ ID NO: 156848 - DNA, 341 bp, Homo sapiens
tgctagtcaccttgcagtaaaactgcatatgctagagaacgcctccaattagaagaatgtgccttcgtgacttttgtatggggctcttaattgctatcacggtttgctttctctgtccatggcattttcatagcaatttctctgctggtgaaggcctggcactgttgcatctttcaagggttttggagtgcgagagggttataagaatgggaggtagaggtccactagaccatctgagacttcttcccttcatttagtcatttacatttatacatgtaaagaataactatgcacccagtaaaatgccagagatccaagagtcacattcatgatgataattt

SEQ ID NO: 156849 - DNA, 100 bp, Homo sapiens
caccctgcaccttcctcctggccccccacaccttcccccatctataaggggaaaggaatgggacagacacgtggtgaggctaatccttgtcctcaaggcc

SEQ ID NO: 156850 - DNA, 582 bp, Homo sapiens
tgcagacacaacatactttaaaaatgactgcatgtttggtcagagagtctcaacaaatttggaaaaattaaaattatacccaacatattctcaggtcgaatgaaatgcaaatagaaattactgccaagaggaattctcaaaaccacacaaatacgtggaaattaaacacattgatcctgaatgacctttgtaaagcaagaaaattaaggcaaaaatcaaaaaattatttgaaaaaaacaaaaattgtgacacagtgtaacaaaacctgtgatattgcaaaagaagtgataagatttgtagcactaaatgcctacatcaagaaaatagaaatatcttgttaacaacctaacattacacctaaagaaatagagaaagaagaactaaattctaaatgaagaacccagttctagcagaagaaaagaaagaattaaaatcagaacagaactaagtgaaattgagataaagaaaactattcaaaggatcaacaaaatgaaaagtttgttttttgaaaggataaacaaaattgatagactgctagataaacaaaggaaaaaaagaagatccaaataagcacaatcagat

SEQ ID NO: 156851 - DNA, 447 bp, Homo sapiens
cttctgactccatctattttttctgccatcagctaagaccatctaggaaagaaggtattgggagagggaggaggagttcatatgaaaatcattttccaggacagtaaaggaactaggaaaatatggtatgattatctggcagtgtcagaggcgtgttaaccagagcaactccgtcttgaataggagctgtgtaaaatgaggccgagacctgagacctactgggctgcattcccagatggttaaggcattctaagtcacaggatgagagaggaggtcggcacaagatacaggtcataaagaccttcctgataaaacaggttgcactaaagaagctggctaaatcccaccaaaaccaagatggcgacaagagtgacctttggtcgtcctcactgctacactcccaccagcgccatgacagtttacaaataccgtcgacgcggccgcgaa

SEQ ID NO: 156852 - DNA, 457 bp, Homo sapiens
acagaaaagcctctacaaggtgcactgccaaagggcagggagggagggtattctgaagtttcgaaaggcatctcagtagcactgtatagtctcccttggtatctgtcatggagaactggctccagaacctcctgtgaataccaaaagccagggatgttcaagtccctgatataaagtggcatagtatctgcgtatcacctatgcacacctctagagtacttgtaatacctaacacaatgcctacacttgacttgatttgcatggattcaatgtagtacctggtgcttggcaaattcaagttttgtttttggaacttggtggaattccaccccacccataaatatttctaatctgaagctggttgaatccaaagacgcggaacccacggatccagagggctggtggtgacatctttagataccaccatgaaggaagggaagctctaccctgaggactg

SEQ ID NO: 156853 - DNA, 540 bp, Homo sapiens
ttgaagctcctcaggtgattccagtatgaagtatgaattatgaagtattccagtatgaagccaaagataagaacgattaggtctcttctttttctctcctgtacagctttggaccaactacatttactttcccagttcaggatacttgaggaatgattggtctagaagaagcttgttcttatgcagatatactgagttcattttcttagatcaacatgaaagaatgcaaagctaagcaaattatgcaaagggacttattctgcattccaaataattagctaacaaagctagttttgcctgcttgtattgatgtagtttaactggtaccaaaactaagaatgaggttactgactgatttttctgatttaataattctagtcctgccctgccctttagcctttgttttgtattctttggtatcaaaaatgaatttgctctataaaatcaaagcatcattaagaaaaacgtgacatcctctatctgtgccttatgtagctgggtccttctcactgtattctccagtagtaccgggcgtcaaag

SEQ ID NO: 156854 - DNA, 473 bp, Homo sapiens
cactctagtctaggcaacctaggagctcttattaaaaataaaaaaaagacaactagggaaatgtgagtgtggactacatattccataattttaagttatttggatgtgacaatggtattgtggttttgtagagaaatgcatattttcttagaaaacatatgcggaagtatttatggcaaattcccatgatgtcagtagcttgcttttgaatagcccatcataacaacaacaacatgagtgcaaatatggcaaagtgttctcaatcaccctgaatagccaaaacagtcttgaaaaagaatgaagttggaggattcccatgtctcaatttcaaattttactacgaaggtacagtaatgaaaacagtgtagtggtactggcaaaagaaaggagacacagatcaatggaacagaatcagagtccagaaataaacccttatacttatcctcaattgatttttaataaggatcccctag

SEQ ID NO: 156855 - DNA, 288 bp, Homo sapiens
ctcgtctggtttcgggggtctggcttggctctcctgcaaagttatttctagttaattcattatgcagaaggtataggggttagtccttgctaaattatacttaggataccccattatgtggagttcacacgaccacaggctcctccctttaccctgaggggctaagcaaggtaataggaagagacctttcctgctctccatttgagcatatgagttatatccatccttcctctttgcatgaacatacacaaacacacatgctcatgcataaacagggtaccgagctca

SEQ ID NO: 156856 - DNA, 144 bp, Homo sapiens
aatctttatcaacaaaatgagatttgacttttagttggaaattttcctgcaggacagttttagctttgggcttttcagtattctgttatttgtctagtttttggtcagtgaaagaagtaaaatctgtatatatgtaactccaga

SEQ ID NO: 156857 - DNA, 263 bp, Homo sapiens
cctgccaggggaggcacgaaacgggaacaaattaggaaacagtgtaagagtagactttttaacctgaaggttctagcatgctgattatgagaagcaaacatctatactataaccatcctatgcccaatttgcagctatttaaaatattcagatttcagatagaagaattatgtgcactaaaaatacattttgcctgagtaaagtgtgtactaagtgttgagtgtttttgacttatgaaaattgtgaatatccagtgtaggtgt

SEQ ID NO: 156858 - DNA, 114 bp, Homo sapiens
ccaaaatcacagatacatacacacattcacgcacacggcaacctcaggagcgtgacacaacacacacaaaaccaccactaagcaagtgcaatttgcagccttggagaccccaca

SEQ ID NO: 156859 - DNA, 287 bp, Homo sapiens
catcacacatcttccagtgcccacaaccaaatgggaagcaaatatggaacaattttgccaagtgttttctgaatctccttgaaaacagcacttttacattataagatgccactgtactaatgtaataggtagatgcagagaagagttattttgagggctgtaatttgatttcgttatcttaggcaatcaagattgtttaacaccagaaatagctgactagaacagctgctaaaacagcgctttgtgtgggaaatgaagaaaaggttcagtattttgacagccatttc

SEQ ID NO: 156860 - DNA, 539 bp, Homo sapiens
aagccataacttattaaagtggggttaagaattccaggttaaccaggttgaaccaatgtagctctaaatgtcagaattcagacttccctgggagatgtggatgtctcctgggttgcttggggtcctctatattgtcctagccacactaaacaaattatatggttattgcagaagcagtcccaacactacaggaagtagtgatagaagcagcttctggggtaatctatgaccaagttccacaatgcttgggggattggagctctcaaggtgtgcctgggtggtctacacgacagcccccacacacagcctggggtttgtctgtgtctactcaaacacttaacattgacttccaaagcaacatctgtgagaggttcatctaccaaagggctacaggagacagaatgagggtgttgatggtttcaagactcagatatcaacaaagcatcattatgcatttggttggtaccaagagacaacaagcatattattgtccttatcatccaaatataccatggctttcaaagttaatacatttatgg
